United States Patent 7,365,185 (GENOMIC PLANT SEQUENCES AND USES THEREOF) - sequence listing, part 84

SEQ ID NO: 79459 - DNA, 1972 bp, Oryza sativa
ctgcagccctgtgtgtctttgcaagtgtctgcaattgtgaacacattgtaaactacaaatttcacatgaaatggaaatatataataatatttatttcaaaagtaacgtaaaattaaagtgtgtcagtactagcgaatcctcgcaataatgaaaacatataccacacaagatttgggaccattaaatcgagcacaaaaacccatttatagagcatcctagctaccctcttcccctcatatctatcccctttccattgtactccccatacaccccttgtgccatgtctcaagaaggtcccaacaaccatcctcaaggcacccaagaaacccatgactgccccttcaccatcgccaccaacacaccgttaggctcgacaaagatgggctactccgactctagaaagtctgacgagaataatacctcgtcaaagccagcaagtccagtggtgtctagtgatgttgtagagatcaaggaaacatgggaaaatgttgtcgttgcggatgaagagggggaaggtggcgaggatggcttcgctagcgatgctagtgaatctaagtccaagagctcatctgatgaagttgattatgagctcttggatcttttggcaggtgcaagtgaaggatgcagcggaggaaacaacaacgatgaagtgaaaaactttgcctatgcagaccacaagatgcatgttttgagagagagggagagaaggaaggagatgaaaaacaagtttgagattctgcatgccctcatccccaacctcccagaaaaggtaggatttacaatcctatgggtttgcatacaaataaatcatttaagtatgtttgagatacttacaattttattttttttcctggcttgattagaaattctagatatgtaaataaaagagtatgtgcgatgtatttgcatgtttgttttcttatgacttgattaaattatctgttgttctctgacttcattaaataatctagatttacatagatagattatgttgtgttaattgctagattgtttttattgtttgatgtacagagatagaatatcctttttctattttgcaagggatagagaggtttgagctggccataacttttaggtgacaacagttagaattactttagatgtgtaccgtggtctatgacatggtgtttgagtgatggaatggtttttttcttgttatacaaactatactgccgtgtcatgttcaactacattttagtaacttttgattagatctatccataatccaaatcaaaatcgacatattgcttgcacattcacatatttatgttactaagatgttgtttaaattacttgtattggatttatggatgtatgtactaacttgaatgtcatcatatttattaagataagtaaaacccatgactagtccatagagttacacgtgatgttactaaggtccatgaacatacaaaatgcacatttagctcggttatcttggtttaatccatcacaacaggctcaaacctcgcgcggttgactatatgactggccacttggcgcttcacgctggcaagatttttgcgttcgctgccgttcgctccctccgaagcacaacgcggcagtaaatttgcattgaccgatcaattgattgttgttgctattgttgatgttgttgttgccgttgttgttgttgttgttattgttgttgttgttgttgttgttgttgttgttgttgttacttttatgcatgtagactgacaaggccactatagtggaggcgaccataaactatatcaagaacctccaagacaaaatccataagatggagatgctcaaggtggagcgcgagcatgccatcgctctcgccaccgccgcaaccgccaccgccgctgcctctgcggacaccgcgctgcaggcaccgccgccgtcggaggaggagaatgaggagcacgactccgtggtggctgcagcgacgagggagatggccctggctgacatggtgcacgcc

SEQ ID NO: 79460 - DNA, 3460 bp, Oryza sativa
ctgatggtaacgacgttgcggatgatcttggtcagatgttgcaggacgccaaggaggactgcgaaagtgaaaagggagcccataaattggacaagatgttagaggaccacagaacttcgttgtacccaggttgcgagcaggggcacaaaaacttggataccactctggagttcttgcaatggaaggcaaaaaatagggttagtgacaaggcatttggcgatttattgaaactcgtcaagaacattcttccggagggaaataaattgcccgagacaacgtacgaggctaagaagatagtctgcccgctaggactggaagttcagaagattcacgcatgtccgaatgattgtatcctatatcgcagtgaggagtatgagaacctagaagcatgccctgtttgcaaagcattacgatataagattagacgagacgatccaggagaagttgacgggcagctaacaaagaagagaattcctgctaaggtgatgtcgtatttccctataataccacggataaggcgtttgttcaggaacaaggggaatgctagaatgatgcgatggcacgctgaagagcgtcaacaggacgggatgctgagacaccccgccgatggttcgcagtggcgaaacatagacagaaatttaaagaatttggaaaggatgcacgaaacatacggtttggttttgagtacggatggcatgaatccttttggagagatgagcagcggccatagcacctggcccgttacgatgtgtatctacaacctcccccctggctatgcatgaagaggaagtacataatgatgccgattattattcaaggccccaagcaacctggtaacgacatcgatgtgtacctaagaccactggtcgaagatcttaagctgttgtggaagaaggaaggtgtccccgtgtgggacgaggacaaacaggaggagtttaacatacgagcgctgctgttcataaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcacaccactcggtacggaagaaaggcaagcacttcgaacataaggctgaccaccgtacgaagcctaaacatcgcaacgggaaaacaatgtttgctatggttaaagatcttaaagtagtgttcggaaaggggcctggaagccagcctatagagagcgaagatggtcacgcggcgatgtggaaaaagaactctatattttgggagttaccctattgggaattcttggacgtacgccacgcaatcgacgtgatgcacctcactaagaacctttgcgtaaaccttcttggcttgctaggtgtatacggaaagtcgaaagatacactagaagcacgtaataatctgaagaatatggaacaacgcggcgaccttcacccggaaccaaaggagaaaggaagccattacttgagtccagccagctacactcttagcaaggcagaaaaggaaagtatgtttgaatgcttggagagcataaaggtaccatctggatactccacgaatatcaagcgaataataagcacgaaggagaagaagttcacaaacctaaagtcccatgactgtcacgtgttaatgacacaactgctaccagttgtaataaggggtatccttccagacaatgtccgggcaataataacaaagctatgtacattcatgaacgcaatttcgcagaaggtcatcgatccggatagattagaaacccttcagaatgatgtggtgcaatgtctcatcagttttgagttgatatttccaccttcatttttcaatataatgacgcatctgctttgtcaccttgtgaaagagatcagtattcttgggcctgtgtacctacacaacatgtttcctttcgagaggtacatgggcattctgaagaagtatgttcgtaaccgtgctcatccagaggcaagcatcgccaagggttatggagcagaggaggtcatcgaattttgtgtagaatttatcaaagatcttcgcccaatcggggtacctgaatcacgccatgaagggagactacagggaaagggaactctcggaaggaaagcaataatgacggtagacaacaatttattccgtaaagcccattccacggttctgcaacaatcttcattggtagctccttacatcgaggagcacttggctctagttcgcgccaggaacatcggtaagtccgatgcatggattacacggcatcacattgatactttccccgcgtggatacgacaacatctcatgggtaacaagtcgatcaaccaacaacttgccttcctggcgaggggaccgtctggatcgatcgcgacattccaggggtatgagatcaatgggtacacattctacacgagagctcaagacatgatgagcatgaaccaaaacagtgctgttcgtgtcaatgccatgggacacgatggaacaactggcacgtattaaggtgccatctaggacatatgagaacttgactatggtcctctcaaggtccctctgttccggtgccaatgggttaggttgactggtggaggcataatgattgatgacagtgggatgacaacggttgaccttaacaaggttggatactcggacgaaccttttgtccttgccaatgatgtaacgcaagtctttttcgtgaaggacatgtctagcaaaggaaagaagggcagagggcctgacgagcctaagcgtcacgtggttctcccaggcaaaagaaaaatcatcggagttgaggacaagactgacgaggattacgatcagttggatgggcaaccccctttcacggtgacgattgaccctagcatcctcctatcaaataaagacacccctcactcacatagcgatcacaaggagggaacaatagtgaggagaaagtatgtgcggtcaaccgtcaccgccgatgtattgccgtaattattgtgtacacgatgtaaactattttggatgtattgattatccatataaatcaattgatgtatggcatatgttaattacgcacgattattagaggttttaacaagtttaaatcatgtgtatgctagttatatgcgatacttacaatttttaaaagttttaaatcacgcaggtggcaatttcatatgttaattagagtttttaacatttaatttactatcattctgtagcgcccgttccgttgtggcgcctagcgggaaaactatctcctaaaaaccctatttgcgaaatctgtttctttgcttgctgtctagtgtccgtgccatctcagatctcaaatccacaatctatcgtcgagttcaatcctgaatccaaatccttcccaaatcaatccctccgcaaaagtctattttgcctccctcgggttcgatgggccgaatccctctcggcccatctttc

SEQ ID NO: 79461 - DNA, 13140 bp, Oryza sativa
gtcatcgcccggcccccgccactccacgcgctagcctccaagggatggaggcagagctccccccctctaccgcgtcgcccccgctccctcctccttttcccaaagaggcaaggggcaagccccctttctctcccccattttccccctttttttccctctcgccggcgtcacctcctgtcgccgttttggccgctagccggagcgccagctcgccggcttgaccgtccaatgtcggttcctctctcccaaaccgaccttgtcgcccatttaaacccaagctccccccctccaatctccctcgtgttcgtctctcgctgccactgtcgccctgttcgccatcgccgttcgtcgttgcgcgtgtcggaggagccggcacgagcaaggacgcggaaggggactttggccgcgcaatcttcctcctcttcctcggcccgaggccgaaacgatcacgtttcgcgccgtcggctctcgtcactgcgcccgcccgcacggtagtgcctctctccgttcttccacctcgttccatctcctccccttagactcaggtagtagcacgagtagcctccccgtagctagccggcgccgccccgaccgttgccgccgctcgccatgtgctcgccgccatcgccgcccgagctcggaagcgcctttcgtcgccggccttcctcgatgcgtttcctcctaatccaacgctagggacggattcccgtagccgcgtagatgctctcgccgccggtaatcggcccctcgtgacctcgtcgccgtttcccccttcttccgccgccggttgccgccgccgcaattcgccgccgtcaagctccctccggcgaatccgagccgttggctcgtttcccctcgtcctgtgcaaccacccggtgtgcccgctttcgcctgtatcgccgtggttcgctccgccgctcgccgcggtcgtctgccgtccgttccggctggcgtcgtcgtctacctcccgccggcccgcgtggcagccacgtaggcgccacgtcggcgccagctcggccaagaccgggtcgagtcgaccccggtcagccgctccctccggcaccgctcacgggcgcggtccaccgcgagccatgaggctgcgcgtgggcccgccgcatccgtgccctccgcgaaccgcgcgcgtgcgccgcatcccttccccaaaccctagcgcacgccgcatactccctccgcatggtgagccgagccgctgacaagcgggtcccacccgggaccacgcgaggtgagcccggtccaccggctccctctctcctcccctcccgcgcgcgctctgggccgccttctgggccggccggcccatttagctcggccgagccgccccttttctctcgggccgcgccctagccgcccgagggaagtctaattcccctccctcttccttttctttttccaaaagggtttaaataaattctttttcctttagaccaaaaaaccaataatcttagaaattcaatatgttcccaactgtaaatccgttggactccgttcaacttccataattcctcaaatctcgagatctatctaatggcatgcttagaggtcattaatagggctttatttttcgccgtttgttgagttgtcccattttgcgtgtcgtttcggagcctgaagacccgcagtgcgaggatttcgaggatcaagctcaagatctcgagcaaggcaagccacctttgaacatattgagccaatatttgaacttaattatattgcttgcaaaatattatgcattgataggattacacttaatttgtttgcgctgtctgaaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacataaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttagtctgggacccctctcgtcggcatatggtaaacctgtgtcggctttcgaaatgccttgtcatgaaaacttggaggtctcccgacgtggctgatccccacgggctgggtgatccggttagtaatgtcgtgtgggtaaagtgtaccccctctgcagaggttaacaaactgttcgaacagccgtgcccacggttatgggcggatgtgaggtaattcctagcgtagttttgtttgactactgccttgtgaaactgctgttgtggaaaggggatcgatgttggaaaaatctgcagctgatgggatcagctaggcccgggtggccatttgaaagttgttgcccgggtggccgtttgaaagttgttggccgggtgccaatcttgatcaattctaaggactgatacattgcacatactccgaccggacgagacgcactgtctcatccgtgtcgtttgagaagcactcacttagttgatttcagaaaagagttcaaataaaatcaatttgcaaaaacaacagcctttccttgaagcctgcattaaacacttatttcccatggcttgctgagtactcttgtactcacccttgctctatataaatatccccccccaattgctgaagaagatgaagcggatcccgctgacgaggagttcttccaggagcaagccggctacgatgagttttagggtttcagcctagttcccaagtcacgcctgtgatgtttggtccaagtcttggcttctgcttcccttttgtaatgcagttgtgagctcgggatctgtccgcagcccaacatgactgtacctctactctataataaagagacctctgttgctgtgatattctgtcttcctgtgataccagcactgtttcctgggactggtatcgattaataggttaatttggagcatcacgggctagttccggtcgggactagttcggggcgtgacacattcatatgctaattataattgactagagaatttttaaaagtttcaaatcatgcatgtggcatttacatatgttaattagagtttttcacaatttaatttactatcattcatatgctaattatatttgactattcgaatttttaaaatttttaaatcatgcatgtggcatttacatatgttaattaaagtttttcacaatttaatttaatataattcctttgctaagtatatatgatgattacaatttttattaattttaaatcatgccgtatgtatatacatatgttaattagagcttttaccaatttaataatatcattcatatgctaagtatatatgattattagaatttttattaattttaaatcatatatttgcttattaagttttatccacttaatttattatagacaacaataatttttcgaagtaattgtcattaatctttgtactttaaataattgtaatgcattatcttctattttagaaacacatatgtaatggaaaataatatttagtgtgcttatcagtagtcccggttcttaaccctaaccgggtttaaaaagaatttggaaatagcgggaaaatatctttagtcccggttgatagaacaaccgggagtaaagatttctttactcctggttgttgagatcttttttttagtcctggttgttctcaacaaccgggagtaaagatatctttaatatctttactcccggttgttctcatcaaccgggactaaagatctagggctatatatattcccagtgcgcgccctcatcttctccaccaacacttagaagtttttgcccgatcgatctctctcggcttctccttcgccgccactgcctagggcatccccgcgccgacgccgccgccatatctcgccatcatctcgcgctcgtcgtcgtcgccgccgccgccgcctcctccgccgccgccgcatctctggggtgagagccgccgcgcgccgcctctctctcgatctctctctccaatctcgatctctctctctccctctcggttgccgccggccgccgagtttcagacgccgacgccgacctcgtcacgacacgacgccgcgccacgacgactccacgccacgagacgccacgtcgccgcacgccaccgccgcgccacgccgatgccgcgcgcggcgccacgccgccgccgcgctgccccgccgccgctccgctgccaccacaccgagaacgtgaacgagcgaacgaacgtgaacgagaacaaggtgaatgaacgtgaacgagaacgagcgaacgaatgtgaatgagccaacgaacatgaatgagaacgagagaacgaacgtgaacgagaacaaggtgaatgaacgtgaacgagaacgttgtcggacaaacgtgaacgagccaacgaacgtgaacgtgaaatgcaattataggcaggttaatgaacgtgaacgaagaaacgtaggtgaatgaaacgtgaccttaacgagaacgcgaacgtgaacgatatcgtgaacgaaatgtgaacgtcaaatgcaatatatgttacttcgcgtttatcctaatacatatttttgtatcttgcagaaaagacgttgtcggagtcgtccctcaagccggagtggtagagctagccctcgaaggaattcgcccaggcaagtaacgtaattatatatatatgattgatatatttgtaatgcaattaagattattagatttgtaattagacttaattagcatataagattatgtagtgttctaatatacgacagttacacttagaatacatgactatttgagttttagtagaagattattggagttttagtataagattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggtcctataatatacgtcacatagacttagcatatatcactatttgagttttagtataagattattagatttgtaattagacttagcatgtaagattgtgtagggttctaatatacgacagttacacttagcatacatggctatttttgtcttagcatataagattatttgagttttaatataagattgttaaaacataaatgtctcatgacttagcagatatttcctgtataaacaggtggctgatcgcgatgaggaacagatattgtacgattcaatcgcggagggaagcagccagtactggaacgaagaagaggggaacgaggatccaaaccagtatttgaacgaggaagggaacgtggagagggatgcggaggggaaccaggaggggcacgtggaaagggatgtggaggggaaacaggaggaggaggctagtggaagtcaaccctccgttggacagaagagggcacgcgggcaacgaggtgccgcgaagaagcttgagggttggcacatcataacggaagtggaagaagatggacgacctagtgccccggcagaagccgccaagaactatgtacgtcacagcggttgggttgtgcgggataacgtgcctgtcagtacggtgtactggtgaagaacaagggcacgcggagatcatgagagctttgtcctagattcggagaaagagatgctgtggaccacaatgctcgagacattcacccttcccgtgggtacagaggacaaaatggaaaggtggactctaaagaaaatggcagaacagtttcagagcttcaagggagagctgtacaagaaatatatcctgaaggggcagacaccgaacttcgacacattcccaaagctaagggatcaccgggacgagttcgttgcatataagacaggtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagaggggtatcaaaccggccaccgctaattggccggaacgatcgaagttctagtactatgctcacggtggaacgctcaacccagctgatggctcactggtcttcggcgatcagatacgagaggctgcgcgtcgactaacagatgcagttgaagcctcttctcaggacacattccgaccggatagagagagggacgagctgtcactcgccctgtagactccagagcatccaggacgaacacgaggcaaaggggtgattccttggaagattgggttcaaggaggacatccacacgtacaggagtcggatgaggagcaagagagataccgaggcgaagattgcagatcttgagttcagggtatcgagctacgagctcagcatgcaagaggaggtggcaaggaaggttgatgaacgcatggccgcacatcggtccactgatccccagccgaccattcctcctgcaatggtgagcccgttaggaaaccgtagcagctgcgcttcaacggggcaggtaggatcacagagcatggacgccatgcaaacccaggacgaatccacctgccccgttgatgacatcactcaacggacaccatgtgagctacatattcctttcaagaacttatcaataaaggtaagctcgtagtttatatattttagatttgcccattccgctagttgctgcttatatatgttgattactaataaataacctctcaccacatgaaggtggtgtcgggcatggccatcccaacggaaccttcaggtacttaccactgcaggccgattccagcaggatactcgaaggtcgaagttgagttggtcaaaggcgcgtacgaggacctcgagctggattaccctagaggagacggtgagacgcatctatgagacacaagccatgccattattctatgggcgacaagcggcgtctcgtgcaccatctcctccggccccgccatctcctcctcaggatcctgcactgtctcctcctcatgctccagcaccgtctccacctcaagctcctgcaccgactcctcctcgggctcctgcaccgactcctccgcaagctcctcttccgacaccttcaaagtcaagggccccccaagctccaccacctgcccacacaagggcaacgaagaaggcgaaagttgacgccgccaagaacaaggacccggggtacgattgcacgcaagaggagcttgacgcttacgtggcatcagaagtcaagagacaattcaagcctcgaagaccagaaaagaagattcctatagacccgagtgtcatgaacttcttcaggggtatgtctgcacctgccaaggaggccattaagctatcggactatgagcgaacgctgaagaaagcatcttctggaaagtccaaaacagtccctcagcttggagagcaaccaaaccaggacatcgagccgttggtgaccggtaaagaaatgacgatagaagaatttattactgacaccggtctaactacggatcaattgctaggagtcgcaccaatcgaaaaggcagaagtgaaatacatgtacgaactcggtaaaccgcttgtcaaccctgagcttctgcagtccctacccacacaaatgtacaagttccatcagctgtacatggagatgagcgccaccggtagagagatgatcggagcgaggatcagggacacggacttcttgcaaggagatgacattctctggatcaatttcaagggaatctacgaactataccagctggacgccctcaacgtctctattatgagttgctggattttgtaagtatatcattcagttagatttcttactacgtctcctttaattaattaagtccttgtatataagtagactatagaaaataatatactcccttttatcgttgtagaatggagattcaaagggcccgacggcggggggttttcgatactggattcatcgaccctcggaaagtaaacgtcgcaatgctcgaccaatatccgcaagccacagaggacaatatcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcagattgcagattccactgggtgcttttactcttcgacctgtcggcctgcaccgttaatgtatatgactcaatggataaaaaagagtctacgtttgacaaggttttcgaacttatagacaggtattgtcataagttcctctgttaattaagaaaatcttgttatgttaattgctactacgaatcgtagctttaaactccatgtagggcttggtatcagttccgtcatttggtccgtggcaaatggagagaaagacttaggtggaagttcaaatttcctgtgagtacacatgctctacatttatatttctccgattcaaatacatacaagtgtatattaattagatctctcgttgtttgtcatttatttgtagtgcgcaaagcaaaagaagggaactaacttgtgcggctattacgtgtgcgagtattgccactgccttgcagaccaaatcatcaccacaagagagctcaatgtacgtacaaataaattcaaaatttcattacgtatcgatttcttgttaattactaatcaatttcatacattcatatagtttattcgcatgagggataacctgaccacgcacaaggaatttatcgcggcggttcaagaacaactcatgggattcatcaacgaataaatccttgatcccaagggtgaattctactacgacggaaacacaattcataggtccttagcttctgagctagcgactactactacgtcgaaatcgtagctagctaggacatataatggattgtaattaatacatgactacatatgtttctatatgcatgtgtacacattttctataacgtaaatatattttggtcatatatatatatatacatatgcatttgcataacatatatatataaatacatatatattatgcatgtacatatgtattgaatcatatataaatataatataatatatatatatatatatgcatatattatatatgcatatatgtactgaaacatatatatgcatggtttatatatatatatataaaccatgcagcaacagggccatgcaaaaaaaaaggtcagctcgatctttagtcccgattgggattaccaaccgggactaaagatagcgatctttagtcccggattggtagtcccggtttagaaaccgggactaaaggagggttacgaaccgggactacaaagtgtttctccaccagtgtaccccttgcgattttctcggtgacccatgcttcgtcttgtcgactgattgataggactttcttagaaatatatgatgcaaggaactttcttttatgacggcatatcacatattgtatacattcatctaatcgtccaccacgatggttttgaaccatgtgtgaatgccacgacatggtcttttaactatagcgaccaaattctcctcatagctccatgtgcaaaaatcttaaatggccacccttactaacaaattaatttgccaccacggttttcaaatacttcattgcagccaacataccagaggacgatgtggttgttagcaagaccattacaagaagcatccggagatagacacatatatattgctgtttgagttatggtagtctcagtcctaaacaaacagccaattcaagatgttcagaaatgcaagtgtactcacaagtcacagcaactcaacaatctgcatgcatctcctgcaaatgtggcatagatatatttctctcaagctagtcaggcatgagaggcgtcgggagtttgggggcctcattttctcatcaactagtcaggaaaatgtagatgtgcagtgccgtataacatgctgagcaagcagcgttctccctgtactctaccttttgttaacgtcagtgcagcgtcgccggtggtggacgatgcacgcaggtgcttcgctgttctaactgatctcgaacagctggatgggggttcgatttcatcggcgaatcacgattgggtgcctgttcgtcagttcttgcatgctctgttaattagtgagatcagtaacgttgacacatatatactgtaaaacatgtgtaacagattgatgctgatatcaaatctattttgagatagcccttccgtattttgagacagccatatgcctctttaaatatgccggttaaaggtgccgatttttttttcgatttcaacccacggaggttgggaaaggcatataggtgccggttttatcactaccggcacctgtagaggcgatagctatttgatgttttgtagtagtgtttgctttttcctagtcttccaacaagcattgacatactacattgtgtgttcaagatagtccaatcaataggtgtttgattgcatataaatcttctttgtttgattgcattcattacaaaatcgcatcgtagtgttagcaccgcatattactagtttaacttgaatgaattgaggcaattgccacactttatagcgtacactgatgttgccagataaaatcagcggctaggaaagaacagcccggattgctagacaaaaagcgcatgccattggaatagtcaacgaaactaaattgggtgatcctatactaccagaggatccatggttggaaggcagcaggaaatcatgaattacgtactttgaactggtgttatagataatattatatgtaccagttggtgaaatggtatgctttggctagaccaaaagattatgcgatttgctccggtccaacaaaaagtatctcgagataccggtaccttatggtaccaaatcgtttgcgatcgttggatctaagaatgaccatcttacctagttggatttaggaccttagagtactactcaggtcactataattactgggctacatgctctttcgctgtcctgatccttttgtaatcctctatgagtatgtttctctcgtgcatggagatcatccctcaaggacgtgtcatctgtcgcaggtttgaaagctgacctagctagccatgttgcaagtttgacgctcgcgtacgtgcatggcaatctgtttgcaaccagccatgtttacaatactagttcgttgttatgtgtaaataaaaggaaaagatgtttggtgttatcagaattattgaatcggtacaacaacatgtatcataccatgcatcgcatcatggaggagtggtgagaccgtgagactatgagctaagagtttttaatgtttcattaagtatcttgtagtatgctttattgattgaaatttggtgttttattattcttttaactgatgtctatcttcaagtattgatgaatgttgggacaaaattaatacaacaagcatatgtgtatcacttctgtattcaatgtgcccaactgtaagcagtgtttatatatttatacaggatgtacaagagaaaattacatcgctaccctaatcgctgatttatctaggtggctggatggtgggcctgtttatggctctttggtaaactcctcggtgacaggagggctgcgcccattaagggagcggcacagattcccgagggcgcctgctattacccgggtaaaggcgtgctgcgggtaatagcgtacgctgtctgccctcgtcagcggcgtcagaggtggttggcagatgcgtactgtgtatttatggtgttccactatatatccgttcacccatcttacgcctagggctgttgaggccctagcttcttctggagcccttgtacagctccggaggacctggaaggctttgaagtccttggacagctccggagtccacggacagctccggaggccttggacacccccgtagcccttaggtggctccgaaggccttggatgaccctggagcccctaggtggctccgaaggcctgggtcggctccgaagcctatgtttagctaagctccggagtctaaatcagtagatgccttcggtcattcttctgatgtggatggctccggtaggtgctgcatcacaggacggaggctagctccgctacccggagccactccccccaacaaagcaaaccactcaaaaaaaaaaactccagctattctaaataatctgtcctactcaaataaaactaactctttgccaaattatgacactaacaagctgcactggagtaataatataatggaatttctacaattgtagcgcctcccattttttttattaatctcgttcacctttttcctatgattattctatatcctatatatatgtaagcatgctcttatctctcatatctcctcatttaagtagggtttaatatattatttttaattctaattctcttgtaccctgtgtatgaaaatatcacaatgtaaatattgaaacttacaatataatttttgaaatttacaatgtaagtgtaggtaatttacactgtaaaacaatttcattattttttactgaaacatacgattcaatatattctactccatgcagaaatatgatttactatctacgtgctcaaaattttctgaacggttgtcagaccacaaaactaatgcctgaattgtaagatcaactatttgtcttataatatcgttcctcgaggaaaatattgcacgcatcagattcagataatcaatcacggtctgatccagggattataacacgaaatccggacttcctgcactgcgtcaaacacaaaatctgctcggtttttccgggaaaatacttagtgcaaaccatatatgtagtcgaaatttagaaactaccgttggatcgagaaatggacgttcgagattcgtgcacgtcaccatgagttaaaatttaactcgcagattcactcatgagttaaaattttacttggagttaaattttaactcac

SEQ ID NO: 79462 - DNA, 35166 bp, Oryza sativa
gcaccgcaaagtagtcgaggttcctttgccagacgctaattccagcgccatatcaccgcaacgcggccaaatagaatacatgacgcaattctgcggtgcgtatatggacagcggacacattagttggtagtgttaagctagttgtagtttaattaggacagctatttgattaaggtgtttgtggtatacatttatttatgctggccagattgtatacagatatgtatgggccaaggattgagtcatgtagttttagtaagttgaatcctacttcttctatcccaaaaaactcaacctatttgaggatgtgacataatttagtaaaataagtctgaacagatggttatctatatttgtcgtactagattagattatgtcccatcctaaattagattaggtttttttggacggagggagtacttgttatacttagtttgagtttgcttagcaaacctatacatttatgtatatgtaattgtggtacatgagttgcgaaaaagaaaacggtgatagttgtgtctcgccagaaaagttatgtattgtttttcgttctagttttcacttgtgttattcgattctggtgaaatcccaacaattcttttgtcactcacaattaatcgatttttcagctattcgatctctgttaagacccaaggttgcctcgaatccaagcgttcccctgcttgccaccagtgcggcatgtgcggtttgcatatgcctgcggcttcctcactcactcacgagcaacaacgcccctgcagcctgctggttggccctggcctgtcgatcggtcaggtgtttgaagtacaaattgtcccgttgaactgagggaaatttgggtgaaacatctacaggtcgtcaggtgatgaattaattaatggctgcaacatctcagcgtagaaggttggtttgtcgtggagatacgggttaaacatcgtgctaaacagttctaacaatggctctatgagtcagttgtttgctttgtttctaattaaggctccaagtatttttcagttatactcacaatacatatgtatgtatatatgtgtaaaagatcaataaaaaaaagtaaattacgatagaagtctcaaaatcatcttaaacaattaagttctaaaatttatttttttacaacgacttattagctggaggacaaacgatggcagtttatagataagtaaattaacactctcacatgtgtgggactcagtaaaatatagtaccgatgtatgtctttaccggcagaagacatagagatactattcaactattcacatattcacatgtgagatgatagcaacctttcaagctaaactaccccatctaaggctggtcgaaatggcgtgccatctatataatagtacatcgttcatatttgcatgatgtgtgacagatagatggctaagtcaactataaaggtggagtgcacatatgtacatatagcgtgcagctctagcggcccgtctctcttaatttcttgaggcaaattaaatcgaccaagtaatgaacctccacgagattcctaggcacgagaggcatctagaattactcagccaccttgtagactataaggtcagccacctctccgttggtcgatcgctagctgtttgctccgctctactagtgtgggatgtgcgatcgacattgcaacaccctccatacttgatcattccctgttgctacgaagagcacaccatcatggatgccgtcgagaggcccaggcttggtatcttttgcggtgccaatctgatgtgtcctggttgaaaagattgaatctaaacgattagatcatttcaatataataatacacgtagaccatcgccaggtgatgcagggactaggaaaaagatgcagtagggccaaatgaatttgtcaaaccactccatctcaaaatattattcaaacggtgcctaactggtggcagtttctgaaagggaaaaaatagagaagcaaagcacaatgaactttggcatggtaacattataccgtagtctgtatggaaggtacaagcattgtatacttttacatcttttgttatgaatgggccatttgtatctacgctgccaccttaacactattgataaacaaaacaacttttttctgttagtagtaaaccttgcaaataaatattagttacatcatttcttaccgatataataaataagattggtattgttataccagtagagaccaccgaaaaaccactccactgtgcactagagtaacacgaaccaacagaaaagagagaggagagtcacccgcacaagaacagctcagagctaacttacctagctggttaaaatggatagtaaatattaggaaaggaatagtctctgccaaccagagatgtgcaacaaagcaacatggactctctggtaaggctgggcatgggaggtttcagggacccaactgcgtcaacgtgggatcatgtctcggaggccggagcgtttggtggtggcattgtgtcgtcacgttggcaacgggtgccctgactgcgtgcttgtcttgaaaccttcactcaccatgattgctcatggaggttcaatctggtaggtcgtcctgagcactgcaaagcagtcatggttcgtctgtcggacgctaattctagcgcctatcacggcaacgcgagcaaacagaacacatggcgtaattctgcggcatgtagtatgtggacagcggacacattcttggaagagttaagctagctatagtttagttggaataagtatttgattaaggagtccgtggcacatttgtttatgctggcaagattgtatatagatacatatggggccgaggtttgtgtcatgtagtttaagtaagttgagtgtcctacttgttatacgcagttttagtttgcttagaaaaagaaaagtttgtcatttatatcttgactagaaaaaatgcctgtgtgttgcgacgggtgaatgctattttaatcatattattgttaagatttttctaaaaagtacatcctccatttcaaaattatgacgccattggcttttcgcacaacgtttaaccattcatcttattaaaaaattagtataaatatcatttattttgttgtgacttgttatcgtcaaataaaatataatattaacatatacttttacatatttatattaatattttaaataagacgaatggtcaaacgttgttggaaaagacaacggcgttatacattttgatagtattgatatctagtttgaaacttttattgggatgatggtcatatcttgtacgttgctttcttatgatttggcaagagttttgaagcaattaggagtctgactcttctcctaagttaacatgcgagtttttaaagggatttcttatatcaatccttatgtatttctgaaaacaaacgaacctgaaaaccgacttaaatatagatgacataccaaaatatcagcagaaacatcttcaatttttatgtttgacatagataaattaaaatgggaagagtgctactaatggtgcatatttttttcttcttttttttgattaatgtggtataataattcctagtctctagagtgaacatgttggtttttagcaatatttggaacaaaatttgaaatccaaaagtttgttatattttagcacaaagaagtttttttaattgcgatctaaaataaataacacgctcaaatattttttttatttaaatagagagaactttttggcagcaactgaaaaattactcctcgcaatatgtaagtatgcatgtatatgtgttgacaccaagactgactcggctttcgtcaaagtgttctgtaattgcaatctagagtgaattatgcgtgcatatgtgttgacactgagactgactcggtttccatcagcagtacatctttctttttctctcccagacgggaacacaatcagacttgtatgcatgcacgttctcgtgacaaacgtgaagaaaccttgcagctagcttcatctgttcgagttaaatataaatacaaatagagtgtttcgtaataccatcaataaatctatatctttataaaaccaactcaaacacggatgacgtatcaaaatctcggtaaaaacatcttcaatttttataatagtagagatagagttaatcttgttgtagttcaattaggataagtatttagtaatcttccataacaggctttgtatactagtcgtcaacccgtgcgttgcacgggttactatcatatatctattataaatgtgataattttggtcatatattaaattcataggacattatttgaattatagtattttaaaattacaatgattgaaagaagagcatatcaaatactacatgatatttgtgaattgcttttttaaaattaagttactaaagtactaaatttcttcgtattattaattcagagtgttagaaacattttattttggatggaaaagctaacactaaaaattaaatagtatttctaacacgaagtatattatctacaatactatgatatagacggtcatgactcacaacaaaggctatgcaccctgttgttttccgacccctaattaatctattacattagaatcggcatctccagtaaatctattactatactatgattttaaattcgtttgtactacttgttttaaagcatgagaacaatttttaatcttgcgttcatataatgaactaattaagaccgtgggtcatttgtcctacttcagattgttggaactctatttattacatagtaaaaccaatacaccaattgcatctacttaaaaaaaagtcgtattgtcttgcaaaagaaaattaatttaattacttgctgtagtgtttaaaatggctggtgcttagctagctgaaccccaacgccggcaccgtcaccgccgatgccgacgctccattaactgtggagctagctaggttaatcgtactagtaagagcaagtataatagtgagttataagcttactataagcttacgtggaggagagagataacaaaaaaatcaagaatgctggctctcatgcaaaagctagcttaacataaactcctaagtaaatacattaaatgtataggtgagagatagagagatgaggagaaaattatagccaaccttatagctaatccactatatatgttggctttaaaataggctaatattaggaagtgagctctactattgtcctggctctaacaaacagccgcagccacaatggttggtgtttttggggcacagaaatcatgggcatgagtgacttaatttcctagattgatgggcatggtaaacgtcgggaattcagttgcctccgatgggattctatgcagctttggcattgccctgcctggagcacggtgcatccacagatacggtgtagcgtgtgcgttgtccactacttccttgttggtgccacacggcatacctgctctggtacaacacgcagagcactgcttgctgcgtgctgacggttcgtctagttcttccacgtcgtcgattctggatgagtacgtacgggtctctcaagagatgctggatggtctggccatgcgttgggacaattggactgatctgatcgatggttgttctatctttggttgtatcctgactgtattgttgcaatgtttctctgttaaggcttacacacaatggagtaaaaaaaaagcgagaaactaaaaggagaaaaacaaataaaacgaattaagggaaattaatttgagcgacaacttttacgatgatctggtagctaaatgacccttttctcaagtacaattttattttaagaattttaccatacctgagaaggtaccaccaggtactaggaggtaaaaactccatctgtccgtccattcacaaagggtatgatcggaatagcttgtgataatcatctagtcctacacctggcatcgtctcttctacatcttcttctccttccacatcttgtagtcccaaacaattccgtcccactctatagctccgcgacacactgttgagacctgaagcacaccgccaatggttatagaggaggctacaatccaggatccagttttggggcctcatcaggatgggaatagtgggagggcaggcgacgctcgtgaggtgagttcatgtgccaccgacacctctgagggggtggtttgctggtgaagaggagaggcagcaaacatggacagacggagctcgccaatgattcagctagtggaatggaaaaggatgaacaaaagaaagagcaagtaaaaaatggaaagaagggctcgcctgaattcgggaaggagaatggtggattccttccattgtgatgatgaggattgggcatttttgctgtttgagcaccatgtcctgtactcctgtacgtcttcaatggtgatagactatctaacagttcggatcaagctaataaccagaaaaacatattcctggtcattaatccaatgttatctcaactagaattttcaaatactcggctctatcattgtggatcaacttctttaggtacatgaaagcactaaatttccagacaatatagctcatgcacctctggttcgcatggttcttggtgccaccaagactaggagttgaccccaagcagagagggcactgaattcgcagttgctgctggcctcggcttcataactgatggatgctgggtggcgtccccctcctctttattgcacaaccaggacagctgacatggcaacgcatgactttggaggtgtccagagcataaaagggggtggtaggtcccagctcggtctgaaccgcggctgcagcggtgtattatcgatgaggggagaagtgctaaagcagaggttgccgttttgcgagagtgtcagtgacagcggaaggagagacagcctgagaggacgagagagagctagcggagaggaggtagtgttggtgggaggataagaaaacaaactagagcagcgtgggggtgggggtggggattggcgacgggagcggactggggaggaggaacaacgccatgggaggaacgacaccggcgtccaccatcaaatcacctccctcaagctcgaggtaaacgttgtatcggccaagtcaagcttgttgttgtgtgcccgtgttaattacctctacggttctcgctcgatttgaggatagatggcgctccactcccacctgcatgcgaaagtacaaatttgctctcctaccatcaacaacatttggtacctgctagatgccatagcgccaggtaccgagcctttccaagccgttacatagaatggaatggacgaccaagatttggtacctcctcccctcaaggactgtaaaaggcctcttattattattttgatggttccaataattgcagatatcctcactcgtacgaaaaaagggtccaatttaaagagtgtagttttggctgatatttcataccacgtaggagtatatgtaaatggtacccaaatttaaatggaggtggcagtggtaaagaacagcattagaaacaaaagctttgcaatgatcaagacgtgtccagagctctagcttaggcaaacaggcatgggaggcactgaggacacgattgcgtccacgctggccttccttgcaaacgcaaagtcatccagaagcagcgcaagatatctctatggacaaacctgcagtgttctgcttgccgccctctgcatccgggagcagcagcagcttcatgttccccggtggattcaccctcgcccctgattattgattgatccgcgtagaggtcaatcggcatgcagggccgagccaagtacgtatatacgtagtgagtttaacactaggatagctaattcgtccccaaccagccgtgaaggaagcctgccaggaattcatgagatggatattatcgatagaactaagtattgtttggttttgtttgtattttccaaaaaggtgaaagcaggtattatcagaactataaaagcccatgaagctcctcgtttcttgtattgtcacgttgagccgggggggaatttattttaatattttaatatttaatttgtaacatcgtttattttcatgctcatttggtcttctctttcccttttaacgaaagtttggtgtttcttcttgcaacatagccaagcattgagttatatggtctgtgaaccgcgacataatttttaatttcaccatttaattttatatttaatttagggacctttttgtttttcttctatttcttagacttggcttttggaccgctataagtaaaagcatatgttttatgtttaaattatatgttgttgctcttttttttaataatgtaagttattctagccttcgcaatgttttgttgcttacttcattcatgttttccttcaagttagccgtaaccattaataaatagttgttgttgtattatggcacacaagacaccatacattatgtagcgctctagcttgtcataaaaggtagtagaaaaagataggctagcaaaatatatatagaagggctgaattatgtagctatgttactatgtaatgaattgcaacaggtaactacgtataactagtaacagtaacaaagggtaatacaaagctatctgcttgttgctcaaataattagacaaagcagaagcattgttctctaatcatatctccccaaactcacccgtggatgtaacacatctaggaactggaagcatcggggagggcgatcgatcacttcttcatggatagggcgaggtcattggctgagagggaggcctcgacgaacttgccgatggtgaacttgtcggccgctgcagagcgcactgtagcgcgccgtcctgaccaaaggcctctgcatccacaagctgaggatgaaggtgatttgggatggcaccgagaggtgcgagatgaagatggtaattaccagaggatgacgtgtgggaccaaggatattttataaataattgttttcttcatttgtagatcggactgatctggtgaaatagctgccgcacatattttgtaaataccggttactttacacctgaacttcttccacggtatggaaaactcctggtgtaaaaagtttagggtgtaaagtaaccgatattagagtttagtggtgaaaatcgaattaccgacatcaaacgtggtctttgaaagttgaaatgtggttactaaaagtcattagcactactttctaagaggactcgcgcgctaatttaaatggtagccaaatttaaagaggtggagcgcaccaattttaattgtctagattattcagaattttgggatagaagaagacatgcaaggagtagtaaattagctgaaaagaacttaatcccactattaccacactcacatgtacacacggctacttatatggaccggtgtgcacggctcacgtttttgacccaagaaatcgacgtgacaacgatcgagctctccgatccgatcccctctagctaggattgtaggcatggaggcattggaaattactcggtggcctctgatccttccctcgcagcttggcgatctcctcctcgaccaaacccggcgcttgcgtctaacgcggcatgtgcgagttgccacaaccacaccattgcgtgcgtgcggcttcttccctgcacgccacgcgcgatcgacgacgtacgtgttgcagcactttgttctggccctggtggcggtaccggtgatcttggtgtttgctgagcccagttctgatggtggatgagtaggtcagtccctctgttgcatctattccttgcaacagagtgcagctgctgtgaatattttttttttcttgaccatacggatgagctagctcatgcttagccttacgcttgaataaactggaacgtaataaatagaactcggctcattaccatcaagagaccttttgcaactaaggatacatattttcagcttttttttaaaaaaaatgattaaaagcctgacctctacatccaacttggatgtacccaacacatacagtgatgtcattgataaataaaataaattttgacaagttggaaaactcatatattagtaactttcactacttgactaaatttggtgctactcccccgtcccatgatataaaggattttaggcggatgtgacatatcctattacaacgaatctggacaggtctgttggagccttaagtttttgttggagcctaagcaagatgggttgagttgtgatccaaattcatttacatatgtataaaggtcaacttcggacggagcgaagtggaggcccgtcgccggtggcttgggccgtcacatagctgaagaggtctgaatatgatagctgtgtgtatattaaatttgttaatggatcacgcatatatatacttactgttatatattgatgatatgttgattgctgccaagagcaaagaagaaatcactacattgaagaaactgttgagtagtgagtttgatatgaaggatcttggtgctactaagaaaattttaggtatggaaattactagagaccgaaattctggtttgttatttcttagccggcaaagttacattaagaaggttcttcaacgtttcaacatgcatgatgcaaacactgtttgtactcctattgcaccttattttaaattatcagctttacaatgtgctagtattgataaggaggtagaatacatgtcaaggattccatattctagtgctgttgatttttttatgtatgccatggtttgctcttgtccggatttatcttatgctatgagtttggttggtagatacatgactaatcctggtaaaaaacaatggaaggctatttagtggagtttcaggtatcttcgagacacagcaaatgcttgcttgaagtttggcaggactgataagggacttattggctatatggattcagattttgctgctgatttggacaagcgaagatcacttataggttatgcgtttactattggtagttgagccatgagttggaaggcaacattgaagcctgttgttgcccagtctaccactgaaatagaatacaaggctattactgaagcatgtaaggaatcagtttggctgaacggattgtttcctgagcttcatggagttgattcttgcattaacctgttttgtgacggtcaaagtgccatatacctcactaaagatcagatgttccatgagaggataagcacattgatatcaagtaccattatgttcgcgatgtagtcgcacaaggtaagataaatgtctgcaagataagtattcatgataatcttgctgatatgatgacaaagtcagttcatattgctaagtttgagcttttctcaagcttagttggtataatggtttaacccaatagattatttggcgtcgaaagtgtttttctttgttgtgttgagggtgaaggtttgatttatgctacaagaaggaatttgtctcaaggtggagtttgttgagttttaatccaaattcatttgcacacgtataaaggctaacttcggacggagcgaagcggaggcccgtcgccggagacttgggctggagcaaagcggccgttttagggtttcacctttatatatacttctggaatgtaagctgccgttcggcgttctaacctcatccgatatatagtgaagatatttgctagctggcgcctatggtttttctctcctaatttaagaggggttttcacgttaaatcttgtgtcttctgtgattggtgtatcattttttatcgtttatttgccgatcgttttctaaatatatttgttggcatgcagcaagtaatcaaagacagtagttgtagtacgtacatattctctctgtacttgtgctgttaagtcgccgtagtaccttgattgtttatttagccttatacagacttgacgtctcatgcatgtctcatgacagagggagtataaatgatggcctttccgattgtattttcatcccatagttcatctatttataaaagacaatgctccacttctaaagctgcgtgacacacatcgagagctggagcgaactaaagagctggccgggtcagtgtggatgttagcatgtatacacgtacacgcatccgtagcgactctattgatttgttgaaactaattaagatcctagcttagatatgggaggcatggggaattatttagccgccatggaactaaagcttcgccctcgcttgtttctgcgcttcttgtgcaaccgcccatgaacatacgagcaatattttcgctatgaagagcacggggaggatgctggctgcgaggcccgttctggcctggccttctctttgtccagccatgtcgggatggtcgtacgatttcatatgtcctaatgtattgctcgaagttcagtttgtactattggagaagtgattatcccatttagtaccggttataacaaccgcgactaaactttcatctgtcctaatggtattcgaagtgcagctagcggccggacgagacgagttcgatctcgatctctcgctagtagtcttctaggcatgggatgggaggagtcggaaattacttggctgcgtcggatccaacacttggcagctcggcatcgctctgcttactaaccgggcgcctgcgcgtgtgacgccgaatgcgcggttgccacggctactccattccagaattaaattttaaaatatacagtattttcctagaatttgcacatatatacatgcttttgaaaattttacaaaaatatatgtttccgcggattgggaatgcggtatcgggcagtggcgcgacgccaagacgcgcgaccgcatccgtcggtcccgtagattggttgtgcggcaccggtgctgacataatatagtcgtttcactgcctttgttcaattcgagctgctagtgccaagaagtcatgcatgcatgtcagaatagtgaatgctaaagctagctacctgttaatacaatcaaagttttatgagtatatcctttgtttgttgcgggatttggcggtggtggcgcggctccgcgcgaccattccgcgggagcgcgtcggtctattcttctgcgcaactgctcctggtgctgggaatggacgccgtcgcgcgctattgtcacgcgggatcgacgcgatcgcgcgttttggcgtcgcgccaccgcccctcccatcggtcaactgtacggtgccgtatttccaatctgcgggaaaggtatatttttaaaaaaattacaaaagcaggtatatatgtgcaaaatcgaagaaaataatgtatattttaaaatttaattgatccatgcctgcagcatccctcggcaccgcgacgacgcgctccggctaatcgttctgccccagtatggtgttatgctaagcccagctctcattctcacgatgatgatgagccgtcggtcagtcctgtcctatctacctagctattccttgcaaattggagtagtacccacctgctgtaaatttttcttgaccatatatatgttgttttatggtcgagggttaatacatttcaatgtaataaatggaactcctcttgttagcataatgagttcgtttttttttgttgtttccaggagactgtttaaaaacataggtgtgcctggttacatgacaaaatgtgtccatcactaaattattgaagcatccatgactttggctataattaaatagagagttagacgaaagttttgtacatgcaattgatgaatgagaaagcataccacaagcttatatctttatgtctcttacattcctagaaattatgcaacttgttttgactaggcatataatacagggtcacacgatgttctaccgaatatcgacgaagaaaactagtaaaaattcatagattccttttgcatcttgctgatctaatcacgaaaacgaacttctcccctattccccgttccgttttcgctattcccaaagaaatccactaccgtctgacttggagtcgtcggtgaaagctgattgggaattcgtgaaacagcttgcgggctgtgcatgtcacaacgcccacggacaccatattgcgccgggaccgcacgacagtgaggtcacaccgtgccacaacccaggcgtcgatgtgcaagcctcagcgtccatgcccactgaagccacgccgccacaccaagacacatgtaatgtactgtcgtgaaggtgctggccggacatgaagagggaaacagaaatatagacgaagaagaatgaagaagaaaagggaaaaagtggcgaacaacaccagctagcggagccacttatgccgaccattcatggcgctgccatacccacagcgcatgccgaccacttgatgtgtggctgcaggaccgtcttgtaatgactgaacgagtaccaaaggcgttggccgcgcctccacgccgtgtcgagactgttgcttgcccgtgcctagcaccgctgaccggccgagctactccgccggttggccgcgccccgccacacgggcgcgcaaccaccgctcgcggtaccccgccgaccgaccaccgccacacatggcaagggcggtggttgtgtggaggtggggtgggggaaggaaaaaaacgaaaggaaaaagtagaaagagttggtgattttgcaaaaatgcgtccgtattttctcgaaagtaagcacatgttcttctgcattggaaaattggactttaaatcctgaagtttttagagaatacagatataatcctctgcattggaatatttgttggactaaaaaaaagatgtgaaacacacatgattttcctttgcgtccagtatatatagtgctatgattataaaagaaatacaagaccgaggtgatagtgagaccagacaacaaactatatatatcctagtgagttgggaactaaattttccaacgaccgtcgagacgatgatgcatcgatcgctctagtttaggcatataggcatggaaggcatctgggacaaagctgcatcaactctagtactccctagaaacgcggaagcgttttagcctcgcttcgcgtatccggccagtggtgttgacagcaagtgcgccgtgcatcctagccttcctagcgctgcgcacacccccggccccatttcagctgcattttctcatggttggtttttagcgagcaatgtgagcgtaatcggtcctgcgaccgtgcgtcgtattctctagccgccctaccacaaacagagacctcaatcggtcgcattttggtggaaccccaaccataaataaatctagttttcttagtgtgagttgcagcatttgaatgtgcaatgttctggttactgcaattcaattgagaggatgcatggagatctttttctggtcgttctaatgcatgtcatgctcttttattttttttgtttctacgaaaaatattagacctttccacaatcctctattttaacatggtttaatctattcatgataatgtggtagcccctccgacgacaaatattaattgacctttggttctttttacggtatttgaggttctaccttagactacaattttagtttataaatctagtcagagatatagtgagactatcaatgtgcattccatgaaaaatctactcacactatttttacgttttgaactaaatatttttaaaatatatttttttgagaaaattgtagtatttgaaggttaaagtttaacctgattttatccaaaaagcaatgttctaataaatctccagctatagcggcaagctatagatagcggatagggaggggaacaactaggatacttcaattttgacgctaagatttgtcggcagctaatagctacacttagttagagatagcatcaccaaaatagccaaagatagctgcacttagctgctaaaagtatgaattagaaactatgaattccatatatgaagtatgaactacgaattggtgatgaactctatctgtcaatttttagctcaaattctatcattttttttaattttttttcttatattttcaaaaaccgctaaatttcttagctatagctatagctggtcttagtttttggagagctcaaccactaagaggcttagctgaagatttagaacattgccaaaaagtcaagtactcgtgaccagggaatataccctcatagcttgttggttggactgaatattttctttggctacatgaagatagttgttgagttattatagttgtcgaaagatggcaccccagacaccaataatgcacattaatatgtagtgataggctatagaagacaaccaaagtaacataatagtaggaggtagagaaacaaggtgcatagctcaatatgtgaaaaaagaatttgagaagtacatggccgtcgaatgattgtgtgtgtgcaccattgtgtgccaactggaagattccatcttcttaacatgttggacaattcatcctatgcttctaggcatgggatgcatcaggaattattcaacagccttagattggacccttcgctacagcttggcgttgctctgcttgactaagagcaacttcaacccgagcctcatccctagatccccatcatccgttgcaggacgcagctccagtagatggatgtggcttggaagctccctccctctctccatgactaggaccttccgtggcgtcgtgcatagaggtttgtgaggtggcggatccgaagtctgtggcggggccgacggatggagacgtgcaggccagcggtggcgtagaggcatgcagtatcgtcgttggagccttggaggcttgcaaggcggcgactcatatgcaaatgacgatggagggatttttacatttccttgtttttcctagataagtgctaatgactaacaagaagttgtacttgaagaagggcatttaggtcatttcatgttagtactaaacttgcattgggaatttagggatgggtttttttgtgagacagagggggtagatctcatgtaatcaagtagggagataagggaactgtttccgtggtcatctctcttcatgtgagtgctattcatcccatagactaagacagttagacgcagtcatcattttatagaaggatagtactccacttcaaagatgcgtgacacacatcgagagctggagttaaataaacaaggtcaatgtacatgtacacttgtgtacagaacgcatcgatagcttatctctctcaatttgttgaggcaaattagttaaatttgacgtgaggatcgactctccaagcgaagctctcagcttagctagatatgggaggcatcgggaattattcagtggccatggaactaaacatcccccctcactcgtttctgcactgcttgactaacggggcgactggaggaagctcagcgtctacaattgccgcttatcccagcttgatagctttgatagattgtggcttcgcagctcgcgcactgcacgcgcgtcgcacgctgccggagccgacctgatattttcttgcaacattttcgctatatgaagagcacgcgagcctcgaggttgtcaaaaaaaaaaaagctcgaggctcacgagctgctcaagctcgacttgtcttaggctcgattcgagcttggctcgagctccagacgagtcgagcaagagcctctcccaaagttcatgagcattgtcgaggagcttgagcttccaatgagtctaatataagaattttgttgttatttaataaacttggagatcaaatattttatttgtatatcttgtattgtcatcatatatttattttattattttttctcttttattaatatgatgaactagaaattaattatttttaaaagattattcttgaaatatacattgttttacataaatattaagttcaatagtcgagcttgatcttgatcgagctcgacatagcctgtataaaagctcggacgttttataggcttgaactcgagcttgtatgagctcgatcctatgcaagcgagctagctcgggctcggctcattgacagccctaccgcgatcgatgccgacgagaggcccgttctgtccttgcccttcttccctttgttgtgtccagttgggatggacatacgatttgatctgtcctaattaataaatgtttttttaggaacatcactgttgagaagtcttagagttggacacatttaataaaaaatatatagaattaaatagggagaggttgtgattggttgggaagtggagataggtgggaaaagtaaatggtgaagggttgtaattggttgggaagagaatattggtgaagaagttattatattttgggataaattctaagtgctaaaagttattattttttgggacggagggagtagttgttttcccatggtgttgtgccaaggccgagattaatcacttacactgctaagctagtttaagcttcaacgaaatttggataagacgcaaaaaaaaaaatcagctcgttacgtcgtagactattgcaatatactccatccttccctaaatatttgacaccgttgacttttttaaatatgtttgaccgttccttttattcaaaaacttttgtgatatgtgtaaaactatatgtatatataaaagtatatttaacaataaatcaaataatagaaaaaaaattaataattacttaaattttttgaataagacgaacggtcaaacatttttaaaaaagtcaacggcgtcaaacattttaggatggaggtagtagtacatataggtagtcgtgaaaatttggtctttgatagttcccggtgataatgcacgcaaataaaatggagaaggaaaacaaagaaacaatataacaaataaatttgacaaaccattaattccaccacaaaaggctcaattaatttagtctaacccgaagtacgctcccaatatttgtgctctctatttataaagagcaagccgaactgagtcatgacaaaaggacaacgggagtagcttaaagttaacagcttaaaatagatcgcataagcatgtagaatggaattgcttgcggagcagatataaggtctaagaggcatcggaaactctgttgtgccatggttgttttggttactgcttaatgcttatgtttatcataagagccccactacggtgttctctattgatagtagagaataatgtgagccattattcttatttaatcgaatagttcagatctatttatattatcgtctagtttaaggtaatagaaatatggagatgtattattgtaaataaaaaagatgaggaggggtacaatcattatttatctgcgactaaacttttttccttcttatttgttttttcgatggaatatgagtaatgccattgcaatggatgacctacatgacgatctagctgggaaaaaacataaatgataaagttacctctgatcactgtattatgaattactgtcttatccttaacaataaacgggatagtgtcttatccttaacaatgaacgggatagtataatactatcgtagagagcaccataacattgcttttttttaataaatggaagcttatgtttggtaatacgggacggaaggagtacatggccagactacttatagataactccagctgcctccaaccctcctatgctgtccacgtgaggcttaaccggattttggaaagggtttttggacacgaataaaaaaactaatttcataactcgcctggaaaccgcgagacgaatcttttgagcattattaatccgtcattagcacttatggctaatcatagactagtcaggcacaaaagagtcgtctcacgatttcctccctaactgtgcaattaatttttcttttaatctatatttaatgctacatacatatcttggaagattcgatgtgatgtttttagaaaaaacttttggagaactaaacggggcattatataggacatccaattcgctggacagtgtcactatcagagatcaattcagccgcgtcggatccatggaacgggcatcgatcgatcgatcgagggataggccacaagctaggcaacttgtgcattcgctgctgctggctctaaaacaactctagctgctctactattgcagagttgcgccccttaggcatgagaggtgtttgggacataccagagaccagctgtggaagcactttgatgcatcctcgcttcgcgcattaaaatgtggcacgggccacttcatgggctctgcttgttttagcaactggagtagtagtagtattactctgttgtccaaacatattaaaccaatatactcgagagtgctattttgatgtgctttagtgcggctagtagtagtattcagtagatccttctaaccaaatgttactatctgggtggccggtgcaattgtccggtatgattttacttgaaaatttattaaatagctatcttgtttttttaagactttgaaagaccaaaccttatcatccctgtgtttctaattttatagttttataaaaatcacaccagttgctaccacttacttttgtcatctctttttttatttgtttgcttgatctaccattgattttattaattctccttggaatctttataaattggatagtatagtttttagagtttattgtctcattcggttttgtttttataatttctagaagtcccattaagcgctgccattatactcctccatggtccgtccactgtcttttctctttttgtcattgcgattttaaaagtcgaatataattattgtttgggttcattttttactttttataagtccccccaaactgtcagtggctttgccactgtactcctctacggttcacccgctgccttccttcttattgtcattaagattttgaaatcgaatattattatcattgtggtttattttttttacttttagaagttctgaacctttaaaaattggaccttatagtttttagaggttattgtcttgttgggtttcagtttttataattttagaagtctcgtcaaacgatgccactatactcctctacgcagtgtccgccgccaactttttattttcattgggattccaaaaatcaaacataactatagttggaatttattttttactttctagaagtcccgccaactgtcgacggctgtgtcactgtactcctgtatgacccacccgctgtctcttctttttagtcattgggattttaaaaattgaatatgattatcattggggttttttattactttctagaagttccgccgacagcgttgactggttacttgacggcctgcctgtcgtccctctttttaatcgtcattaggattctatttggtgttttattaatattttttagatgtcccaccaacctccaacactttaattctttataagtatgttacttaattactctcgtcatgaattttagatggtcttttctttcaatagtctttatgttttatcaccaattttagttatttataaattatattcctagttgaatatttttttaattttagaatttattttatttttattttgaattttaattaatactgtattatgtttttttagtatttttatattttattttcaatttcagctgtttcgaaatggtattcctacttgaactatctttttaattttttctaatttcatattttattttatttttttattccgaatattaattaatgtcatattggtctcgtacatggaatcttctttcaatagtgcatatttttaattctgaatttcaattatttttaaattgtatttctacttgactcttctttccttttgctccaattaatgtgggaatttctagctcccacagtgaatgtggttcctccttttaaagctgttttaataatatattaatagatagatttctttgatggttctatctgcataaacattgcagttaagttattttatatctgttttgtgtaattgcacataaacatatactccgtacatagtgctaggccatataggctatagccatgtaacggtaactagagagacagaagggatagcacgaggtagagaactaagttgtgtggctgtacatgtaaactgtagagagcaagcaaagaacaaagtttgtccctcttcaatgtatcaacgaactcatccatatatcccatatatccatgtaaacatataggaacagaggaggtatcggaaatctgggtttagcagtgatgtagaaacgatcgtacaacggaaaactggtaataacttgagaaagccattcagccctcgctcatccttgtataacttattcgcgttgtaaaataaacttcttctcatatccctagaatattcgttctagctaagagcttatcgtctccccagacagtttcacccgaagagaacacttctctacggctacacgttctcctaatgcctaagcaagatgaaggctaacgatgagaagtaccgaagagctatctcctacagggtcccttgcataaactctcagccagacaaataaactgggatgcacaaaagaaattacttcatataacacgagcaaatttacatacggttttccctttcgggaacccccgagcttacagacttgctccatgcagtcttgcgtgtttatgagggggatgaattctaatctctcgggtggacgtccacccgtttcttgtatgccacctaaatgattatgaaaaagttacaaaaaaatttataagataggttaatatgtaatatatcatctcacaaacatgcaagttcaaattcgacttctacaagttgtaacaaaaataacaaatttgactgtgaatatgtgtgtagtagttagagtttaattaacaaataaatttgcgtgtactaatttgacttttatatttgtgcaaaagattttacatcccgaatatttcttaaaaaaattgaatgaacaatatattttcaaatttaattcttgttgcaatatagttcacataggaactcgtgaaaacttggttttagatagtttccggtggcgatgcacgtgactaaaaggaagaagaaaaactgagaggcaatataccaaataaatttgacaaaccattccacctcaaaaggctccatttattctaaccagatggacacttccaatatttgtgctctctatttataaagagcaagacgaactgagtcacgaacaaattaaaggacaatgggagtagctcaagggtaacagcttaaaatagatcatcaaagcatgtagaatggaatagcttgctgaacagagctaaggtaatatccttgttgaaatagtatgggcaagtggcaaccatgcatagtggcggatccaaaaaaaaatcgattcgttggtgtcataacgtgtctgttggtgtcatagtatgctaattatacttagatcgtgatggtataatatatggataaacagtttcgctatagattttgacaaaagtcgttggtgtcgaaagcatgcattacactgtagatccacccctgaccatgcagcatgtatgttaggtctaagaggcatcgaaagctcagttatgccatggttgttctggttactgtaatataacaagcaatttagtactgtgcagcaccaagagatagaagtacaagtccattagtcttctaaaagatgggccatatattatgaacgcattcaatgtgaccaagaggtgctattttttaataacataccggtacctatgatgggaggagagccattgtggtcagaatcgtaggtgttggttctatatgcgaaccagtaactgtgtgatttttatttagcaccaacacctataaggtgttttgtaattgtggtactaatattgtcctgcagggtggggcaaaggtatggagatgctgagaataaccatccgtttataaatgatgtactttcaagctgaggtacttataaatcattcgcctaagagacataagtacatgtctttaggtttccagaagacaagccatatattaagagcgcattcaatgtgaccaaaaggtgctaatttttaataatatactagtacctatggtgggcggagagccattgtggtgaggatcatggtgttgattctatatgcgaaccagcaccaatgtgcttttcatctagaaccagcacctataaggtgttttgtaattgtgataatgaccattgtcctgcaggttggggtgaaggatatatatggagatggtgtgaaaaaccatccatccataaatttcaagctgagctacttaaaaagactctgagaggatgtgccatctatatacatagcactcgactgccgcgggccacttagatagctgagttaacttaaaagggccagcagatgtgcacgtatatgtagctcagttttggaggcaaattaaaattgacggtccgacgactctcatcagatcgagtctctgtcgctcctagctaggatcctatatatgcatggaaggcattgggaattattcaacatcccttcatcggacccttcgctgctgggcgttgcatttctggactaatgtggtggccgaaggcagcgcaacgtgtgcgaccccctcttcctgccaaatagcttgtggcttccccactcacgtactgcacgcccaccgcgcccttccaacattgtggcgtggtgttcgtgcagacattagacctttaggcagagcaagtggcaagggaagttctcacgcctgctctgcccggttatctctttgatcaccatcacagaaggctcatccatagctggttccactgctctaatcggtgctagatttgttgcatcactactcttctgggagactcatctgtgtcaactctcaaaccggcattgatgggagagcacgagtgaaaagaaaaaaaagaataataagaagagttcgacagccccattgtttggttgtttggtggaataggtcaaacggcatatttgcaaataaaaaataatttgtgaataaaacttttatgtatgtgttctaaacgatctaaaaacaaagactgaaaaataaactacgatgacaaaactctaaaatcaactttaaatttaaagttgaaaatttaaattttgactgataagcgtaagcataagaaaaagacgaggacgctgagcatgtctcgatgaacggagctgacgcttcgagccaaataatcagaatcgttaccgagacaccgtagaataatcacatttggatgcaatttttggctccaattaaaaaaagcacgaatgttgaaataaaaaccacaggaatgagtacacactgggacatactcccaatcatatttaggcttcatcctcgtattggagtatgggaagcatctaaaattaggaaataaccaacagacgaagagaatgaatactaatataatgatcaactatgaacagggggagtatttgtttttatgttttcacaactgacccaatggttatacaacttccaatcttttaggtttgatcgatgatccggttcggttttttcgactatggataggacacaccctgacagggatgccgagaggcccattctggctcggcaactcttcattataatggacgaattgttctgccctattgtattccccagagtgcagctatactatgtgaaaataaattctcatcatgttgtttcttggctgaggtcaactacactgctattttttcaataaaatatgtataccacatcgtttcaagataatatatatatatagatatatacaccctcgtgaaatatgtttaagatagttcccggtgataatgcacacaagcaaatggggaaaaaaaatcagagctgcaaatgaaccaaatgaataatgaatttgacgaactgttacaccatataacggcccattttcttttttttagagcatctccagcagggacttcaaatccagcccctattcaatttttgagagttaagataaaaaaactagatccagcaggggccctactacagcccccaaagtgaggaggccctcaaatcctcccccaaggccccagtcctggggactccggagcacgcccccatcgtcatttttttttggcgcggatataattttgcttcgtgcattttcttgttattcccgcacggctgcgacgacggatcttctccggcgagcaccgacgaattcccagcacctccatcaagactgccctagaaaggtaagacttttccatacctttcttgcccgccgttctcgaggccttcggcggcagtccatgcacatgcccggccgccgatctcccgccatctgcctggccacacgccggccgtcgcgtgccctccgaggctgcccgcacacacgtcgcccacctgcacgccgcctgcccccacgctggcctcctgcccccattgatttttctggagaaactctaagtaggtcatgtggtgcgggggttcagtggtagagtactaatcaattttctgaataactctgttcttgacacctgtggacatgtggtggtagatggttctggtggagactgacttgtttttaatatttttttggagaattgtagtggactttgtcggcaagaaaaatctaaattctcagctagtaatggttgtgtttagttcacactaaaattagaagtttagttgaaattgaaacgatgtgatgaaaaaattagaagtttatatgtgtaagaaagttttgatgtgatagaaaagttggaagtttgaagaaaaactggatctaaacacggtgaatatatcactgtatttatacttagtagcactgtacaattgttgcaatggatcgattagaaccatatatatatatacaggagtaagtggtactgtactagtacgattccactgcttttcatagattgaatgttgcatactgtatatggggtatactctgtaccgtgtatgtgtagttggatgtgtgcatatgctctaaattttcttattaattttatgattttgtgatggcagtgttttttatatggacttctacgacgacgatgacgacgacgatgatctcattaccgattggtgggatcaggaggagttgtctgacgatgatgactactacattgcagctgctcttcttacagacatagagcataagaggaccaaaagaaagcatcatggttcagtcccaggtcgtgagataattcatagggacaggtttgctggcaatttacgcatagtggctgattattttgcagatcctcctatatatagtgcaaaattatttaggaggaggttcagaatgtcaagggagctcttcttgcgcatcgtggctagtgtggaggctcatgatgactacttcaggcagagaccaaatgcagtgggtcttctcggtgccactgcattgcagaaggtgtatggtgcaattcgcatgcttgcatatgatattccagccgatagtcttgatgaagtcgtgaggatttcagagagcaccatgatagaagctttcaagcactttgtcaaggctgtggtggatgtgtttgctgatcaatacttgagggcaccaactgctgaggacactgcaaggttgatggctataaacactccaagggggttcccagggatgctaggttgtattgactgtatgcattggaggtggaagaattgcccaacaggctggaaaggacaatattcagggcatgtggatgggccaaccatgattcttgaagctgttgcatctaaagatttgtggatttggcattccttctttggactaccaggttctcttaatgatatcaatgtactacagagatcgccactctttcaaaggcttacatcagggacagctccagagttggagtttatggtgaatggaaataaatacaccatgggttactatcttgctgatggcatatacctttcttgggccacttttgtgaagaccatttctaattcacaaggtaacaagagaatacattatgcaaaagttcaagaaggagtgagaaaggatgttgaaagagcatttggtgttctacaagcccgctttgcaatggtgaggggtcctgctagattttgggatacagagaccctatggtacataatgacagcttgtgtaatcatgcacaacatgatcattgacaatgagcgagatgaaaatgtagattttgactatgatcaggaggacagtgaggtgttgaggaaggaggaataccaacgacgtaataaacctgtgttagagaaatttctaaagatacataaagaaattgaagaccgacgggtacatgagcaacttcgagatgatcttatggaacatttgtgggcgcttcatggtgctcggtagtttgtttcattgcattttctatcatgtgtgggttatgttcaatatttgcttctaggatatatcattttcatgtttgaaaattttgaattcaattttgaatcgtggtgtttgaaattgcaaatttgaatatggttgaattccatgcgctagaattatttatgtttaaattactatgtgttaaactagatataaatataaattctatactaaaataaaagagaaaaaaaataggggctaagatatggaggctactgctagacataaagacatatttagggtcctagaacattgagggcagcccctatttaacttttagggactcgaaagtaggggctactgctagagatgctctttagggaaaagacatgagctctaccattcatttatagaggaaagcaagtaaaacaaacggaaaatccttttacaaacagaggaaccaaggttttcccccacaatacaggaaccgatttttaggtagccagcggccacaagcagcaacaaacgactaagggccatctaatttaggggactagctgagctgccgccatttgtttacacatttccaagatcgaattcacaacatgttccaccgtgctgtaggttcagttgaaaattctgtcatttcattgcagccaaatgacccaagccgtgcaaatgattattccatcgaaaatattcctttgatccttcaccatatcttccttcagcaagtgtcccaccagctcatgaagttaccatcaaagcaggaggaggtcggaatgtgtggaacttgatttggaacggctgcattttcttctcgatcagccgctatactgtcccgttgttcgtgttctgtagtttatatacacaaatagtataacatgaaccaacgtagaagagagtcaacaacataaggacgacgaggctcagagctagcagctgataaaatggatcagaaaggcatggaattgaatatagcctgctaagcttaaaacgatggcaaattttgctcctcaagtgctatgattaccgttcttctcagaaccagggctgggaagcaacgatacaacgagggctgctttcccagtctgggcaaatagcaattagataaattcaggctttagatcagagcacacatatgaccggccatatgccaggtttcaacttttgtaattgccagttatatatagcgtgcaggcgagatgacacctctggcaaaataacaagacgtctatatatgacatgtttttgataatgcagtttctttacaaatttactttgaacactcaactttcttcaatttccctttgtgatcttttttttttgcgggggccctttgtgatctaatataatggtagagcattgtaaaagaaagcacccttcaatcaagcaccatccgtcttaaataccatagccacattttttattttgtgactaagacatcatgcacgcatccctgaaaaaaaaaagaaagacatcatgcacgcagcggtatatctatgatttttatataggtggtccaacttatatatatttttttaaaaagaccctaattataacaaagctaaaagccttttaaaggaaaaagtacgagttaccctgaatcatcgtggtcgactaaataacccccctaacccaaaaaccatattagaaacatattagaaacgagtttttgctttgttcaaaagtttttttcatagatgtataaatatgcattaattgggctaagattttttttggtggcaccgggatcataaggaccaccctgtagacccgcctatacatgcacgttatgtagtgatgggccataaaaggctgccaaaaagagggtagaagaggcagaaaaacaaggtggctagctatgtgaaacaaagagcaggggatagtattcaggcagtcgatcaagcatttgcactatctgcgcaagtcaggcgattgcaacagccatatatataacatgtaggaattggaggtaccagaaacctagctcttgcttcgaagaacagattgacaagtttgactacccaaaaaactgtagaaattaagcctcgcggccctttttcagttcatcttcctgtcatatcctatgctatatgcatatcagacagaagcgtgagcctctagctagtacaagcatcaacaaagtggagaagctgcgaatggtttgtacgctagcttcttccatggaagattcacccgccatgatatatggaacttcaatgtggtgatcgcttgcgcttttttctgaagactgaattctactacgatgctacctgaaaaaaattagccccaaaaagattctttgctgctttgatttactatactagctagtatgtgggcatagcacatgtttttgtgatttatatttgatcgaaaatcgctggttataggtgaaataattgtccaacgccacatatatatatataacaaaggctgcatcgtggattgtttccatttctcattaaaatgattgtgaacaaaatagcatgcattgtcgctattttatttcaacataaatataataactgctactctaattaatatccacttcaataaaaaaagcgcaaagcctcgatcttcaatctccattcaaaaataaacattgaatagacaaacaccacaaaagtacaattattagataaaaagagtggagactaaaaggatgattaaatgcataacttgttggacatatatatccttgtggaaaaaatctagtatgttgtattctgatatattatatcactacaagagaagtgctcatctctcccggttcgcaaccctctttactcccgggtagcgaaccgggagggagaatccgggactaaagatggcggtctttagtaccggttcaaatacgatgtagtaaagctccggctcatccccgtggctggcttagccatcctttagtcccggttggactaaagatttttttatttttttaatttagttgtgatgtgtgctgcctatacatatatatgcatatatattatggatatatatgtttaaatacatatatatatatatatatgcataatctagaaatgtatatattacaaatatacatatatgtgtacactatatgtatctatacatatatatgcaagtgtgcacatatatgtatatgcacttaagtaaatatggcctatatatatttacttaagtacacatatgtgtactatatgtttttacacatatatatgcaatgtgcatacatatgtagaaatacatataatatacatatatatgcccttaagtagttataggccacatgcatacattaacaaaatatgagtttgcacctaagtaaatatacacatatattaccaaaataaatacacaaaagtaaatgcatgtgtacacaaaagtaaattagtgtgttcactttgcggggaaacaaaattgagctataaacaatacttacaaagtccgcgcactgagaatagagacgtcgagggcgtcccggtgctataagtcgaagacttctttggggcggatccaaagaacatcttctccttgataataatctgagtttcgcaccatcgctcggaacatctctctacccatccctgatttatccatgtaccattgatggaaccggtcatctatgatcttattaggcgtgactagcggttcaccgagtttaaacttgtacttgaccgaagcagtttcaataggtgcgtcctctagcaactgctccatcttcagactcgtttctttcaagaactttcgtatctctatttctcccggttctatgaatggctaaacatcttgttgtggatgctgcctcagctgagggacttcctttccgcactttattgctgcagactttgctataagagccttcttcaatgttcaatcatagtcagaaactacgattggtttgcccggttccatcattttaataaagtgctcctgagcctccgggtctataggaatcttcttttccggactacgtggattcaattgtgccctaacttccactctaacggcttcatcgagctcctccggagtcttgtcgtacgaccttttcttgagagctgggagccttggctcgtcagatttggccttcttcataggccttgacggcgcaggttcatattggcgggaccttgacttggcagccggtgcaggctgaggagtcggtgcagacttggcagctggtgcaggctgaggagtcgtttgccatggaccagacggtgcagacttggcagcaggtgcaggcggaggaggtggtggaggcggaggagccggtgcaggcgaaggagccagaggagccgatgcaggcaaaggagccggaggagatggaggaggcggaggagacggcgcttgcggcggggatggaggtgtggacaccccatcttgcccgggaaacatgatgtacctcttcagccagagtaaaatggcatgggctgtgtctccaagtctcgtctccccgtctcctccggggatgtccagctcgagatcctcgtaggttcgttccaccagctctatctcgaccctcgcgtatccaggtggaatgggcttgcaatggtatgtacccaaagggtccgtggatattgatcgggagaggcatcgaatttgcaatagcctgcaaagaagacgacggcaattttctcctcgagctaacataggcaccaaatcaccaatgcagcatgcttgttaggtttgaggggcatagctagggtgatcgatacaaccgtggctgctttccgttttgtattcctacgtactatcacagcattgagagctatgcagctaagcttcacattaggccaaggaaacgagacaatgatcttcatttcttcaccttgaccagcaatatatatagtttaaatccatgcttccagatcagagagagaaagagagagaaatccaactgtcaatcgtcaccaacgttttgttttggtgccaaatcatagtaaaaagaacaaagccggtcagtgaactgctagagcccctactcaccgggtcagtggtccgaccaccggtttgtctggtccgacagataaaccggtagagttatttactatatgcatattttcctaagacaaggtcagttagctagcggtatggttgcgggtttacggcgctctgctaagagcattacaaacagttcccttattctattctctatctttaaatttaggaaattttgagcaaaaatcgtattcaacagattccctaacctatctcctaataatccaggttcccaaattcggatatctcgttacccactttcagggagcgattttttcttcccaatcacggtcttcactctcttgcacacgcacgatgaaaaaggttcccgcgctccttttctcgcctccctcaccccgcagcgaacgttactcttcctcgcaggcatcggcggcagcgaagcagcaaccatgcaaccccttccttgcaagcatcgtcgtcggatttccaggtggcaatgcagcggccgtccctttcctctcagtcgcaggggtaagttgaaatgggagtgtcaattgcaagaaagttactatgttcccttctgaaaattgtggatcgcacacagggatccatgataatcgcaatgtgtatatgcatgggagaggatagtgtagtacaaaatatcggtgaaacaaaaattatttttgacttggtgttaataatcattttgtgagactagagcacgctagctaagccaatgcaaggcactttaggtattttattggatactttcttgggtttttaggtgcaacacagaatcaattgatgcaccctacttggatcattagcacatttgtagtgtcacgccccgaactagccccgaacggaactaacctgtgacgctccaaattaacctgttaatcgataccagtcccaggaaacagtgctggtatcacaggaagacagaatatcacagcaacagtggtctctttattacagagtaggagtacagtcatgttgggctgcggacagatcccgagctcacaactgcattacaaaagggaaagcggaagccaagacttggaccaatcatcacaggcgcgacttgggaactaggccgaaaccctaaaacttatcgtaactgacttgctcctggaagaactcctcgtcagcgggatccacattatcttcttcagcaactggggggggttatttatacagagcaagggtgagtacaggagtactcagcaagccatgggaatttaagtgtttaatgcaggcttcaaggaaaggttgttgtttttgcaattgattttatttaaactcatttttgaaacaactaagtgagtgcttcttaaacgatacggatgagacagtgcgtcacgcccggtcggagtatgtgcaatgtatcagtctttgaattgattcaaggttggcacccggccaacaactttcaaacggccacccgggcctggctgatcccatcagccgccgattttccaaacatcgaacccattccacagcagcaatttcacaaagcagtagtcaaacaaaactacgctaggaatcacctcacatccgcccatgaccatgggcacggctgttcaaacagtttaataacctctacagagggggtacactttacacacacaacgttactagccttggtcacctcgcccgtgtggatcagacatgtctggtgacttggggctttcacgacaaggcatttcgaaagccgacacaggttcaccatatgccaacgagaggggtcccagaccgacatcaggttaggtcccagaccatactgtgccaggaagcccgggggttctccccgacaccaccccgttgaatccacatgtctcttggcatcatcgttcccccgactagctaattactcagccaggtgtgtcccattccacccatgtggtcgcacttgccttatgttcggatgaaattccaaggaaacggtccttaagtgcaagaacgggaaaatgtactcccagtacgtctcccggtctgcgattttagaaattcattttagttcgcaagcaccgacccaggtgtcgggttttccaagtcttttgtaaaacctaagttttacccatcgttggatattttaaattttgagggggggttccgatgcgcgtacccaaaggcccgtgcatcgaagcacaacagttgacaaaggaggtttaagtgttcaataattcaaggagggtaattgcagcaattaggattgggggccggcaagatatctcgcaagccgcggccgaattacttgtgtaaatcctattcatgcaatatttgcggaaaaaaatacttag

SEQ ID NO: 79463 - DNA, 17836 bp, Oryza sativa
tagatccgcccctgttggaaagattataaaattttgatatttttgaagcactctgaatgaaaatgaaatgaaatgttgcttggattatgtactacctgggttgtggtggccgaagatgacgtcagcaatggcctgcccgccggcctggccggggtacccagcccacaggattccggcgatcttcgggtcgttctgcgcgacccaatggcgatggggccaccggacatgagcaccaggatcaccggccctttcgacgccttcgccaccgacgagatgagctccgcttgccggccagggaggaggaggctcgcgcggtccagcccctcggcctcgatcttctggtcgaggccggcgacgacgatggtcgcgtcggcgcggcgagcggcgtcgacggccgccgcgatcggctggccgcttcccgcgcacgccacgtcggtgcatcccggctggtgcgcggcccgcgcggcgtaccgggcgacgccctgcagcggcgttgtgtacctgcacggcttcccggcgtagttcccgatcatcgccaccgttgcctcggcgtgcgggcccacgacggcgacggcgcggcgcgccgtcgccggcgacagcggcagcgcccgcccgtcgttcttgaggaggacgatcccctgccgcgccgcctccaccgcgagctcctggtgcgccgccgtgcacacgtgctgcgggcccaggtgcccgaacggctgcgccgccgggtcgccgtcgaacatcccgagccgcatctgcaccgtgacggtgttcgtcaccgcggcatcaatgtcgccatcgccgaccttcccctgcgcgacggcgccctcggtgtactgcgccaagaacgggccgcagtcgaggtcgagccccgcccggagcgtcgccgcgacggcgtcctccctggtccgcgtgtagtgctggtcgctgtagaacacatcaaccgaatcgcagtcggagacgatgtagcctgcgagcccccaccggcggcggatggttccccggaggaacgccgcgtcggcgcaggtgggcacgccgttgacctggttgtaggagcacatgacgctggcggcgcggccgtcgacgacgcaggagcggaaggggacattgaaggtgtcctcgaggtcctggcgcgtcacgacggcgttgaagtggaagcggtcggtgccggaccagttgtcgaggtcgtaggcggtgaagtgcttgcagcaggcggcgagcttgaggcggccggaggagggttgctgctgctggaggccgcggacgtaggcggcggcgtagcgggcggcgacggcggggtcctcgccgggggtctcctggccgcggccccaccgcgggtcgcggaagatgttcacgttggggctccagaacgtcagccccgcctgaccgccgttgtacatcgcgcgaccctcgtcggacaccgcctgtgcgcatacgtacacgtacatgaatacagatatacgtatacagctgaagaaatacatgaattaataactctaatataaaacacacacataaatacatacatggattaataacaaaaggaatttgctagatttcagacatctaagaatttatactattttttcttgtcacctgaagtaaacattttggtatttggttagcttaaaattgcaatgtactaacatgtgccgttgtatttcattttgcctgtaattttttttttcgaattacatattacaacgcacgcacacccatccctatgaacgcacgcacataaactatttacgtaaaccctatctctacgagcattttcgaagactgggttgcattatatagttttacttaatttttgtttaagcttaaataattgtatagttctattaaaaaaatactttgttatgaatattttttttgactgaattattttgaataattaatagtagaggggatgagaatgatgagaaacctgaaaaccagatagtcctgactagtaaaaaaatactcctaaaatataaaaagaagaatctttctatggattgttcatcatgggcaggatgacaacgagtcatggttttgatcacagtggagcacgaatcacgaggcaggatcaaatatataattgactctcctgcaatcacatggccgtgtaccctatcgtgtactcaaccaagttactatgcaacactgcattcgcacgtgaattctcaaccgtgtgcttgtgctcacattcacgctcgtgatcgaattcctctgcaaatttcagaagatttttttttttaaaaaaatgtctgcaggttctctatctctttggaaacaagacatgcagagatcagatcagacacaggtccagcaacttgccctgaaggtccaatttgtgaccactgtttgggccttgaaggcctcaactactcctaatacagtactcttgtcttgctaatcttgagagagccataaatgaggcatctgaagatcttgttctgcaagtatactaccaactgcagctctacaaacaagtcaacaacctatggatcacattgtactggagcactactgatcaattgatcatagatcctagatcgacaaatggtttcactgaattgttgaactgccatacctaccaatgggtaattaggagtaaaatggccattatatgaattcaccatgacacggggagggctagcccgccgctcggctcgccgacgaaaactccattaaatttttaatattgttgaataattaaattgatgatagaatttctatagcaaatgatagttataatgaagtttgtttgagctaaaaaaaagtttttctagcttcgccactgccatgatatgaatggaattcaatatatatgtaataacaaaaaggcaaaaggccaaaaaggtttgatctaaagctaaagttaaagcttagcactgattatggtaaacaaaattcagtgcaaacaactttgccagaattttagtgatgaagagagaaggacatgctaaaatgagagaataaaggtgggcaatatgctatgactacaataacaagagcaacatatcataactctatccttatggactcttctgatgtaaatagttgctagctgcctcctacacttcaccttggccgttggttgcatcttgcatggccacctttcagaatgggcatcacctttaattaaggtgtaccaactttacacatttacacattgaaaaatattttcttaattagctaagataagatatcagaatggggctcaaaagttttagatttggctaggctggcttgcacatggctgcacccctgtatcttgcacaccattggccagcacactatataggacactaggaattccattatgtccttcctttttggacttggacacactagcaaggtgtgcatcactcttgggtcctaaagttttgtccattgatgataatgaacttctaaactaaatttaagtgcatgttattgttttgatcaaatattaggacatagtctatttctcaccaccagtttttggttatgaaaggtgcatgatgcatgcatgcttttacagggctaacaatggtaaaataacacaatgattaaggtagaatgtcacatcacagttagcctaatacatgcatgagatctagatatattcttcagtgtagagcagagcatagcatgtgcattgcttgcttgtcattttgctaagacagaccatgtacaaacacggtgccttaactcacaattagtgcctaacattatgtctagacgcaagctctaatgtcttatctacaaaaagataagtactacacacatataccatttgtgtgaagctaaattaacaaaaaaaatagctagtaaatgcatgcagagcaaatcagttcaccactagtaccaaaaacgccagtaaaatcaaacaaaccagaaacaaagtacccttgaaaggttaaaagcagtcacttgcaaaaaggccaaaagggcatatggatcattagccttttcttctttgtaatcacacatgttgtaggctccacacaaaaataataatacaactccagtgctctatccattccaccaaccatgatccagcagatgctattgctgggccagtgtcacagtgaccctctttgctcatgcagatatttaggccaactcataactgaataaaaacttgttcatgtaaaatttccacaaacttttatcttgcaaacattatgtgcttgaagtttgagaactgccatgcatacaaaaaggttttgttcactacatcttacacttgttcaccaaaaaataacattttctgttataaagattgaaaattttgtggacacgcatcattattaagcaaagtggtggcaaggatgctagtgctctatccaagtattatggaccgtgagatatgtgctttaagattcgtacccaaaatcattggcactaccaagtaaaaaactactcattctattccaaaataaaaacatttctagaatagtgataagtcaaatatttttaattttaactattaatagcaaaaaatcaaaaagatcattcatctaaaattgatgttattagatttactattaaataaactatcataatatgtaacttttcatttaaaatattttattggttaaagtagtattttaaagattgcgtggaagatttatattttagaagagagagagagagtataaaccatagaaaaaaaatagagaaggacagaacctgagacaagcgcgacgcacagtagcgagtgacacagacaaggacgccatggcgcgcacagacatgacgaagagaggcatcacatgcacgcacaacaacaaaaccgcgacaaaagcaaaagcgccgcgcacgccgcacgcgcgccgcggcgtcccgtgtccgcgccgcgcgcgcgccacggcgccggcgacggcgacaatgccggcgacacagtgttaagtgtggaacgtacctgcccgatgagctcccagagggtggcgttgaacgacgcggcggtgccgatgacctgcgggaacgcggtggcgccggggaacgcgccgccgaacctcaccccgggccccgtgtcggacacgccgtggagcgcctccgaccaccactcgtacccggcgacgcccagccgcggcacgccggcggcgttgttcaccagcagccgcaccttctcggcgcgcgtcagccgcgccaccaggtcgcgcgcccgcgcccgcgccggcagcgaccgcctgcagaacggcagcgtcgccgccggcccgcccgccgcgcacgcgaacgccgaccgcgccgcgacggggacgacgcccccgccgaccgccgccccggcgagcaccaggagcgggaggagcaggaggcgccgcattgtggaagtgaactcctcctctgcaactgcaaggtgtttgtggaaatggagatggcgaaggcagcgtgcttatataaacccaaccgcacaatctcaggggctctgcaagttgcaaccaacccccagaggagaggagcaagaaaatggctaatttctttctctcttttttttatactttttgtttgcaaagaaaagtatatgcttttcaattaaaaatttacagcacgttttcagtattccataaattatttggtttgcagagaaaagattaattaaaattcaatcaatgtctcgggtgccatgagtttctttcttcaattttgatcgtctgttttatttaattgttttaaaaaaaataaaaaacataagtcatgtataaactatattcatgttttataatctaataacaataaaaacactagtagtaaaaaaattttaaataaaacggatgatcaaagttggcacggaaaatttatggctgcatttattttgggatggaagaagtagtaaattgcagtcactgctgctggctagtcctagagaaaacttaaaaaaaaatcggtggctgccagtttgtgtgctgcgtgctggtggtgttttcattctcttgtgcatgtgagcatgtaactgtgtgtttgtacaatgagagaagtaataaatcattttttccctttctttttagtaatggtgtttgtactgaatgaaagttggtggtgatggatatttgtgatttgtgcttcaaaagtcagataaagaagtaaagcggtttcaaggacagggcacggctactttggagcaggtattgacgtactaggctctgtactgtactggtgtaaagactgcttttagaatttacaaaggtaattactgctatgattaacatctgaacatatccattagctttaactcccaaaacaagtaccttcaaatctagtagagatgaaaatagaggaactttcccatatgaaaagcacctaacaactttccctatctcctttcttcctctatcccttttaacctgaattttttttgttggtttatcttggaccgtccaatcaaagagtctatgattttattctagaatagaaacaatgttgaaacagaagatttagttcattaccacactagacaacaaacaagaatctataagttccaattaaggcctataaatatctctcagtgatcaccatgtcatcttgatcttttatttgtaaatgagagcatgcttttaatcataatctgctttttagcctctgtttggttctgttttggatttatgagagcaaaagagagagggcctgcttgcctttagcatcacatttgtgtaaagatgcattcatgccttggaaggaccaccttgcagaatggaaggatatttctccacacatatgtcatcagactaatctgttcacagtactcatgcaacaactcttccataaaaacaacgtggcctcattagcacaaagctacatgtttcataagcagaagcacaagctcaaatcctacatcaatcaaagaatgcgtttcaaacaagcccaaaatgttactgaaagcatcttaacgatgtactttgccaagtttcatttcacacaatatatattgactcttgcactcaccgttaatcttgttgagcagttggtaatccaatcttttttatggtcagttttagtgagcaaccaacttggaacggcgtactacgtatttcgccggcaagcagttgttcagtacttcaacgtacagatcaaaatgtcatgatttcacctaacacctttatacaaaccacagtccagtgaattacaaatgtttttaaatgcaatttcatcaggttgtacaaaatgttgaagaagttcattctgtcattaattaatatatttaatggcggcgcctatcatgcacctgatttgatcgccagcaagaagaggattagaactgagaataacttcgcttgaagaaatcggactagtaggttgatttaacaagctttgctggaagaactaatgacgtgtcagaattacttaccgtttagaccaatgcaaaggatacgaaaagcttcatcaaaatggtttccttgtacggaggtattgtttggcaactttgctgacatggattgataaatgagagcgaaatgagtgtgtcactgtcaaatcggattagatgagtagttcagctgcaaaggttaaaagcaagaggataaatacgatttcagaattcagatagcaccaaaaagagtaaccaaagtttgagtgttaatagatcatctgtgcacaaaacttgacgtctcttgcaggtctgcttgtgcttatcccttttcactctgtttaaagcttcttttctttttgtgaattcttgaatgttgatgaatgaaaggtcgagcaaacacttattcttattcgcaactaaatgcttccaaagaagaagcatcactctattttccctaatccctagtgatttctccactacactgtgcaacctatttctgatggcaaaagtactactatatattctaatgacaggcagaaagacaacatgcttattagtccttattcttttccttttcactttcatgatgtgtgaccaattgatggtgaactgttagtggctttcaaaagcatagcatgttatacatcactctgacacaactaggagaagggagaaagtgtgatgtccagatgctaatgggacatgtaccatttcacttcaagtattggctcctgtaaatggtcccttctactatccattatcccttatgccaatgccactatggcaccaccatccactagtaaggacagaagttagctccaagagttagtggtacaatgtatttatggagtagtgttgtgatgtcaaagcaagaaaactaccagggtacccacttcagtaagtatatctgtatatgatcttcctcctgaaaatgctgagcaactatttgtctgcaacagtagaaaagctaggtaattagactcactgtgaatagatatttttatgggtttagtcatgtaaattctgcatatgtagctccccaaatctctgcagaaaatatggagatgattccacatttccacttcccaaggcttttagtggcgttgttgcctcatgtgcatccacaattctgcatcacttctgttcatggacatacgcacaaaggtcaacttgcaagcatgcatcacccaactggaaccgaactggatggcttcagctcatggaattcagcagctgttgatgtaggggttggtgctgaggcagtgaggctatgctgcagaacatgtggtactgactgcatgtaggacaggatactgcatatactcatacagttgaagaagtaatgggagcaggaatgagtgaatggatggatgataggagtaccagactgcagtgtatctgttgggcaaattgagagtcatgggctctattgagtctctctgattggatgcagcacatcttgactgaattttgcatcagcaatgattgtgtgcaaggctctttctcccccaccagatgctgcgaaatgcatgtatatcttcaggaacagaaaagaaaatctttccctccattatccacccttgttttttttattgaattcatcattctacaattaaacactgaacagaacagcttgtgagtcatcaggattggttcaagacagatgtaatgaccagtgccttagctttcctcattgctgtcccattaaattcttcaaatcacccgtgatcttgatgccttcatatgctctgcaggggatgttaaccagtgctcttcttcgatacttgaaccttcctaatttttcacgaggctttttacagtctttgagtgaaggaggcaccatatcctagccgtccattccactcaatctaatggcctaggatctcccgcaaaagcaggtaccgaatgttgttgatggtgggagggcaattttgtactttcgcttgcaggaatcaagttggagcggagcaccatctgtccgatgcagtcgtctactcatcgactcctcaaatcgaacagaaaccgtataggcgaacacgggcacacggcgacgagcctgagacaaccgatgcggtggtcttccgggcggcagtgacctcgggggaggtgggccgatagggaacaccggcgacttcgtggttccctcccgtcagtgctcccgcttcctccctcctcccggttcgatcctgacggcgccgcattctagtccctcctacccattccaccagagcgaggacgggcatcgcaattcgcaagggcgccggcagctgcaaggtcaaatcgcgccagggcgattggctgctacgggctacggcgaggccaccaggaaacttgaagcagacaaagcttttcactcgagaagctcatctagagaagccaatataaatccacgaatttcagaggcctcgtgccaaggagttagaagtcctgcaaaccaggcatttgtttgcaagccaattgcatcattatgcgctgaaccacaactaattacagaaaggtttacaaaagagccttttcaagaacaatactccaactaaaaaggaacaaggagcttgaagaacagtcatcatcagaaagttctgaatacatgtctgacataaattcctaacaaatcctatattccacaaacaagatctaaataaccactgcgtaccacaccaaagaaggttcagagttccacacttccacttcatttgagtttcagaaggttcagagttccaggaactgaacttggcacttccacaatactgaacactcatacttcatgcgagctttgaagcacggcatatatactagcacaagacaaaccactatgcatgctatggacacgacatgactgtcaaagtgtggagctctggtgctgtgtggagttgggcagggcacgatgatcaagagcaaggggggagatagccgacagatgaaggcaacggcgccctgtggctgcagcagaaaggacaaagaatcggagacggccatgggagggagcaggggcaccctgccgcggggaggatagagacgctagcagaagaagcggggaggctggctttatgaagcagcgacgtcgtggatcgatggtcggcggcgagatagatgggtggaggcggcgctatagatgggtggccaacggcatcctggaggaaaggagaggccgcgccatctagggacgtgcgccggtgccaaagcaagtgaaaacaaaggatgcggagcggaggggaagaggacgaagaagaagacggagaagagacgataccacacgcgcagacgtgctattccgatcgtatcctttgtgaacggacggatggattgagttggtacctcctcaaagataggaaaaatactcatttttcacactgtattatgttatactagcaatgccttccctgattcatagctcgagttgttgtctcaagggatgaaactggttcggatagtttccgtccgtccggaccatttttcgaattcggatagtttcggtcggaactatccggaaattctcggattcggaaacgaattcggattttttttctcagaaacgaaaacgaatacagtaagggtactatccgttggaatcggaaataagtcggaaactatccggaatttttttcagatatccgcagacattgagtaaattttagaaaaaaacacgtatatatgcataactttttcatacgaaatcatatgaagacaaactttatatcaacattgtaaagctcggtgagatctacaactttcttattgactattttattatttgaggtcatttaagggtctaaatattcattataatataccatattaatttttacaaaatctcatatctaccatccaaacgacatctgatggagatgtgttacatatcaaagttgtagagctcaactggatctaccactttgtagtttataacatttgtatttgaaagcatttaaagcataaaataaatattgcaagtttcgaagatgcgaagtaaaataaacaacatctccaatttatacaatggcaagtaagttatacatctagtagaaggtcttgagaatagaaactgataatcatatttgcatatgaatctcttagaggaacaaccataaaaatcgattttcacatacggttgtgagaccgtctataaaattgacgatataaatattggagatgttgaactaaaataataagtgatatctcttcctcgatcaagaaactcaatttgaggggccttttatataccggtaaatattcactaccgtattcgttccgtctcgtattcgctccgtatttgtattcgataatatttgatttcatttccgtatccgacttttcgattccgattccaattccgaaaaaaatttatgaaaacaaatatgataaagctaatttccgtccgttttcgatttattttcatcctctcatggacaattaaattggaatcgagcttagtgttcattcctgtactcttcacttattcagtatttcagttcagtgttcttagtttcatctcaaccatttcgattttcgggtacaaattattcttcccatgcatgaatgacgcacaaaacaatcaacggtgtttggcgaatttcatctaaccggagcgacgagaagggaaatggagcgctcgaccttgccctccgcgctccgccaccggtcttcagcgccatcgccgaggtgggggctcgctcgatggccggaccaggtgctccgtgctcgaggatttacctcactggctgactgactcatcggagcgctcgccatcaacctcgccgccagcgccaccgtcgccactcgccggagcgccgccgccgtcggcgacccacgcgcccttttcaacgataatacgagatagtttgagggcttactcgaaaataatcatcagatgcttacgtggctttaatctcagccggctgtgttagatcaaacgggtgtaaagatgcacatgtaccttttttggattcaaaaatggaaattctgatagctaaaggactcgttcaaaaaatcacctccaacaactggccaacgttaatatcgaccgctagtgttcgatcggacggtcagcagagatagaggcccatcgacaaggcccacaatctcgtcgtgaatatggggccgcacgttgcctccggcctatgttggctagaactcgccgcagtacagcctaggcccattaattgaggcccaaatcatccctcacggcccatacattatgggccacaatttgctcctggcatgtggtggcccacaaattaatcccaacagcttgatgggcccatacaatatgggcctcacgccggcagcagctcaccggcgcatcccgaccagccatgggccatggcgctccactccggcgacgacttggatcccgtcgtttcttcgactcttcggcgagcttccggtctttcagtttcatatttcagatcagacaagttgagcgggtacggaattcaaatttgcagagggatatcaactagaagcaggaatcctcgatagataaaggataatgaagtttgtcaggtatatgttgtctgtttgtcagtatcattcaagattcagatcaggtagctcgacaaggtaaatctgagttcccctcaatcggctgtgaccctttcatatttatagggtgggtggacagagcttagctcttgtacaagtcgaattcatgacaaattcgttaagaacacatactctcttttcggataccaaaacaggatcatccggtttagcaggacatattaattttaactgttactctctccattttaggttataaaacgttttgactttagtaaaagtcaaactactttaaatttaactaattctataaaaaaagtaataatatttacaacactaacatagattcattaaatctataattgaataaatttcataatatatttgtctcgggttaaaaatactaatactttcttttctataaaattagttaaactaggagtagtttgattttaaccaaagttaaaacgtcatgtaacctaaaatggagggagtaactccttgtagtgacaatcaatacttatgttaatggttggcatgggcaacgattgtgtccaagactcattctccacccatcagccactgcttaggtgggatggaacccatgtatatcttgaggaagagaaaagtaaatccagctttgtttattacattgaattcatcttatccatttaaacactgaaaacaacggtctgtccgctgtcatcaggattggttcaggaaaaagctacgagagtgccctaacttttctccttgttatcccattacattgtttaatgagagaatatattctatctccctaagtttactccaattcaaggatttgccatcgattgtcttcctctataatatgtcatcaactttgtcaactttttctacaatatgctattgaggtggatactttttcaaataaaaaaaaaactaaaatgtcactcaagacatggctgtttggttgccgccgtagtttgcctcagtagctgtggctcaccatgcttggcttgccacagttgcctaagctttttgtgtctgaatgtgcttgccacaacaacagcgccgcagatgaggcgatgattttcagcgccacaggtgtggcgtgtttttgtactgggagcagtagtggcagccacagctttcacgggaaccaaacaccagccgcactctcgatctggcgtggcgcatgttggcaggaaccaaacaccggccaagctctccatggctgccgcaggtgtggcgtgccgcgcggaggcgggcaaccaaacaaccaaaccgtcggtgtgccatctgcgcccacggtaaagatgttattttccaggccaggattgtcgatcacaaccaaagcgagtttttgttcagacttcatactctttggcatatagaaactactggaatctgaaagcccaaaagctttcgtcattgcagagaggccacagtgaggggtgaagaaagcatgacgtttcttcttcgtgtgaagggagtgtctatgatcattgttcgtctctactactagcatataaagtagtatgcacctctttggctctttcttttttcttttttaatcaaagtgcgctcctgctttaacatcatggaatataatctttatacttaaactaattataatcacatcactaggcgctagctaatcatttgatttacttggaaattttggtgcatcaccattaacgagtttctctatggcaaccatactagattctttaattggatcatgcgtaaacaagttgcaacggctcattactgaggaggcaatacaaattttacatgtaaaagaagaatttattaacaaaacaaattacatattctgccaggaaactgtgagacgaatttattaagcctaattaatccgtcattaacgaatgtttaatttattgtagcaccacattgtcaaatcatggcgcaattaggcttaaaagattcgtctcgcaatttcctggtgaactgtgtaattattttttttgttttttttgtctatatttaatactccatgcatgtgtctagacattcaatgttacagcgtgaaaaattttgtttgggaactaaacagcccctaaacagggcctcataagagcaggtacaatagcaggctataagccagctgcaaacatattttaagaagataaataaggagagagaaaaagcagcgggctacagatttgtagccagatgtagcacggactccaagacgcggtgtgtgtacgacaggtgggaccatatattaatagtgtagtatgcaactattgtatgaatgggctattagattggctatagatgaattggagctaatagttggctatactattaaacttcacaatttttgacaatttgaccctttgcaaaaactatttttacaaatgaaccgctgccaaaacttatttcaaatctgacccttgtgctcaacgccaaatcatgtggcgctgaaattaaacacctcagcgccacgtcagctggcgctgaatgccgtgccacggcggatgggagactaagtcagcgtgccaacgtacattcagcgccatgctatttagcgctgaggtgtctaaattcagcgccacacgatttggcgttgagcaaaagggtcagatttaaaataagttttggcagtggttcatttgtaaaaatagtttttgcaaagggtcaaattgtcaaattttgtgattaaacttgctctaagaggacaggactatgatggtccatacatgccatcaaatgcacactcataaagtctgagttgtcagtgttcaaactgaaaaacatcacatggcaagctgtaagttattgcctacttcctactagtagtactggtagtaactgaaagctccaagcagcaacaatctcatatcgatcctctagctccctcgtcagattacaggggaaacgttcttgatcatcatctccctcgtcagcggctgcacgcaccaattaaggcctcactctgaggcgagtctttcttcctcacgcaccaaccctctgcttgcccacaagctctggttccttgcggtatgagctgattgaaacatcggattgctcagtggtcgtcatcttggcgtgcactgctgccattcccatcaatccagctccattcggcctcgcctttcatgtccagctagttcaccttgtatacatgaagagaacacctcatctgtgctggttacttcgtcttttcattgcccattgaccaaagaagctatcgaaaggtaaccccattaattcttccaattcttcagcttcagtatactaaattacttgctccaaagacattgcaaaatagcttgttagctagagatcgtgctcctgcgttacataaagatgaaactgagtaaacttctgatcatcttcagaccatgttattattgttaataacttggaaattttcttgcatcacctcccatcatcactttatacgttatatgcataactctcaaagacagaagaaaaactcaagaacatatacaaatgagaatttccaagatgatttctactgtaatattgaaaattataaagtaccatccattcttttcacgccagatgactactttataaggtagacttgcatgtaaggatgtacttcaaatctcttgttcttctagctgtgatcattttattgtttttttttcaggaggagaagggagggggggggggggtccataatgttagttactacagttaaatgcgctaacacaactcctaggctagcatgtgcgaagtagttatagaataaaataagatagatatcttaatgttacgccagcttttggaatcatttctggactgcattaatttttaactctcttctggtattttttgttgaattccctaaaacagtttgctggatggcaacaatagtggatactttggttggatcatgcatcaataagttgcaagcgatcattacagacaaggcaatactcattttaggggtaaaagatgagcttaagaactgcagcgaagaacagatctcataagatattctcttcaggatgctgaggcaaggaggatgaaagattctgcagttcaaaaatggcttgaccagctaagagatgttatgtatgatgttgatgatattattgatttggctagatttaaaggaagtgtcctactacctaactatcctatgtcatcgtcaaggaaatctactgcttgcagtggcctttcactttcatcctgcttttctaatattcgtatacgtcatgaagttgctgtaaaaattagaagcctgaacaaaaagatagataacatttcaaaggatgatgtatttttaaaactcagcctcacacaacataatggaagtggttcagcatggacacctatagaaagctccagcctagttgaacctaaccttgtgggcaaggaggtcgtacatgcttgcagagaagtggtggatttggtgcttgcacacaaggcaaagaatgtttacaagcttgctattgttggaacagggggagttggcaagacaacactagctcagaaaatattcaatgataaaaaattagaagggagatttgaccatcgtgcctgggtttgtgtctccaaggagtattctatggtttcccttttggcacaagttcttagtaatatgaaaattcattatgaaaaaaatgaatcagttgggaaccttcaaagcaaactcaaagcaggcattgcagacaagagttttttccttgtgttggatgatgtatggcactataaagcatgggaagatttactaagaactccactaaatgcggcagccacaggaataattctagtaactactcgagatgaaactattgctcgtgtaattggggtggaccgcactcatagagttgatttgatgtcagccgatataggatgggagttactttggaggagcatgaacatcaaagaagagaaacaagtgaaaaatctacgggacacaggtatcgagattgtccgcaaatgtggtggcctacctcttgcaatcagggctattgccaaagtcttagcaagcctgcaagatcaaacagagaatgagtggagacagatattggggaaaaatgcctggtccatgagcaaacttcctgatgaattaaatgg

SEQ ID NO: 79464 - DNA, 6970 bp, Oryza sativa
tcccccccctccccccaccgctccgcccgcgcgccgcgcgcgcgtgcgcgagagccgcaccgagcgctccctcccccctccgctctgcccgcgcgcgtgcgcgtgagccgcccgcgccgagccgagtcctccctctccgctccctcgctgccacttcccgcgcgccgtgttcgcgtgcgcgcgcccgcgcggtcgccgcccttgccgcgcctgcgccgtctgtgccgcctggcccccactgccctaccgcgcagccgcccggccccgctagccagcgcgcgtgcccgagccgcgcctctcaaaccgccgcgccgcccgttgcttcccgcgcgcgcgtgtcgtggtggccgaccgcccggtcgccgccgccgtcaccctctgccgcgccagcccgcgcctgtcgcccgtgtcgtcgcgccgctccaaaccgtcccgccgtcatcgccgtcgtcatcgcctcggccccgcctccgcgcgcaagccaccaagggacggaggcagagcccctcctccctctgccgcgacgcccccgctcccctcctccttttccaaaagcggcaaggaggcaagcccctttttctctccctcttttcccctttttccgtcaccgctggcgtcatcctcctccctccgccctgtcgccgatttggacgcgagcgccgagcgccagctcgcgccttgaccgcccaaagtcggtttccaaaccgacattgccgcccttaaagccccgggcgccctccctctcttctccttccatcgcctccgcgccattgccgccgcccccgtgctctgttcgccatcgccgttcgtcgttgcgcgtgtcggaggagccggcacgagcaaggacgcggaaggggactccgggcgcgccctcttcttcctcttccccggcccgaggccggagagattactcccgcgccgtcggcctctcgtcacagcgcccctcctcatcgcggtagtgctccctccgttcttcctcctcgctccacctctccctcttagttttcggtagtagcacgagtagcctccccgtagctagccggcgccgccccggccgttgccgcctctcgccgggtgctcgccgccgtcgccgcccgagctcggaagcgccgctcgtcgccggcctcgctcggcgtagctccgcccaattcgacgctagcatcggattcccgtggccgcgtagatgctctcgccgccgggaatcggcccctcgtgacctcgtcgccgtttccccctttttccgccgccggatgccgccgccgcaattcgccgccgtcgggcatcctccggcgaatccgagccgttggctcgtctccccttgtcctgttcaaccatccggtgtgctcgctttcgcctgtatcgccgtggttcgctccgccgctcgccgctgtcgtccgccgtccgttccggccggcgtcgtcgtctacctcccgccggctcgcgtggcagccacgtaggcgccagctcagccaagaccgggtcgagccgaccccggtcagcccctcctcgtgcgcgcgttccaccgcgagccgtgaggctgcgcgtgggcccgccgcatccgcatccaccgtgaaccgcgcgcgtgcaccgcgtccctcccccaccctagcgccgcgccgcgtgctccctccgcacggtgagccgagccgctgacaagcgggtcccacccgggaccgggcgtggtgagcccggtccaccggctctctctctcctccctcccgcgcgcgcgcgtcttgggccgctctgggccgccttcttgggccggccggcccgttaagcccggccgagccgccctttctctcgggccacgccctagccgcccgagggaagtctattttccatccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgctgagttgtcccgtttcgcgtgtagtttcggagcccgaagacccgcagcgcgaggatttcgaggatcaagctccagatctcgagcaaggcaagccacctttgaacatcttgagcctatatttgaaattcaattatattgcttgcaaaatattatgcattgataggatcgcacttaatctgttgtcccgtctgcaaggcagatcggcggacctacctaacttgttgcatttgatccttccattgttaattgctataccatgtccccttgtaaccatccagttgcgcctcgatattcgtgcactctgtgcgagtatcgacggtcgccttcaaacttaaaatctgagtaacaatttgggtaaaactggagttttacaaaagacttggaaaacccgacacctgggtcggtgcttgcgaactaaatgaatttccaaaaccgcgaaccggggaacgtaccgggtgtacggttttcccgctcttgcacttaaggatcgtttccttggaatttcatccgaacataagacaagtacgaccacataggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttatcaaactattcgaacagccgtgcccacggtcatgggcggatgtgaggtgattcctagcgtagttttgtttgactactgcttgtgaaattgctgttgtgaaaaaggggttcgatgtttgaaaaatctgtagctgaagggatcagctaggcccgggtggccgtttggaaaagttgttggcccgggtggccgtttgaaaagttgttggcccgagtggccgttgaaaagctgtcggccgggtgccaaccttgtttcaattctaaagactgatacatcgcacatactccgaccggacgagacgcactgtcttatccgtgtagtttgagaagcactcacttagtcgttcttagaaaagagttcaaataaaatcaattgcaaaaacaacagcctctccttgaagcctgcattaaacacctattttcccttggcttgctgagtactcccgtactcacccttgctctatataaataattccccccccagttgctgaagaagatgaagcggatcctgctgatgagaagttctttcaggagcaagccggctacaatgagttttagggtttcggcctagttcccaagtcgcgcctgtgttgtttggtccaagtcctgcttccgtttcccttttgtaatgcagttgtgagctcggggtctgtccgtagtccaacatgaccgtatctctactctataataaagagaccgctgttgctgtgatattctgtctccttgtgataccagcactgtttcctgggactggtatcgatcaacaggttaatttggagcgtcacgggctagttccagtcggtactagttcggggcgtgacacgccgcctccgccgaccaaccgcgcattgtcccagacgccgccgccatgctgcatgtgctgcatgccgcctctcagctccatcgccgcccctctgcgccgctcgctgccgctcgccattctcaagggagagagggagggagggatagagagaagaaggagagagaggatagagagaaaggggatagagagaaggggtagtgaggatgataggtggggtccacgtgggccccaccatttttttttattattgtgtgtgtgaaactgacatgtgggtcccataggttttattaatttttggatcgaattgccacgtaagcgcaacgtcaatgccacgtcagatgaagaccgagtcaaattagccacgtaggcgccacctcagccaaaaccgaggtcaaatactaccgagggaccttatttaaacggtttcgtaagttgggggacctgtcgtacccacttttgcaattaagggatgaaaatcagactaggcgacaaatagagggaaccaaagtgaacttattccacagagaatccccttgatgggccatacaatatgggccgcacgttgcatccggccgtagcagcccacgatctccccagggcggccgctcgccaagccctcgccgtcgccggccgcccgccgccgtcgctttcctcgtctgagacggcgaacccctgcccaccacaccgccatgttcgctgcgaggccggccggaccgccatgtgcgggcgcgcacgatcgagcatccccaactctgcctgaacacacaacatgaataatacatgcaagtttcagtcactgctactcactgcttgtctgcatctgaaagttcggacttttacttacggattctattagtattactgcatctgcacgcatgagaaagtattttttttataaaaaatattttcttaaaaagtttttaacctaggtgcccatggatttgatttttgacatgcttaatgtgtgttcatagctatctaagatttcgaaacctgtgaattgtgcatggactgattttttacgggcacagtgctacgctacttgactatgacttccccgaatgcaaaatagaccttttgttttctggattgctcataagcatcgtctatgtagatgttttcaacataaaagtacccatggatctggttgagccaacaaatgaaagaataacatcgctacaaacaaatgctactaatcactaatcagccggtcagaatcgcacaatatatatgcatgatgttatataacaaaggcactgttgatccaacaaaacctggaaatagtagcacccaaggaggaaggtggtgatcttaaatcaatggacaataatgaatatctgaatcttctcattcggttattagtttcgacattgttggttgctctttgatgttcttgcatatttaactcaagaaagggtaaactcaagaccaaattcatgtagatgtaggcaaatattcatgttcaatctgttgaagcatataattgcagttctgaacatctcttggctagaaagctgcggctggactgcaattccgctggcagaggagaggactacaagtgcagcaatatgttgtgtgcaattgtgcatgagtgcacaagttgaaaaaaggtaatattatttcattccgaaaagatagaacaaccgtgaaaataacgttcaaaccagtcagttcagaggagaatacggtgatggacagaaggccagaaaacaacccaatggtgagaatcgatcatttttctagacaatgaatggtgagcaattgatcttggtgaagctgaaccagataagttgacagcgttactgttagtggtgatcagcccagccatccgtaaatcctttcttgcattttgcccaatacaagtcagcaagtcaagatgttcttatcgtttcagactaagtggacactggaatctgttcttttcacatccacactgggacacatacagaaaagctaaatggacataccacctaacagcaatatctcttgtcttccactctttgtcactgcataagagccagcccatctggatgatccacgcaatcaccggggaacttgctcgtcatcttcctcgcaataggcgatcgatttgccggcttgccatggctgcacgcaccaaaggcctcgctctggggtgagtctttctttcaattcctcgcaacatagcatgtgcttgcttggttgttgggtctgatggaaatgtcgtcttgcgatgcagcagacgcgccccatgccgctgctgttcccattgatctaggatcactccggtctttcctttcatgctgagcaagttcgccttctgtacttgagtaaaacccctcaactttgttgccagatatttctttctggttgcccgtttacccaagaagctatagaaaaaggtaacctcattatttcattttttcagattcagtgatccagtatggtcttgtggcaaaacacatgcaaaataacatactagctagatatgtgctcctctcttacaaatatactctactttatgagtcaggctgtgtttagttcagtgcaaagtttggattttggttgaaattggagatgatgtgactgaaaagttgtgtgtgtatgacatgttgatgtgatgaaaaaggactgaagtttggatccaaactttggatctaaacacagcctcagtcagacagtaagacaaataattcagttcggtctctagctatgatggtccgtgcatgtcatcgaatgcatttatgcacactcataaagtttgagttgtcagtgttcatactccagtaactgaaaaacatcacagggcaagctataagtcattgcctacaagtacctactagtagtactggtagtaactgaaagctgtgcagctagccttcactggcaagctccaagcagcaacaatcccatatcgaattaagtggaaactcttatacaaagaatagatggataatatatttactgaacttcatcttgcattcatattttgtcagccttatctaacttttaaactatgttaacacaagtttggttacatgtcaggctgcattttttacattgatcaattatatatggtggattaccccttttgagtttgtcggatggcaacaatagtagacacattggttggatcatgcatcaataagttgcaagcgatcattacagacaagacaatactcattttaggggtaaaagatgagcttgaagaactgcgacgaagaacaaacgtcataagatcttctcttcaggatgctgaggcaaggaggatggaagattc

SEQ ID NO: 79465 - DNA, 44590 bp, Oryza sativa
  unsure (1)..(44590): unsure at all n locations
tcaatgataaaaaattagaagggagatttgaccatcgtgcctgggtttgtgtctccaaggagtattctatggtttcccttttggcacaagttcttagtaatatgaaaattcattatgaaaaaaatgaatcagttgggaaccttcaaagcaaactcaaagcaggcattgcagacaagagttttttccttgtgttggatgatgtatggcactataaagcatgggaagatttactaagaactccactaaatgcggcagccacaggaataattctagtaactactcgagatgaaactattgctcgtgtaattggggtggaccgcactcatagagttgatttgatgtcagccgatataggatgggagttactttggaggagcatgaacatcaaagaagagaaacaagtgaaaaatctacgggacacaggtatcgagattgtccgcaaatgtggtggcctacctcttgcaatcagggctattgccaaagtcttagcaagcctgcaagatcaaacagagaatgagtggagacagatattggggaaaaatgcctggtccatgagcaaacttcctgatgaattaaatggtgctttatatctgagttatgaagtgctgccgcaccagctgaagcaatgttttctttattgtgcacttttccctgaagatgcaaccattttctgtggtgatcttactaggatgtgggtggctgaaggctttatagatgagcaagaaggccaattattagaagacacagcagagaggtattatcatgagttgatccatcggaacttgctccaaccagatggtttatattttgaccacagcaggtgcaagatgcatgatctcttaaggcaacttgcttcttatttgtcaagagaagaatgttttgttggagacccagagtcactagggactaatactatgtgcaaagtacggcgtatttcagttgtcactgagaaggacatagtggtgttacctagcatggacaaggatcaatataaagtgaggtgttttacaaacttctctgggaagtcagcaagaattgataattcacttttcaagagacttgtatgtcttcgcattttggatttgtctgactcacttgtacatgacatcccaggtgcgattggaaatttgatttatctgcggttgctcgatcttgacaggacaaatatatgttctctcccagaggccattggctcccttcaaagccttcaaatattgaatttgcaggggtgtgaatctttgcgcagacttcctttggcaacaactcaactatgcaatttgaggcggcttggtcttgctggtactccaataaaccaggttccaaaagggataggaagactgaaatttctcaatgatttagaaggatttcctatcggtggtggaaatgacaataccaaaatacaagatggatggaatttggaagagttggctcatctttcacagttgaggtgtcttgatatgataaaattggagagagctactccttgcagcagtagagacccatttctactaacagagaaaaagcatctcaaagttctgaatctacactgcactgaacagacagatgaagcatattcagaggaaggcattagcaatgttgagaagatctttgagaagctagcacctccacacaacttagaagttcttgctattgtgaatttctttgggcgaaggttccccacctggcttggtactaaccatttgtcttcagtgaaatacgtgctcctcatagattgcaaatcttgtgtgcatcttcccccaatcggacagctaccaaacttgaaatacctaaaaattaatggagcaagtgcaatcaccaagattggacccgaatttgttggctgctgggagggtaatctcagatccacagaggcagttgctttccccaagctcgaatggttggtcattgaggatatgcccaactgggaggagtggtcctttgttgaagaagaagaagtgcaggaggaggaagcagctgcagcagccaaggaagggggagaggatggaattgctgcttcgaagcaaaagggggaggaagccccgtctccaactccaaggtcgtcgtggctgctgccttgtttgacgaagttggatctcgtgggctgccccaagctgagggctctcccaccacagcttggacagcaggccaccaacttgaaggacctccttataagagaagcagaatgcttgaagacggtggaagacctcccgttcctctctggtgccctttcaattggtggctgtgaaggcctggagagggtctccaaccttccccaagtgagagagctgtttctaaatgtctgccccaatttgaggcatgtcgaggagttgggtggtttggagcagctattgctggatgaaggtatgcaggagatctctcagctgtgggtcccaaggcttcaggagcaacaccgccaactccatggagatgagcatgagctggaggtcatcgagtggctgtgagacccaattaatttagatggcgcaaggtatgtacactaattgcttgggacatttcactggaataaactaatcattgggttgtacattcatgctgcccctctgctcttcagctgtatatatgcagctattctagcatttgatagtctccttagttgttcatgtcgtgtgcattgactgattgtttaatgatttatatgatttagttttattttcatttatgctgcatgtaagcatttcatcatggtcaagattttcataaaatggtggatatacattgacaaattcattagttgtccatttctttaatcctctcgtgatcttattaacatgcgtcctgtacatacggtgtattctagataaatgaattgtcctatatgtactacaacataatcatgtgcaatagtgttcctagctctgcagacaaagatagagattacttctactccaaaagaaaattgtatgggttatatcaccaaacaatgctatgatggcattgctatattcactatatgatagtagtaatatcacaaatgcatatatccatccaaggacttggggacaacataaatggtttagcatttggtacacaggctgcataagtgcacgactaaacataatggacttcgctaggccaagagataagtaatccttaattcagctcttgaatgtgctagctatgattggccgtgtacatccttcgggatgtagaggccgggttttatttaatccattatttaaaaatgcgctatctatgacgaagaccagatcacgtgcatttagccttcaagtctgcaagtgtgttctatgtcatatcaatgtgcacatttagtactcagtatcttataaaaacacaaatacacatgaattttcgcaagacattaggcaatagagtagtttttttagatttcacaaaaaataggtcaggcccaatgttacagattccttgcagcctgtgagcaggatattgaagatggaagggttgtgcccaacatctgttcctagtgtagggctcctaattaaggtttgtttggtgaaaaaacaaaagccacctaaatgtctttgtattggttcaaattgattaatatttttgttcgtattacatctgttataagcagaggatattgccgagcgacatgcctatgtatagtccctatgtgtcttttccttatactttttgtaattcacgtatgatgtttggtaagttcaattgtagaaaatagattgttgcaaaacggatgtcacttgtattttcttttccttaattaagttatttaattaccaaattgcttatgaatatacatccatgattaatttttgtgcgcttatttgtgttgtaggttaatcttgaagaatttgggctgcagtcacctgtaatctgtacttttgtctttacctagctactggtctttgaaatatattaaaaaaattaaaaaaacaaaaatatcaaaaaatgggaaaatgtcaaaaaaaaggttatattttctttagctcttgtaaaatacatcgtcatgttttcttagatgtgtgcgtttcttttctttttattttttttattgtaggtgtgtaggtaactccgcctatgtcatcttaggtttatctgaatgacatagccggtcccaagcccggaaaaaggaggaggggataatcttgtatagatgttggttgaaatgacgctctcctactatatagtagatcattgggatttttccgtacttttatcagattaatttcattttcaatgatggaatagttatggagacacttctagagactcatccagtcttattttcaatgacggaatagtctactgctaccaggtctttgaaagttttcttgaaactgcacctttgtcaggctactgcattttttttgtgatggaataattatgaaaacactttcagaggcacatacactctgtttctctgttggacgaacctgagttggaaaccagtttagtttgagctcatttcaaccccttctttcaccagaagcaattgggctaaacccaagcaccaatcattctcctgtcagtccttaatgacaagcctgcaggacaaggaaatcaatgaagatcactgaggcaaaaatatatttatcctcccatcatgatagaaactgattgtgctttgtgaattgtgatcgagaggagaggaaatggtggataaccttcctagtcattcctttgtactgacaatgtttcagtacttgaggaaatctcagtgatgatacctcgtattgacaatcaatacctgtgttaatagatggatacaacacatctttgactgaaatttgcatcggcaatgattgtgtccaaggctctttctccaccagctgctgcttatgtgggatggaacccatgtataacttgaggaagagaagtaaatccaacttttgtttatttcattgaattcatcctttttccttttgaacactgaaaataacagcttgtatgtctttaggattggttcaggaaaatgttattatgacagtgcactagcttttcaccttgttatcccattacattgttaaattaaccatggttttattgccttcgtattttctggacggggatgcaaaccagtgtcttcttggatacttgcatcttcctaatgttccgtgtaagctgatttccttattttgcatagtgtaatgtgttctactagcaacgatagggtttgagatattcggttttgacatttcatttgatggcatttgatcattatgttcaaagatgctcactactgatgctgtagagctcactcccccaaatctgcaaccttctcatggactctgaaattagaatcgaggtttgtgttcattcatgtacacaattgagctattcagtttgaattttcatctgaatcattctgtgttcatctacaacggacaaattattcttatcgtgactgatcaacgcagcacaaagcaaagcacagctatagcgcatccagcgatgagaagaaaaagggggaggaaaacgaggggtcctgtacctcggttgtgctcgaggttctccggcgccggcgacgtgggactcggcggcgatttacctcgtcggagcgctcgctcgcttgccgtcgtcgcatcaacggcaatataaacatataatgtctccctgactcgtggggccacttgagggcaagaacgcaagaacgacgcgtgtctctcctgcttgagaactaaccggcagccgctcgccggagctccctccggaaaccccaaatctcggcgcccgtatccagaggcggttcgtgtcccgttggttcttgggctcctatcctcgttcagatcagggaggctgttcagttcttgtttatccagcggggcgcagcgaaatttacagaggaatctcaatctccaaactggtaggaagagagtttggtcgatagaagttgagctcttgtttgttcgttggtctgcagagttcactagttcagataatcatatcatcaacaccatgaattgaaagagatgctgcactgctgtttattgtgttcactgtttaattcatagcatccatcaaacctgtatctgtttgggagaatgttcgatcaatgctacagttggaatcaaattcaactcaggaccaaattcgtgttaggcaaatattcatgttcaatctgttaatacgtttaactgcagttctcaacatctcttgacgaggaagcagggctgctgctgcaattcggcctgcaattcaagtgcagcaatatgttgtgtgcaatttgtgcattagtgcacaagttgagaatggtaatattatttcactcggaagagatggaacagttgcgaaacgcagaaccactcggttcagaggagaatagtcctggacaaaaggacagaaaatggtccaatggtgagcattgatcatttttacagtgaatggtgagcaactgatcagcatcaaccatggtgaagctgaacctgataagtcgacagcactaggggtgatgatcctagccacccataaatcctttcttgtatgtttcctaacatatataagtcagcaagtcaaatgttcttatcgttttctttagtcgatggttcatcgattctgacatcaagacaagaagccaacatactgctagccatgttactttcctcttggctcacatacggccatttgaatggattagattcagaaataacactatatctcgtctttctttcttacttacatgagttgaaatattcttggcctttttttctctacttactagggcagaattaagattttgaagatgagctgcaccccaatccttaagagatactaggaggtactccctccgtttcatattataaaacgttctaacattgctcacattctagacacacacatatatatatatattgattcattaatatatatatatgaatatgggcaatactagaaagtcttataatatgaaacggaagaagtaccatattttctaatgtaaaatttggtatttctcgataccttcggtattaggaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccaattcaacttttgtccattttcagacggtattactcttgcatgatttaattggatatattgcttacgccaaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagagaactgcaggaaaaaatggaacaaatacgatgctttataagtgatgtggagcgaaggggcatggaagactcatcaatacacaattggatttctcgtctaaaagatgctatgtatgatgctgatgacattatcgatttggttagctttgaaggaagcaagctattaaatggccattcttgttcaccgagaaaaacaattgcatgtaatgggctttcacttctctcttgcttttccaacattcgggttcaccatgagattggtaataaaattagaagcctgaacagaaaactagaagaaatagcaaaggataaaatatttgtaacacttgagaatacacagtcatctcataaagattcaacatcagaattgagaaaaagttctcaaattgctgaatccaaccttgtggggaaagagatattacatgcttctagaaaattggtgagccaggttcttacacacaaggaaaagaagacttacaagcttgctattattggaacagggggaatcggaaagacaacacttgctcagaaagtattcaatgatgagaaattaaaacaaagcttcgacaaacatgcatggatctgtgtttctcaggactactccccagcctctgttttgggacaactacttagaaccatcgacgctcaatgcaaacaagaagaatcagttggcgagctacaaagcaagcttgaatcggctattaaagataagagttattttcttgtgttggatgatgtatggcagtctgatgtgtggaccaatctactacgaactccactgtatgctgcaacctcggaatagttttgataactactaggcaagatactgtcgctagagaaattggggttgaggaaccacatcatatcgaccaaatgtcaccggctgttggttgggagctactctggaagagcattaacattgaggacgagaaagaagtgcaaaatctgcgagacatagggattgagattgttcagaaatgtggtgggctacctcttgcaatcaaggttattgctagagttttggcaagcaaagataaagcagagaacgaatggaaaaagattttagctaattacgtttggtccatgtataaacttcctaaggaaataagaggtgctctatatctaagctacgatgatttaccacagcatttaaagcaatgttttctttattgtattgtatatcctgaagactggaccattcaccgtgattaccttatcaggttgtgggttgccgaaggctttgtagaagtgcacaaagatcaactactagaagatacagcagaagaatactactatgagctaataagtaggaatctcctccaaccggttgacacatcttttgatcagagcaaatgcaaaatgcatgatctcttaaggcaacttgcttgccatctatcaagagaagaatgttatattggagatccaacatcattggtggataataacatgtgtaaattgcgccgcattttagctatcaccgagaaagatatggtagtcatacctagcatgggtaaggaggagattaagttgagaacttttagaacccaaccaaatccactgggaattgagaaaacatttttcatgagattcacgtatcttcgtgttttggacttgactgacttacttgtggaagaaataccagattgtgttggatatttaattcatctacgtttacttgatcttagtggaaccaacatatcctgtcttccaaaatctattggtgctctaaaaaacctccagatgttacacttacagcggtgtgaatctttgtacagtttgcccagcatgatcactcggttatgcaatttaaggcggcttggtcttgatgattcaccaataaatcaggttccaagagggataggaagacttgaattcctcaatgatttagaaggatttcctgttggaggtggaagtgacaatactaaaatgcaagacggatggaacttgcaggagttagctcatctttcacagttacgccggcttgacttgaacaaattggaaagagcaactcctaggagcagtacagatgcattgttgctaactgacaaaaagcatcttaaaagtctacatctatgctgcactgaaccgactgatgaagcatgctcagaggaaggcattagcaatgtcgagatgatctttgagcagctaagtcctccacgcaatttagaagatcttatgattgtattattctttgggcgaaggttccccacctggcttagtacatcccttttatcttcactgacatatttgaaactcaaagattgcaaatcttgtgtgcatcttccaccaattggacagctaccaacttgaaataccttagaattgatggagcaagtgcaatcaccaagattggacccgaatttgttggctgctgggagggtaatctcatatccacagagacagttgctttccctaggcttgaattattggctatcaaggatatgcccaactgggaggagtggtcctttgtcaaagaagaagagttgcaggaggagaaagcagctgcagcagcccaggaagggggaaaggatggaactgctgcttcgaagcaaaagggggaggaagccccgtctccaactccaaggtcgtcgtggctgctgccttgtttgaagcagttgcaacttgtggagtgccccaagctgagggctctcccaccacagcttggacagcaggccaccaacttgaaggagctcgatataagaagagcaagatgcttgaagatggtggaacacctcccattcctctctggtatactttttgttcaaagttgtcaaggcctggagataatctccaaccttccccaagtgagagagctacttgtaaatcattgcccgaatttgaggcatgttgagatgttgggtggtttggagcagctatggctgtcaaagaatatgcagaagatctcttcactgtgggtcccagggcttgaggagcaacatcgccagctccatggagatgagcataagttggaggtcaacgagtggttttaagagccaattaattagatggcacaaggtatgtacactaattggttgggatttttcactggaataaactaatcattgggttgtacatccatgcttcttctctgctcttcagctgtatgcaactactctagcatttgatagtctccttagttgttcatgttgtgtgaattgtgattgtttaataatttatatgatttagttcttttttcattgagtttttctcccggccttccttttgtagcacgcggtactggtactgtgaggtaccagtctccatccggccgttgattgctgaggggtacgatgggtatcacgtgtggtccaaatagcgtgtgtgtctcgatatctctcgctttcccttctccttctgcatctagcgctgccgcagggcacatgagaaaaaagtcgaggtgaaggtcgaccccatcggccgcaccgccgcaggcagacgcagcaagggcgatggcatccgcaatcgtcccagaatcgtggccgctgcagttgtcctcgccagcgccacaggagttgtcgctgccgcaggtgtcatcgctgcagccgtaggtgtcatcatcgcggtcacaggagtcgtctcggcgccgctgcaagggccgtggctgcagtggatctccaggaccccatccgcagcatggtcgcaggagtcgcagcgttgagaggaatggatgaggcgccgccgcgaaggggaaaacgatgggacaaggggaagacgccagcatcgagaccaacgaatgccgccgccgccgccgtcgtattgtccgccacgcgccgccgtcgggaggaagcctagggttttgctactctgcggcacttccccaaacaaaccaccgatccaaacatccttccaaacgcgaaaatacgattatacccttccactatggctcactcgtgcttgctaccccacgatcaagctggtaccctgaggtaccatgtaatcgtgaccattcgatatgccatcattaatggatgggattttagtaccttgcggtacaaaaagaatgaccggagcaatgctctttttcattagtgctgcatgtaaccatttcaccgtggtcaagattttcataaaatggtagatatagatcaacaaattaattagttgaccatatcttttatccactcatggtcttattaacatcctgtatggtatgttaaataagtgtatcgtcctataggtactacaacatgatcatatgcagtagtgtacaaagatttgaagacagagatagagactactgctactccaaaacaaaactgtatgggttatatcgccaaaaacatgctatgatggcattgctattcactatatgtcaataggaatatcatagatggatatatccatccaatgatttgtcccaacataaatggtttagcatttggttcataggctgcaaaagtgagggactaaacatattgggcttcgttaggccaagagataagtaacccttaatttgactcttgaatgtaccagctatgatgcagaccagcttacatgcatttagccttcaatttcacaagtgtgttctatatcagatcatgcatgtgtgcaaaagatagcatttactatcttgtaaaaacacatatacacatgaatttttgcaagacattagacctatagaataatttttttttacgacaaaaaataggttaggcccaatgttacagattccttgcgacctgttagcaggatattaaacatgaaagggttgtgcccaacatctgtttctactgtagggctcctaattaaggtttgtttagtgccaaaagtatccacctaaatgtctttgcattggttcaaattgattaatattttttttcatattctatcagttaaaataagcggaggatattaccgacatgcctatctgtatatgtgtcttttccttatactttttgtaatgcatgcctgatgtttggtaagttaattccacgaaatatgattgttgcgaaactgatagcacttatatttatttccttaattaagttattaaaactgatgtctgatgtataaagtatatatacatccgtgattaatttttgtgtgcttatttgttttgtaggttgttaatcttgaagagttggagtgcagtcattcctcagagaataaaatgaaaaaaaaatcacaaaacatgaaaatttaaaacaaaaaaaaaacaaaagcatcaaaaaaaggggaaatgtcaaaaattgaaaaaaaaagcattttctttagctattgtaaaatacatcttcatataatttgttatatttgcttgcgtttgttttcttttaaaactttttttattgtaggtgtgtaggtaactccgcctatgtcatcttaaggcgtaactaaatgacatagccggtcccaagcccggaaaaaggaggaggggatataatcttgtatacttctatattgaaatgatgctctgctgctaaatacatcatttgatattttcttggaagtttctgcacttttatcaagctaatttcatcttcagtaatggatcagaatagttatggagagtcatccactctgtttaattgttcaacaaatctgattctagactattttagtttgacctcattacagtccagttttccagtaaaagcaatttggatgaacacatgcatcagttcattctcctctgtcggtctgtcctacatccttcagttatcagtgccagatcaatgatcacaagagttgatattttggagaccacaaatgcacaagtctgtttgttggaggctttagtatttttcatgatcaaaactggtgcagaaaacatctgttatcacatatcacgctatttaggttcagaacataattatgaagcacatgatcaacaaataaaaatgatgaatttaaattcatgaaaaatggaattggcaaaaaccagaaaaacagagaggcgtgcttgatgtcctgacaagaatgatttccagcgatggtcagtaattactgaagtacattgctctagtgaatctttacataatcacttcacctccatgcaagtttcttgactggaaaaaggtaaacatggaacagaataacaaactgcacctggagggggctactttatttttatttttttttgaaagataccttaaagcggatactgaactggactgaaattgccactgaatgttcgatcacattaagcctggcaggaaagcggagttctcaacaaacagagttggacaggaaatggtccagcagcaatgcaaacaagcaatgctgatccgggtaggaatgggcgagttcaagtcgttgtgtcacgcagggttcttcttccccgaggcgaagatcaagggacactggaagtggagcaagacgattaaggtcgtcgaaagcgagacgctcggcagcgctacctatggtaagaataggaagatcttacaatcgaattcagggcgttcaggtaaacactagacaaatcccaatcgccaaatccacagcatcctaaacgaaaatcaacagtgtttctcacagcaatgatctgaacgaaattcatcttcacatgcatatatatcacccatggccagcacccccacacatacatatcttattcaacaaaattacaagcagttccctgataaagttgcatattacaccaacaggttctgcaacttccatgcagctcattatcagaacatcaaacttctattgagcaggaatgaatgaatggatcaatgggtagatggtaggagtaccatactgactgtgtgtattgttaggaaaccgccggcccatgaaggcccggctcggttacccactaattaggcccatcactaaatatggaaggtggaagagggaatggctataaatagaggagtagagaggaggattgtacacttgagaatgcaatggatgaatgagaaaggatgccacaccctcatatcttgtgtctccacttttgtagaattacgcaatccctcttggactatctcggtacatttagtctccctgatggttacagcccaccttaactgaattttacatcagcaatgattgtgtgcaaggccctctttcctccaccagatgatgctttatgaccacaaaatccatgtatatcttgatgaacagaaaagaaaatcattccttccattatccaacatcgttttttattgagtccatccttttccatttaaacgctgaacagaacagcttgttactctgtcatcaggattggttcaggaatcaggagagatattatgacaaataccctagcttttccccttgttgtcccgtcatattgttgaattaactgtagttttgatgggatgctaaaaagtgccccttttggatacttcaaccttcctaatattccatgtaagctgttttcctaatttttcgcattgtaatctgctctactagcaatggcttatgtgctacatctcctgtacaggattcagaactcgagttcttgccacaaaatggttactgtacacacaaatctggctaaaattgtaaatggaaaatttcaaatgccaactgcaattaacagcagattgagttgcaattaactctcctatgctttagagttcacccccaaatcatcaaccctcttatatggactctgaaatcagaatcgagttttgtgttcagttattgcagttcagtgctctagtttcatctcaactgttccgagtaattaacaactggactagaaattattcttcccctgtactgaaactcactcactgactcatcgaagcgctcatacactctttgatgggccatacactttgggcctcgttttgctcctgccctgtgcagctgtgctgacgggccgcatgtccccgtagtatggaaaaagtacaccgaaggtccctcaacttgtcatcgagttacaaaattgtcccccacgtcccttaactaatcaaaaccggtcacaataggtcctttggtgtttttgactccggttttatcctatgtggcaactgactcagcatgggacccacgtgggtcccacatgtcagcatcttattccttcctctctctactgccctttccaatcccccttccacgggcgacgggcgtgcgcgggacggagaggcggggcgcgggcggctgggcacggcgtggccggcggccgaccggaaagaactgagcggcggcggcgggggaggagctaggcgcgagggcggtcgcggtggagccggtgccatcctcgcctcgcctcccgcacgcgcgcgtgtgcgtgcgcctcgccacaccnccgccgcctaccgcgcgctcgcagccgccactgccgagcaaggcgaaggcgccatggcggcgctcacgcaggcactcccgtccgtggcacccgtgccgccgccgtcgtgatctctctcctcatcgtcatctagttccaaggaaggatttggtctgtgtctgtacatgactttttttttgttttgctcgggtagcttggccattgttagtgaattgatggtgaaaataaaaaagagtttattgggtaggtctggtgttgccgccaacgccgtcccgcgaccaggcagcggcagcaatcggagacgaccacgctgcggcgacaaaacagaggggaacacgcagcggggaacggaggggaacatgtcgatctggccgatgtcaaggttggtgggtaccagcgtggggttcacccgctcgacggcctggtactgcatcaggctctgcagcttggtggtggagacaatccagaaggtgtcgccggcgttgatctggtactgcataggcgcgtatgcattgggcgagtgggaggggcacccacactggagcggcacaagcagcggctgccccgccgctcgcgcgcaacccctccccccaccgaccgcgtgacgcccctcccccgtcgccgcttcgtgggtctcgtcccctccctcccccacgcacccgtccgtctcgcgcgacgccatcaccgctgacgccctcctcctctcccgcctcgcagaacgcagagcagagaagtgagagagagagagagagatgaggaagggagagaagaggggaaaagagagagaaggctgacgtggccacactgacatgtgggatccacgcgggtcctacgctaactcagccgccatgtcggacaaaaccagggtcaaaaccaccgaaggatgtaaagtgaacggttttgttagttgagggatgcccgctatttggttttgtggttggaggatgattttgtatctcgatgacaaattgagggacctttggtgtactttttcccccatagtatcgtccaggcccacaaattaaatggaatcccttgctggaccatataacatgggcctacgtcgcttccggcgtacgcccattaatcggcccgaccgcaagagcgatagtctcctggatgagagaatccgccgccatggcagccgctcgccggagctccgccgactggccacggagctcctctccggcgaagatttgcatcacgtaggttcttcgagtcttccctttccataatgtgctttggctctttcatcttcttctctctgtctcacagatcagacaagttgcgcatgataccaaattagagatgctgtactgctgagtaaacttcagatactattgtgttaccaaaaattatcccgggaaagcaacacctgaattcttttgatatcaacacatatctgtttgggacaatgttagatcagtgctcctgttgatgtcacaatccaattggatgctttctaggagtaaaatgctttctaggagtaaatgttctgtgcaatattgagttcaacacttcaatcaaaccagatggtttcagatcagaggtattctaaggcatagttatcaacaacacaaacttgcagaaggactatcaaactggaggaaataaattttggtcaaatagaaagaagtcatgaaaacaagtactcatctaagcaattactccagtaattatgtataatattctatgagaaatagttacaatggcacagactccaagagtttttgaagacttcgtgatatgttcatcagccataaattctagaattagaatgcgacatgactagcaagatccaaattctccaagaatgctctgtccttgtctctattgcccggctccttcacactgcagatgcaaagcagagtgaactgattggggtctggatggtcgggtgtgatcccattctctagactctttgagataacaaagatttgctctttgtcacctttaatctccttcttgagaagtactagaagcatctcagttgcctgcagcttagtagggttcaacgtggagaggaagatctgcaagaaccagataggcatcagccatgagtaccatgaagttttgccgtgaatggtaagctgattagaatcttatatagtcatatatatttacctttcttagttttctatgtaataagtgataatagaagaattttgttgttgctgagtgtgagtgcagtaacaacatcaggttcttagaaagccctcatccaacttcacatattctactccgtattatttatagacatttagaaggggctaatctctaaaattctgtaagactttgaggtgacaaacttcatgagctgacctagaattgaaccgattacttctgcacttcactaatgtaccacaagtgttacagtacagtcaagagaaaactcaaccttcagactttcggttccaactgtgtttttgcctttttctgtaaaaggaacaacatcattatgaaccattgtgtcatacataccacaaacgtacagtatctagattttatcatgagagtgcccgtaatatgttgattcttgttcattcttgagctagaaaatactaacagctttggatggcaatctctgcattgcttgactgaacttttgcaagctcctgaatcacaggaggtagctgacagatactgtgtgtaccgcaacatggtgcaccacatcgccggggagttcaccacattgcttgacctggaaggatgtcttcttccaggtcaggattatcggtcagagacaaaccaccagtttcttcatagttcagaattacatagaaactactaaactctgaaaggtgaaagctttaaaagctttaaaccacagcgaggggtgaggaaggcatgacgcttatcttcgtgtgctgcaaccccagctgcggtcacagatggagggagtacgtggcatgcaaaggcagtagagatttgcgttatgccatgaattggtctatgtttactttgtcaacaagagtatgagatgccatgatcctatgacagaggaaacaaaactgaagcatgtgtggccttccttctctatctgtttttttttctaattcaagggcgcagctagttgactagttccacatcatggaatcttgaagccaacagtaaagtaatcacatagaagtaaactgtagatcaatcacatggaaataaactgtgaactaatcacatcgactagacaagtggacaagcacaaaacgttgggttgtggagcatagacaagtggacaataactcaaaattgggtcagcggtattaacgtgggaaagataaaagaaaagagtggttcagcacttgtctagtctgaatgttcagctagctatgcaatatatatatgcaaggtcttaccactccctcctgcagtactgttgctttgttccactgttgtgtgtgtggcattcttgtactgcatttctaccagctgtgggtaagctcaagacatatagctgaatttacttcctttgtttccttaagataatctgtaaatgctcgttttgattgcaggcacggtgtttcatcaggatcagtcgtgtctatttctgtctgccctgtgatcgcttgagacgaggtctgctaggaaggaaaatctgcttcatctgaataaacacatatatactgatatctccttgtagcagacactctcccgtcggtggatgtcaacacattcacctgtatttttggtattatcccattgatccttctagttaaccttctgaatcattcaagttttacatcggtataatgagcatacacttcacctcttattttcatctcccctttttgcagttgtagcagcacaatcagtggttctctcttgatgactggctcataatgttctgaaatcctttctacagttggcgtatccactgagtttcttttgatcttcactaatctgagtctgtcgagtatctaaagtagatgggtcagagcaaacttctagcttgtgcaagatgaatgctactatactattgatccttgttatgtgacttatgtcttttcatgctgaattatcactccataaggtaagatttgcatgcaatatacttgagtaaaacccctcaacttgtttccggttacttctttctcctcatttacctttaacccaagaagcttacccgaaatgtaaccccattattccagttctttagcttcagtatgctaacttgctcaaaactcatggcaaaacaacttattaaaaaccttaccgaaatgtaaccccattattctagatactctgaaactgattgaacttttgtccattttcagatcgtgtaattctcataagtaatttacttagaaattttggtgcatcaccatcaacgagtttctctatggcaaccatattgggttctttgattggatcatgcgtaaacaagttgcaaggcatcattacagaggaggcaatactaattttaggtgtagaagaagaactcaaaaaactgcagaaaagaatgaaacaaatacagtgctttctcagtgatgctgagcgaaggggaatggaagactcagcagtacacaattgggtttcttggctaaaagatgctatgtatgatgctgatgacattatcgatttggctagttttgaaggaagcaagctattaaatggccattcttcttcaccaagaaaaacaactgcatgcggtgggctttcacctctctcttgcttttccaatattcaggttcgccatgagattggtgataaaattagaagtctgaaccggaaattagcggaaatagaaaaggataaaatatttgcaacacttaagaatgcacaaccagctgataaaggttcaacatcagaactgagaaaaacatctcacattgttgaacccaaccttgtggggaaagagatattaaaagtttctagaaatttggtgtgccacgtgcttgcacacaaggaaaagaaggcttacaagcttgctattgttggaacagggggaatcggaaagacaacacttgctcagaaattattcaatgatcagaaattaaaaggaagcttcaacaaacatgcttggatttgtgtttctcaggactactccccgtcctctgttttgagacaactacttagaaccatggaggttcagcacagacaggaagaatcagttggcgagctccaaagcaagcttgaattggctattaaagataagagttattttcttgtgttggacgatgtatggcagcatgatgtatggaccaatctactacgaactccactgcatgctgcaacctcaggaataattttgataactactcggcaagatattgtcgctagggaaattggggttgagaaacagcatcgtgttgaccaaatgtcaccagctgatggttgggagctactctggaagagcattagcattcaggatgaaaaagaagtgcaaaatctgcgagacatagggatcaagattattcagaaatgtggtggtctacctcttgcaatcaaggttattgctagagttttggcaagcaaagataaaacagagaacgaatggaaaaggattttagataaaaatgtttggtccatggctaaacttcctaaagaaataagaggtgctctatatctaagctatgatgatttaccacaacatttaaagcaatgttttctttattgtattgtatttcctgaagactggaccattcatcgtgattaccttattaggatgtgggttgccgaaggctttgtagaagtgcacaaagatcaattacttgaagatacagcagaagaatactactatgagctaataagtaggaatctcctccaaccagttaacacatcttttgataagagccaatgcaaaatgcatgatctcttaaggcaacttgcttgttatatatcaagagaagaatgctatattggagatccaacatcatgtgtggataataacatgtgtaaactgcgacgcattttagttatcaccgagaaagatatggttgtcatacctagcatgggtaaggaggagattaagttgagaacttttagaacccaacaacatccagttggaattgagaacacaatttttatgagatttatgtatcttcgtgttttggatttatctgacttacttgtggaaaaaataccagattgtattggacatttaattcatctacatttacttgatcttgatagaacctgcatatcttgtcttccagagtctattggtgctctaaaaaatctccaaatgttacacttgcataggtgtaaatctttgcacagtttgcctactgcaatcactcagttatataatttaagacggcttgatatagttgagacaccaataaatcaggtcccaaaagggataggaagactaaaatttctcaatgatttagaaggattccctgtcagtggtggaagtgacaatgctaaaatgcaagatggatggaatttggaagagttggctgatctttcaaagttgagacggcttattatgataaacttggaaagaggtactcctcacagtggtgtagacccatttctgctaacagagaaaaagtatctcaaagttctgaatctatggtgcactgaacagacagatgaagcatattcagaggaaaatgctagcaacgttgagaacatcttcgagatgctaacacctccacacaacttacgagatcttgttattgggtatttctttggttgtagattccccacctggcttggtactacccatttgccttcagtgaaatccatgatcctcgcaaattgcaaatcctgtgtgcaccttccaccaatcggacagctaccaaacttgaactacttgaaaattattggagcaagtgcaatcaccaagattggacccgaattcgttggctgcagggaaggtaatctcatatccacagaggcagttgctttccccaagctcgaaatgttgatcatcaaggatatgcccaactgggaggagtggtcctttgttgaacaagaagaagaagaggtgcaggaggaggaagcagttgcagcagccaaggaagggggagaggatggaactgttgcttcgaagcaaaaggggaaagtagccctgtctccaaggtcatcgtggctgatgccttgtttgaggaggttggatctttgggactgccccaagctgagggctctcccaccacagcttggacagaccaacttgaaggagctccttataagatacacaagttgattgaagacggtggaggacctcccgttcctctctggtttacttttagttgaaagatgtgaagacctagagaggatctccaaccttccccaagtgagagagttgtttttaaattgttgcccgaatttgaggcatgttgaggagttgggcggtttggagcagctatggctggatgaaggtatgcacgagatctctcagcagtgggtccctgggcttcaggagctacactgcaagctccatggagatgagcatgagctggtggtcaacgagtagctctaagacccaattaatttagatggtgcaaggtatgtacactaattgcttgggatttttcactggaatatactaatctttgggttgtacattcatgctgctcctctgctcttcagctgtatgcatctattctagcatttgatagtctccttagttgttcatgttgtgtgcattgactgattgtttaatcacttatatgatttagtatttatttcattactgctgcacgtaaccatttcaccgtggtcaagattttcataaaatggtggatatacatcgacaaatttgttagttgtccatatcttttatcctctcatgatcttattaacatgcatcctgcacatacggtgtattctagataaatgtattgtcctatatgtactacaacataatcatgtgcagtagtgttcctagctctgcagacatagatagagattactgctactccaaaagaaaattgtatgggttatatcaccaaacaatgctatgatggcattgctatattcactatatgccagtagtaatatcacatatgcatatatccattcaaggatttggggacaacataaaggcaaaatttgccactggacacgcaaaaaaacgtgtaattggctgagagacaccgcgaaaacgtgacatggctgatggacactacaaaaaatgtgtaattggctgtaggacactcgtcgcattattttattatttccgggtcaaaacaggtgagatatttttctaaatgcccggattgccccttctctttccttctttaaacaccggtgggtcccatgtgtcatggacagtgtatgtttaatctaatttataataggtttttaaccacctggccccacgcgtcatggactaatttttgtaacaccctgaaaatttgaccaacaaaaatcaaagttccaaaaatatggaccttcaaaaactttttaaataaattgcatcatgctgattttgttcacctatttcatcggattttaatttcggagttcatagatcacgaataaagaatagttaattaggaataaaccctaaaattagattggcaagagaaataattaagatataatttaaaataaagattatgtgaggatagaaataaataaaacattatcacgaccatatttatatcaattaaatttaaatgtgatggaataagaattaactctaattaaattccaataaattatatataaaaataaaatatgggtaatgataatctaggttagagcaacacaaatattgtgtaaacttgatttgtgcaaaaattataaatattgggacaagatttgaataggaaaaacaaccaaataggaaaaacagaaaaaaattcactattcattgcgctgtaagtgttcgatcgcgttccctagccctaacccctcctctgccgcacgcgcctggccgccatcacgtcgccgctgtcgcccgtcgcgtcgtcgccttgcgccccgtgccgccgcgcgccgtcgccgtcgctgccgcgccgccttgcgccccgtgccgccgcgtgcgccgtcgccgtcgccgttccgtcgccgcgcgtgcgtctcatcgcctcgcgcctcgcgccgccgtcgccgctgtcgcccgtcccgtcgccgcgccgtcgtcctgtcgccgtcgcgtcgccgcctcgtgccccgcgcccgcgcgccgcccgcccgtcgcgtcgccgcctcgcgccccgcgctgctgccgcgccgcatcgtcgtcgcatcgccgtcgtcgtcgcaccgagccccgtgtcacgccgcgctgcccgcccgtcgccatcgccgcctgccgcgccgcgcgccgcctgtcacgtcgccataaggctgcccgccccgctccacgccctataaagcccgacccctcctcttctccaccccacacacatccccttcatctttcctcctctccctctcccccttccccacgcgccgccgtcgtcgtgccgccgcgccgccgccttcgagccgccgcgctgcgccgcgacttgcgccgccgtcgccatcgtcgccgccgctgcccccccacctcgcgtccaccgccgccgccgcccgggtgggcaaggagccgagagagagagagggagaaaggagccgggagggagagaagagagtaaaaaaaaagaaagaaaagaaaagagaaaagaaagaaaaggaaaaagggaaaagaaaaagaaagaaaaagaaagaaagaggaagaaaataaataggcatttgagtaaaatttagaggtttagaaaatttaaaataattagaatttaatcgtggattaattatagtcgtaaaattgcgaaatttaattatattttggtagcctctatgagtaatcaatttgcggtaggaatttagatttatttaagaactaaaataaaggtgttgaattcttaggaaaattacttaggagacacaaaatgtcttaggttgaggaatagttctatttcgcgaataatatagtggatataacaatcgactctcgtgctcgctttttgatttggtctttattggattttatttgaattcggaattcaaatcaattcttcgcacgtacttgtagagcccgagggagttgcggatccgagcgaaggtcaagacccgcaagactttgagcaaggcaagtcatcactattctttgagcatattgatcccgattgcaaaatttattttgtttacaaataagattggatgtgatgatgaacattccacttgtgaactatgccatgccttgattattgttcatctttaaatctttgtaaccataaatacgtatgagtccctagtcaactatgacacttgcttagaaatgctactctagatttatgcatgctcatactttattaaatgctatatgcttgggcaattacctttgggaagttaattgagatgcggcatgtggagacatgagcgccacattgccatgatatgatgacatgaattatgaaaataggaatgaaattaaacacttgttttagactggggcggacggtaatattgggtgatatctgggaaaggctagtaccgtccccggtcaattaaggaccgagccatgaagttaagcatgaaacgaccctgtacaaccacacttctcgtatggggatagacctagcggagtaaatagctgagcggaggcagtatccttgcatagtggtttcttgatgtttgaggatggggctctacagtggtaccgccattggtaggactgccatatgataatttagacataattataacttaatgcatgtgcgtgagtcttcccttcccgggtgcgccagaactcctctcgctgctagaaactgtgtacgcctagagtgcatgaggatgaaaagttcatagagcggatactgccgatgccaggttatcgaaaagctttgccgtgacacgtctcatgtgttgggacgaggctcatgtgttgggcagtcgcggagtgcgggtaaagtgtacatccactgtagtgtgagtaaaacaaatctattcgaatagccgtgctcgcagttattgagcaccgggacatgtattacacttagctagactctaaattcttaacttgtgtggaatgggatattgcatgatgatttttatgctgttggagccacttcctgagaggagggaaggtggacatcctcagaaaaccatgacaactcaatggcgggaagctatccttgggatcacaatggatggtggacagcaccatcgttgtttaaatatgaacactggtactaaaatttgctcagtcaatgctaggtcttaggcttgtgaaaagaattacaaaacttgctttgcgcaaaagaaccatagccatcctttgaaatacccctatcatgtgcattgttgatgtgatggcttgctgagtacggttggtactcacccttgcaaatataaacttaatcagaggccggagatgaagcttcggaggatccctgtgcctattaccaggagggtgatgaagacgatggtgctcaataggtcttagttacggtcgttgcctgtggcaatggcgtgccgctgccttaactctgctgccttatctacctctgtttttgggatgtactccggaccgctcggttcgatgatttaagactatgcctgcgggcttatgatgtaataatttgcactagactctcgtgtatgtgcatatggtatttcagctataaactcgtgtgtaccagactacttgatccagggaaatggtactgtttacacgattgattcctgttataaaaacgggggtccacaatttttttctaattagtagggtgattgctatttgctaatcataagtggggcccatatctctctcctatccttcttcttcttcctcacgcacgcgccagagtagaggaacggcgcgcggccggcgcgacgacctgagccaggacggctcggcgtgcagcagaaaaagcggcggcgctccgccatggtctcaccgccggagctcgtcccttacttgaccagagacgggacaaagacgggacggagaagcgcgggtgggtcaggatggccgtcgatgccttggctgccgtcttgtccgcggatggggtaaacgaagataccaaggaaggtctcatcgatgccctcatagccggcgatctgggccccatcatgaacacgctcatcgcagctgttcccagatctggtatgggtcctcaaggacgccggcaatctgctgcatggcggcaaccgtgcaggtgcgaggctgcccagctcgctcgtagatggtccggccaggcgccatcccgacgctcgcgcgagttcaccgtgggagacgactagaggatgagagaggcagtggcatccgcgccggaggccgtgggaaagttgctcgtgtgatgcaaggacgacgacactgtacatgggcccacatgtcggctgcatcgagaagagaggggcattcctgtcattttgaaaattttcttccctctttcggcatggaaattataaaataatgtcttcggtgtcctacaaccaattacacaacttttgtagtgtccatcggcaatgccaagttttacagtgtcccttagccaattactcgatttttgagtgtcctgtagcaaattttgcccaacataaatggtttagcatttggtatacaggctacataagtgcacgaccaaacataatggacttcgttagaccaagagataagtactccttaattcagctcttgaatgtgctagctatgattggctgtgtacatccttcgggatgcagaggccgggttttatttaatccattatgtaaaaatgtgctatctatgatgaagaccagctcacgcgcatttagccttcaagtctgcaagtgtgttcttgtcatatcaatgtgcacatttagcattcactatcttataaaaacacaaatacacatgaattttcgcaagacattaggcctatagagtagttttttagatttgacaaaaaataggtcaggcccaatgttacagattcagagattccttgcagcctgtgagcaggatattgaagatggaagggttgtgcccaacatctgttcctagtgtagggctcctaattaagttttgtttggtgaaaaacaaaagccacctaaatgtctttgtatgtgtcttttccttatactttttgtaatgcacgtctgatgtttggtaagttcaattgcagaaaatagattgttgcaaaacgaacgtcacttgtattttcttttccttaattaagttatttaattaccaaattgcttatgtatatacatccatgattaattttttttttgcggggaacatccatgattaatttgtgtgcgcttatttgtgttgtaggttaatcttgaaggatttggccgggctgcggtcacctgtaatctgtatttttatctttacctagctactggtctttgaaatattaaaaaaataaaaaaacatgaaaattaaaaaatatatatcaaaaaatgggaaaatgtaaaaaaaaggttatattttctttaactcttgtaaaatacattgtcatgttttcttagatgtgtgtgtttcttttctttttaattgttttattgtaggagtgtatgtaactccgcctatgtcatcttaagtttatctaaatgatatagccggtcccaagcccggaaaaaggaggagggtataatcttgtatagatgttggttgaaatgatgctctcctgctacatagtggatcattgggatttttttgtacttttatcatattattttcattttcaatgatggaatagttatggagacacttctgtagactcatccagtcttattgctctgttggacacatctgattctaaactaagcttgaccagaccaccagatctgagagttacgttgcaaattgagatagacaagtaggtaaaggaaattcagtgccaggcatgacaagaggcagggcaccccagataaggtgtgcaacgagacattcgagtctctgagctcatatatgcccaaagtcctgaacaactcgatacaattttgctacaagatcaaatcataacggctagatcaaggtaagttctatttttatgtcggtttggccgatctagctaatgaattgacaaaatataagtacagttacatacccactaatcaataaagacatccccatgctaaaacaagtatgaaagaaatgtgcatatccctcagtatctaaaagaaaatagttttaagttttagcctataagtttatcccacaaagattatttttacagtgaggttcactagatctctttaatactactttatatttttctccctccttctcttttttttctcctcattaatagaatacaatgttcttttagcctcctacttaatctatctttgatagctaaaactacattgttttagaaacggagggagtatgtgagtgacaggttacaacttacaacaatcattgtctgatgtgtcacttgcttcggttcacaataggctgtgaactttatgtgttgcttcggtttgttgttcccctattgttttgttgctagctgctatgcttgtcatcagttcctgtgatgaacgtggcggtctgaaactctgtaagcctgcaggtctcactctctgtctctcctcattcctgagtcctgacagcctgtggcccatttctgcatttagtcctaattaatgaatttacctagccagttgacaccatcaggagggaaaaatactgaagactctgtgaaccctgcaatctagtagtttacatgtttattcaaatgagcaaatattcaactccctcatggactctgaaataagaattgagttttgcattcatttcttgtgctcttcagttattcagttcagttctatatagtgtcaggactatcatctgaactgtttcgggttcatgaacaataactgttaagtccatctaataagttcagttattcttcccctgaatgactaatgcagcaaagcaaagcaatgctgaatcgcatccagtttatcttaatttgggttcctgtgcacacaatttgggtgaacttgtaaagttcaaatgccaaatgtgattagaagcacatttagttagttgctgatggaggtgtatagggcttttgtatgtatggattgtggtaaggcttgtcagaagttgtaattcctacctccagtttcagatacatggcagaatttcacctgatggcatttgatcgttatgttcagagatgctcagttgctcactactgatgctgtagagctcactcccccaaatttgcaaccctctcatgaactctgaaattagaatcgaggtttgtgttcattcctgtacacacttgagctattcagttccaattttcatctgaatcgttctgtgttcatctacaaagcaaagcacatctagagcgcatccagcgatgagaagagaaaaggggaggaaaacgagaggttcgccccaagatccggccgagcctcgtcgaacagcttcgcgctccgccacctatctccggcgccgacgacgtggggctcggcggggatttacctcgtcagagagctcgttcgcttgccgtcgtcgcatcaacggcaatgcaaacatataatgtctccctgactcgtggggcccacttgagggcaagaacgcaacaatgacgcgtgtctctcctgcttgagaactaaccagcagccgctcgccggagctcctgccggaaaccccaaatctcggcgcccgtatccggaggcggttcgtgtcccgttggttcttggagacttggactcctatcctcgttcagatcaggggcgctgttcagttcttgtttatccagcagggcgcaccgaaatttgcagaggaatctcaatctccaaactggtaggaagagattttggtcgatagaagtagagttcttgtttgttctttggtctgtagagttcactagttcagataatcatgtcatcaacaccatgaattgaaagagatgctgtactgctgtttattgtgtttactgtttaattcgtagtatccatcaaacctgtatctgtttgggagaatgttcgatcaaattcaactcatgaccaaattcgtgttaggcaaatattcacattcaatctgttacttcctccgttttacaatgtaagtcattatagtatttttcatattcatattagttttaatgaatctagatagatatatatgtctagattcattaacatcaactaggaaggaagcccgcgcatatgcgcgggcaatttatttattgtctataaaaagaatattaaaagaagccctatcacactatattcactgtaagaaatagatcatagattttgatagtactaaatgataagaatgtgtatcatatccaaacaaaaaatcactttgttccggttatatgtaaattcgcctatcacccctacttattattattgtcttggaaatatgagtatctttttaatagatagaattgtagttatacctaaaagtaaacccaatacaccattaatgccagaaaaagttaaatctccacatcatacccaagtgcctatgtctcacatgtgtccaaatctatatataaatatttaaaagtactgcttctaccaattaataggataaaaccgtttaacttatataagaatgcctctctaacgatcgggtgaagccgactatagccgttaaggtttttctttaatgccttaattcatggtctcgtattgatatagtcgtgctcctcaagtaggccagttaagctctattttcaatggtaacctgtaaaatcggaccacctcaaccgaataatgcatactcctgcatagtttactacaacgtagccaattgagattcatgcttggcaccctttagggaatgagtgaaaaaagatggaggtaatgaaaaaaaaggtttttttgtgtcttgagttgatttaatgtatagagtagacataatgtgtttatgatgttaatcaatggtactaaattttagtagtaaagacatattgtttaaaaaagattagtatggatcattcgactatctaatatcttcagtggcgaggatcacataaaaaatatatgctctcacgatgatcatttgctaacatatggttttgatattttttttacttgtattatacatctaattcacctatgcatgtaagtagggtttaatatgcgttggaatttgtgctaatttgttaacactatttggatgagaccaacaaaaaatagatataatgtagttacgtgtatgttttttttttggggggggggggacagtagtctctcgtacatacgtttgtttttcttttttttggacaaaattttttctaatgtagggatagggtgtacgcatgtgtactcccagtgtgcttctgcacatatttatatgagttcatatgattgtcttttaaattattagtaaaaagaatactttcgagaaaatcaatgggaagagagtggagcaaagggtggcgtaaggcagttgcatatggcatggcttgttttaccacctcagtaggagtagttgctacatttatataccctcaatttgggaaaatcttagagctggaaagaaagagaaaactaccagatgggacggataatatacacactcttttttttctttttatatctcttatctacatacttacgtaggagttgtgtacgtacgtatgcacagaactatacggtttttagcacatagggattagtttagtatatctaatttaatggttgaaaataatggatcattgatttaattgtaaactgatggataaatattttacttttttatataattncccccccccncccccccccccccccccnnnctaagtggcattttaggagtatttgtagaagtgtaggaatagtattaatnataggtgnaangcccccccccnnttgtagtccactattgtttgtagtatattgtttttatattctatttacctataatttgttgatggttgcgcacttagtatcaccctttatcttcggtgttggatgacacacgtgctcattagatatcagctatcgtttggtgcattgtgcatggatatctcgtaagtaatattatttagcgatttgtggacaatggcttgtatatagaattatatatggagataagtgaggacatatgttcgatattttaggttatgattaaccaagaatattgtatactacatatgtttagtaccctaagtaacaaatttaagattgtgttctaaagtgcttatcagattggctactctcttatttatattgaacatgtttcccgaaattgctaaacatgtttcctgaaattgctaaacaatatattatatggtgcatgttttgcaaatactttttatataaaagtttttttttagaaagatcaactaaatttatttttgctttttaatatttaatacaaaattaaacatgtgctaatgacttgcattattccaagtgcctacataaactcacccaataagcttgatctaacgaagtttaaagtaggagataaaggacaacgacacgatgtaaaaataatatatttgatatttaatttctaataatatataaataaagaaaaaacagtacataataaatttactaacctcattttaatatattagttttttttacagtatggaatgagtaatttttgagggtgctatttataactgggttttttcattttcaaaacgcaggtctaatagtgtacttcctccgtataaccttgtaagactttctagcattgctcacattcatttagatgttaatgaatctagacatatatgtgtttagatttattaacatctatatgtatataggcaatgctagaaagttttacattgtgaagcggagagggtacatgttatgtttttttctttttccgggggtacgtacgtgtgtgtgtttttttctatatagtattcgtatgtgactgggtacgtacatattttctttttgtcaaatagtgtacgtgttatggtttttttttcttctccgccggcatgagaagtgaaagaaaagcgtacacacacaaaggggaaacggaggtcagatggatacgtggatagtacgtacgctacggagggatcatacttgcgttggacggatggatcgagattttgatttccttttaagataaatctaacgatcaaaattaatgggtccatcaatttaaaggaaaatcgacggtcagatttctctattttaatagagtgacatgtggcgactcgagagcgtttataggatgccacatgtcgatttaggagcgtttgtagaaagtttaatggacttaaatctaacgatcaaaattaatgggtccatcaatttaaaggaaaatcgacggtcagatttctctattttaatagagtgacatgtggcgactcgagagcgtttataggatgccacatgtcgatttaggagcgtttgtagaaagtttaatggacttttagtatataatagaagatagatagataatagatagatagatagatagatagatagatagatagatagatagaagatagatagatatgaatgtgggaaatgatagaatgccttatattgtgaaacggagggagtaatacgtttaactgcagttctcaacatctctcgatcgacgagcaagctgtggctgctgctgcaattcggcctgcaattcaagtgcagcaatatgttgtgtgcaatttgtgcattagtgcacaagttgagaatggtaatattatttcactcggaagagatggaacagttgtgaaatgcagaaccactcggttcagagaatagtcctggacaaaaggacagaaaatggtccaatggtgacaattgatcatttttacagtgaatggtgagcaactgatcagcatcgaccatggtgaagctgaacctgataagtcgacagcactaggggtgatgatcctagccacccataaatcctttcttgtatatttcctaacatatataagtcagcaagtcaaatgttcttatcgttttctttagtcgatggttcatcgattctgacatcaagacaagaagccaacatactgctagccatgttcctttcctcttggctcacatacggccatttgaatggattagattcagaaataatacaatatctcgtctttctttcttaattacttacatgagttggccggtgcgcaactctgccgccggctaccgcctgctgcgcagagatgcaagtgggtagtcccgctacccgtataaaaacccgcttgctagtatatttttcgtatggtagtacgaaatttagaagaaaaaatgaactagaagtaggataagcgggacaaaaaaaaaagcccgcttgcccggcccgcttgcatccctatgctgcgcgccaggttgagctcctcggccgcgagcgtgccccgggtccactacgctgcagctctccctccgctcgcgccttccttcgtgcccgatagatgcgaccgcgccctctggactccctcacccacctccgtgccccacgccggtcaggcggccaacacgcgcctcctccgccattgtcgacgtttgatgtcgcgattccggtatttgcatagtatggggatcgttggtactaggatatacgcgagactgaggtaaaagagatggggacgaggatttttatataggttcgggcccctgaattgtcaggtaacaaccctacatcctgttggccgaagccggtattactcttattcaccataatcacaccagtataatatgtggggtagcctatctaattgttgtcgacatggcggtctgaaggtctgactcgtagtcgacaacagggtaatcttcctcctcgaatccgtgcccggcgagatcagagatagcgctttcgtctctcccgacagtatccggagacaccgtaggggactagccatgcttatccctgaagttgatatccaacgtcttgtcttggcgtatgttggcttgtatgttgtggcttctgttgttccgtgtcccctctcctcctagggggccttgtatttatacccataggtgtctccttgtcctagtagaactagggaaaccaatatggatatagtccgagtaatccttgtcgtttccatgtagaactctggttgtctttccttatccagaactccctccatatctgaagtcagtttccgtattagacatggtatgtggtgggtcctgccgagatgtagtcgactactattaggtatgtggtatccataaccctgatagtagcccctgacttcaatgcaaatgaacgaattcatattctcgaccactgaccatggagtaactgttatcgagctcaagtgaccattctcggtgagttcagagataacgttagacttcctttatcagcctcgtgcgggcacctaaagggtttgtctcagtccatctccaacgtcaaccaagaaagtacagaacattcgactaagtctcccgtcttgctgtaatcgagaatttggattgaagtcaagaaattttatctcggcgggtacaccatctcttcaatccgtattccttgccgagatccaccaactgttctcgagcgatcgagaaggcgtagaatctgcgacggagccttgtcaacatttgtcgtactcgccttagtcgatcttggtgtagaaccatagagacatggagtcttccacaacgtcgaatagaattttcctgaaatcaatactcagaaaagaatatcaaatagaaatagcccccgggcgaacgctcaaagggtgacatgttatagtatgtatggaaaactgaaaatgagttaaatttacagaccaatgttttgtatatgagcgccttctctcttaccgacttcgatcagtcagtttgttgagtcatacactctccctagcccccagccttgtcgtcggagaatcgttctcggaggagaaggctcttggacccttgacctgccttggttgaacaagcactaattctagcccccagtcgtgaagttggaaaatccaatttccgattacacggcttggttaatacgcacggcgagaactcttacacgaccagatcttacgtggtcttttgtctctacaggatccgacaaggccttatcggctctaggcgcccccagccaaagttcccttaggttcctcggaggccttgtcaagacggcgtaaagggacatgaggataggtttcaatgctaggtgtcgtcatggtaagggatctctaggtaaaacacttagcaatattgtgtatctgatatcaactttgttcgagtagaggtaatgggagaatcgctacaccgttggtcaaaaaccagttgtagccccaactcgaccacttgaaacaaaggtagtgggagaatcgctacaccgctggtcgaggaccaggtagtagtcgtaactcgaccacttaaaagtggaaatagtgggagaatcgctacacctctggtcgataaccaggtagtagtcttaactcgaccactagaagtaaatgtacgagagatcgctacgattaactggttgagaaccagtgagtaggtgtctctcgaccatttggagttggtacgagggccgttatgctaccggtcgaagactagtcgtagctgtccctcaactatccgaagtcatctgaagtcgtggtgcgaggaccgttacgctattaccatagttgtacctcgaccatcaggatttaaggcacgagagatcgctacgtcctactggtttgagaaccatgagtagaattatctctcgagcaccaatggaagctgcggtgcgagagattgctacggtttacaggttcgagaaccagcgagcgagtagaattatctctcgaacaccaatggaagtttgcggtgcgagagattgctacgtacttgttcgagaaccagcgagcgagtagaattacctctcgagcaccaatggaggcgctagagttggtttattacatgtgcatctcatgtggccagcatgactcacatacccaacttatagcatatccggatgtccgttcgcaatcatgtcgggtgatcaagccgacgacgttcgcgaggaattatccgttaacaaccttttctcgagtagctcagccatggctggtgtcgcgaccgagaaaattaccttttcccgaacgctagtgtattaatccccgtcccaggaaaagccggggtacaccacacaaacatgaaacaaaaggcacatctttattatatcgataatatttacattattacaaaggcacttcaggcatgacaaacaaaaataaacagcagcggactagcgggcctacggctccatcttcacaggcgctcaactggggtataagccaggactccacctaagacttcttctccaaagcttctgttactgaagggggaaagattgagcaagaatgagtacaaccacagtactcagcaagtcacaccggaaatgcataattaatgcaagggggtacaaggggataataatataggggttaagttttgcagtaaacagcatttaaaagtcatttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaatcattccacattttagttattaagcaggttttaagaatttaaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccagccctgtgccatgacatctcgactaccgggccgcagcccgtgtagccttcatttgtcctagagatgtccatcgacccccgactttgtccatctccatccgtgtacttttgtttataaccagactgagccacaaactaagccttacccacttgacatgtggaagtacggtagtgctttgcaacagaggcccgaagaccgaggtgctgctaacaaaaccatgcaccccgagcccagcctaaaaccattttgagggttttgaatagagggagaggtgtgcatccaattccacaataatccaaccattccatagtgtccaagtgacatgaatattcccaaagtctagagttataaaaccacctaatgttgcctagttaatcagcgaagcatctacctaaattcatactagtggaaccatgaatagagtatccactagctggggttttgtttattctagggtgaacaaggtaataataacaatagcaataataatgtcataacgaaggtaaataggcatggctaaataaaacagtgataacgcgggaatttaaataaagcggtaatgcattaatttaaatcaaaataattttataaactgggattcaatatgctcaagaataatgtgacttgccttgctcaaagagaacggccttccgaaccttcggcgacgatcgcgaaccacgcttcgggaacctccggaacgacagaagctacgcgaagcacacaagcaaagctacaagcctataaagaagcaataacaatacataaaaagaaagcacacggttctttaggttataataaacattaggagacttgaacgggtcgattcagagttcgtatgaccaagatatgatcatccgaagtttaatgctgttatatggagatttgcggattattataattaggctttgcaactataaaacatgtgaaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaactgaggcgagtagccgacaaacggactccactagacaccacgcgggctgcacacgtggaaaccacgtggctaccgagcgggcacactaacacggacactacacggtcacttcccgcacacgtgaacgactaccgacaccggtacacgggtaccggggtcgacaaccgcacaacgggtacggggcgacaacgaaaggacaaggacggggcagcgagaggacggatccttaccaccacacgacgaggcgagggaacgacaacgacgaacgggcgcggcggaggcggccgggaacgacggagacgaacggcgaggggacgacttcggtggcgatccttggacaaaggcgagacgcggccggcacgaggcttgacgacgcggagccgaggacgaagacgacgatggggctgctgcacacttgacgaaacgcgggcggcgaacgcgatcggcttgacggagggacgaacgccacgacgatgaggacgacgagaggacgacgacgacgacgaccggggccggcgaggagacgacgagggcagccggcggcagctgcatggagacggggacgacggggaacgcgccgctgcgaatccgacgacggaggcggcgccgcgagacgacgagccggcgaggacgaatgatgacgacgacgacgaacaccggcggtgttcgggtggaggggaggcgaggccgagggcgaccttgccgctatgatgccggaggtggtggtggcgcagcgagccgacgagccggggaggaggaaggggcggccgaagggacgccggcgacgacgaggatggagaggccggcgcaatgcttgacgacgcggtctccggacgaatcagagggcaggccggggtggaggtcgacgcggcgacgccgagggaggagacggcgcggccggcccacacctgagcggcgcggcaggggcggctggaggcagtacagtggcggcaacgccactggacgacggcgggaacgcgcctccggcagtcaccgcgcgaaacggagggcaggctgtcgtaggctctccagaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagattcacactttcatcttaagcatggttacacatagcaaacacaactaagatgaaagaaacttaagacttacaacaacttaataattacataggccgaccgcccaaatagacttattagagaacagcggaagcttgactacccaaacacaagcacaccgactaagggtataccccattaagttctcatcctagaagaagcaatcggaacccgcatcactcaaagactaagactaaacctgcaaacaaaaggttatatcaaacagcaagagtcagtacattaaacaagttaatgtactggcaagcacaagtcaatcctaccatactacatgtaaagcatatattcaaaggaagacaatatgtagctcaatttcagcataaagcaagttttgtttcgcaattcttttgtaaagaagttgatgcttcaattaacaaaacaagttttaagttttaacattaagtttatcataattccatcataatcaatctcttgttgtcatccttgaacaacaagtcataatatatcatcacactcacacaactcaacacgttttatcaatttcaaatcaagtcacatgttcacattttaaatcataaagcctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagaatctagccttacaccagcacgatacgtgttcctccatcctaggcatacttggaaatatgtctagaaccgttaagtggcgggcccacgccttaaacttaacgccgtggtggcggacacaacgggaacccacccacgtggcacaataccgttgtattggacagacttagtcacctaaactaccacgtcggggcaaataggaagttcctctgaatcatcgactaattcctcataattatcgactaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtataaaatcacattttacacattttagttcgcaaatacccatcatattcattttattccagcaaaggttcaagtatcaaaatcacattttaattatagatggaatgaacatttgcatatttctaagcatggctaagcaagtaattgcacatagagcatatataaacccatttgagcacaaagagtgtactctaaccatttctaggggtgttcaaacagcaagagggatnncaattattcaaggtggaatatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccactccttcaccgattatgcaattatctagataaaggacacgatatccaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttatagtagtatagtcttaggtagtgttatgaaatactttggtaaagtgatttttactagattagacttcataggagtgtgaagttgtgttttctaagactaacacatttggtttcacaatttttggagttataatgatttctttatgcattttacaagttataacgtgttattggtgtatagtgttttatatgttcatgacttttgagttataggttcagaacatgctacttcctgtataagttgaataaaaggaataatttggttatctaaaacatttttagttcacatgtttatggtctttactagtatggttcatattttataaactagagatgctctaatctaaactagcaatatattatattaacctagaaattgttatatgagctaagttcttctaagttttagtggatgaggatggaactatggcttcactggcaatcaagttt

SEQ ID NO: 79466 - DNA, 13496 bp, Oryza sativa
ttgttgaataacctgcacttgctttgtttttgatcctttgttagccatgctagttatttttatgctcactcctagcttgctgatctagtgagtttttcctgtctttgcttgatacttatctgaggtacatagataatcattttatcaacatagcaactatttttctttctgccattaacgtgtgatgtgcatgacagtttgtattatcccttgtatttgcaataatagagagttatattagatatcatacattctggagactttttctatttttataccacttgttgctagttgttgcatgagctaacaatcttttcaaccctttcagagccttgatgagatcccagacaagtccctcaagagcaaagatggttcaagagtctgcaaagattttgttagtttggtaaaagagtggcttcaaaagattcaggtatagctgtaaaacctcgtggcattgcttttacttgctacagtacccttatgttactattttgttggtttcagttagcagattcgttatgtggtgtatttggtgagacaaatcaaagtgagctggcagcatttgcatcctatgcattggcttttccgaccaattttctagctcttgtggacacatatgatgtaagttgttgcgatgttctttaatcattttattgttgagatgcatatatgagtgagtagttctgacccttttttctttttgaaacagaaagtaggtatggaacttcacatatcatactttgtcaataaacaacttgacaaaaatctcatatttgtcctttggagtcttccttttttatgctagcatttctcagtggcttcttttacaaaaaatcatttttctttgaacgttttgcaacctggattttacaaacagagatgcaaccagttttaagtgtgcaagtatttagacttgatgatgatgttcaactatggtgatttcgatgtcataattaatctggcactcctccaggatgcataaactctgaacaatcagtgtgtacatctgtagcctttgtttcatatcatttgatagtctgctgtgcgtagtgacatgcccttaccggtaccctgtaagtctgtaactctttagtggtgtgcagattttcaatgcatttatgccgcacatgtacgttctatgttctctagctttaactcaccaagttttccctttcaggttatgcgaagtggaattccaaacttctgtgcagtagcgctagcactccatgacttagggtaggtcaaatcaaacgtatccttggctactgtacatttgcattttgattgaagctcgattgaattggagcttatcttctcatggagatcttacatgacagtgtcttacagaaaatataaatgaagctaaagattaaggcaaagttcacccaatacaatccaatttaagatggtacaagtttatatcaaatttgtgttttccaaatctgaatcattctgatctatacttgcaaaataatctgtaatatcttagtaatctagacaccatcatactttgggcatataagatgccagttggttgcaaatttgtagtttttaacatgtgttcttattgtaacattagaaaacatataatgcatcatgtgcttattgttttctcattaaatatttgaatcatcaagttttataaagatgtcttattttgtagatcactgtctaataaaaaagaaaaatcttattttgtaggtacaaggcatctggtattagattagattctggtgatctggcctatttgtctattgaggcccgtaaagtgttccgtacactagaaaaggagtttaatgtgcccgcttttgggaagatgataattactgctagcaatgacctgaatgaggaaacaattgatgccctgaacaagcaggtaataaaattgccaagaacttcattgtggcatttatgttatctggcgcatttgtgtgtgctcctgtggactacagggcttgtttttatttccaatccttctaatatgatttaaatttctatttatttcagggccatgaagttgattcctttggtattggaacttatctagtaacatgttattcccaggctgctcttggctgtgtctttaagctagttgagataaacagtagacctcgtatcaaactttctgaggatgtggctaaagtgggtctattttttcttttcatgttgacaaagaatttcatttctttttgtttacttatagtgtcatgatgggttccaggtatccattccatgcaaaaagcgatgtttcagattgtatggaaaagaaggctaccccttagtagatatcatgatgcgtgaaagtgaaccatcaccgaaggtaactatgaatattgtccaaattatccctatttgttaccatgcaatgctgctgtcacttatatcctttgctgacccttttttatctacactaattattctcgattattaaactgatcttgtttacacctaacatttcaggctggagaacgaatcctttgtcgtcatccattccttgaatccaagagagcatatgttgtcccccagcatgttgaggagctcctacaatgctactggcctggtacatcaagtatgtatcgtggatctttctaaaaaatgataagttcttcagttgacatggctaattttgaattgtaaaggaactaatcagagttggtattctatcctactgcttattgtgcaacaattacatttgcatatgtgtccctttcagataaacctagggtagagttaccctctctagaggagatcagagggcgctgcatgcaacagcttgaaaaacttcgaccagatcacatcaggcggttaaatccaacaccttacaaggtttgtcttcgtttcaatctttctttccctttttgcttccttcagttcccttttttttttacaagatctttacttcgagcaggtgagtgtgagtgcaaagctgtatgagtttatccattccctatggttgaatgaggccccagtaggagagttacaatagatttctacagaagttgggaaaaacagagaagcgtattctttgaagcatagcaaaatagcaatacatcaaagaaaagtagagctctgttgtaaaaaaataaaaaaaatcgtcagttcatgggcccaaccttataggatttttgctccccaatttttattagtacaaactagttatcagtatagagataggccaacctatctgactgtacatccatgatccattgtactatacgtcgttatggaattgaacatcctttttggagatttgagtccatgagatgatgagaacaaataatcgctgtaaaaggttgagatcatgcccccctttgtccttccagaaacatttgcaggtgattgattcagaaactaaggcagccaagcattggtataatatccgtactccatgtaagattcatagttttttttttttcgttttgatttataagattcagagttgaaacttgagcagaacaaaaatgtagttgcaccctgtgtcggctgttgggctgggttcctcgttgtgttcatggtacaaggaaaattgaagatccctgaataataaggtcaacagcacaagctgagaaaaggtgggtgatgtacttcccaactaccattgcattaacagagctgaacataggagtactggtcaggtatttaagtggagacaagttggcaaccatggtcatttgaccattccctcatttgccattattgccatcatagaaagaacaaaaaaagggaaaaatatctcctcatttgccaataataagtggaggcaagtaggtcgtctatttcatttcacccatatttagggccccctttgaatgcaaaaatagtggaatatgaaaaatgcaagattttaataggaatataagtacaaaacagaggattgcaaaatacagaaaaagcaaaggaaggaataggatgagagagatagattcaaaagaaaatttcttagaggtttgaagctcttgctaaattttctctagaatctctatagaattgtctatttcaatggaattttaaagaataacataggattaaatcctttgttttaaaggccttcataggaaatttttctataaaattgaaatcctccaaaattcttatgtttttcctccaaatcaaataagcccttaatgggtattgtgtaactgggaaatcaatggattttgcaagcgtacgggacctaattataaaaaataaaggttaaaaacatactcctcagcaacaaataccaagttgtacctcgctaagggctttcataatttaaatggttttaaaatgccatataacctacgggcactcattaaaaaaacaattctcccataatgcaagtggtatctttgatcggcctcatcttttcgtttatacttatacttatcagccaaaaaataaattttaaattggaagttagttttggagttttttcatcggagtttattttttaacttttgcttttagatcgttaagaacatatatataaaagttttattcacaagttatttttagtttgtaataggacatttcgcttattccccgaataccccgaataagtggaatgatgggaccggatatttcatatcagcctctagcataaaaataattctaccactcgccacgtcacagtgttgttcatcccctgaggccacgattgagaagccaaaaccgccacctaagccaggaactgtgcaagcaaccccctccacagtgcatgtgaccttccatctattatagtgggtcccaccactcttcattcctcttctctctccacctttccccaccgtcggacgaagcgagaggagaccaagatgtgccagcggggaatggagcagcgatgcgccggcggggaacgagcggcggcggcgcgacaccacgtgaggtcggcggcgggaggaggcggagcagcggcgtgacctcggtgccgccacgcggtgcctggaggtggcgctggccccgctgcccgccgcgtcgctcctcccgctcaccgaggcccgggtgcggctgcgtctcgcggccctgctgctgcgttcccgctccaagggcttgccaccaccaagtcccacctcgagcgtgccttgctgctcccctcctcccagagctctggcgtggatatccggcgggcggagcgatggatccagcgacgacggagcagcttcagggcggccagatccagccgagcggcgatggagcggggcggagcagcggtgagggcgccgggcgaagcagcggtgagggcactgagcggagcagctgcgggcgatggcggctcgccggatctccttctctcttcagctcgcctgcgccaaatccctctcccctctcctcgtcggcgcctgctgttctgggcaacgacaactagcagcggggttgcggttgtgcggatgcctgacgaatcctggctattccctgacgaagaacgtgtgtcccattttggctccccgttcctcgcttggtcacggtagcgtctgacatggaggggaatcttggctgaggctgggtgaggctgaataccacctatgcgcactgtgaacgccctgagtcaccggcagcaggagcctccaacccaatgttggctttcctttttgtttgtgatgaagtagtagtatatggatgtactgtcaaccttgtactaatattttcgctgcagcttttgttaaagcaaaagccaagattttcccattatcgaaaaataaagcagcctccaaaccctgtacgggcaacggactgatgaatgtacgaacttctacagcgcagatatggactgtttcttctccctaggaacccacattgtcatcagtacatcgtttctgttttcaagggcatgtctactgcattagcattactactaaattaatagtggtactaccaaattcagcagctttttgtaggtaatgttggtatgattagtttaactgcttagaatatttatgattagccgttgaattgcgttcatgtactgtctacttccggggtttgtttgatataggtggatattagcttcgaactttatgaatgaatggacatggaagttgaattgatccacaacaacctgaatggattgaattaaaatccacaacaacatgaatggattgagctgaattgggttactcccatccacaagatcatgtcatgtttgcaatgattacaggttttatgtggtactcctatgattacaggttttatggagtagtatgcagtatcaatgttaaggtcctactcctatgtgaggtctgtaagttcaatagtactactactttgtgaagttgcttttcaacaaaatttctacaaaagaaaaaaaaatccataagcctacaaaagtgattagtgacaggagtaccattgtggcaaggagaaatgtgctagtacaagcctacaaatatgcaattaatttgcaacttctcttcaaggctataatggagggaaagcgtccacctaaaccgtatgcagataacaatacgtccttgcatcctgttggtacaatacacacaagttttgtgtagaggctgttggttactcatcatgcaccagcacacgtacacacacacacgtgagtcggtgagtactaaaataagattgaacacaagcttcagcttcaccattatccatagccgaaatttaaattttagaatttaatttaaagttaatttaatatttttattctagtttaattttcagcattggcttttaaatcagtagtaatacatatttaaatgttcacgtatggatttttttttgctaataagcctcagggtttataataagcaatttagcaccagctacactaatggtcaaaagaaagaaaaaagtaacttctagccgcacaagaatttagtcctattcaaagaataccacaaaaattttagagtaacaatgaatgccaaaactaatcatcaagtatatcaaaaatgttttcccgaataaaaaccctccatagtagtaaaaacattacaggatagctttatcgtgtaggtgttcacaataatattatgtctgaaatgaatcaaactttttccttgccctgtgctgattactgagaatatggatctaaccacaatgctcttcctccatagttcatggtggctactggctacccttggttaggttaatttcaaaacgaatcaaggtcgttccatagcctctggtctaaattattggatcccactgcatcaaaatcataactttgataaaacctatactttaaaatatattttctgtcttcatatataatatatttctaaaaagaaaccctttaattacaatgaaagacacaacacagtaggtgtgtgtagtgtgaaaaatatttccatggaagagaaaccctaatataatatgttctatttgttgtacagacatcaatacttaagtctaagggctcctttaatttggccaaaaatcatagaaattttgaagaactttaataagagctctatccttttggaaacttttttttaagtctatctatctcatcaaattcttatgtttttttctatgttccaatcaaacagtcatttctatttttttctatatttatatttttctatttctttgtttttttcattcctataattcaaagagcacttaaatgaaactctttccttgtcccatcccaattactaaaaatttccctagatgtagccacaaatccacaatgctcttcccatattgacacagctatgataggctcaaaataaatctaaggtttcatggatctggcggcaccgtgctgtccgctagctcacccaccgcagctcaagaagacctgcattcctcctcccccaaatcacccccatcaaaaatatcctaccagtattctgtattcccccatgcctcccttctcttctgacttgatttgtttattactgacgataatcttgacttctctgcctccaaatccgattctccacacatgcaaaaagaattaagaattgcatattgcatattgcagccttgcacttgcagttgcaaggcagctgctgctactacaccctgtcactcactcacacactctcatccctgcacacacacacacacacacacacacacacacagtggcagtacacactacagtacatgctgcagccagcagctacctatacactcactatcacttttgcaagagtgtactactccatctaataattgcatccttctcctctacatttctgattgatttcttttctccccctttgatttgttgtttgttgcttcttgtgctcctccctccaaagatcaccaccaccaccaccaccaccaaccacccacaccaccttcctttctctcctccctctaatcttctccccctctccccaccaagaaaaatccaggctttgtattagggaccagattaagcagagaaccaccaccttttgcctttttgcagtttgctgttttcacctcctcaaagagaagaagaagacactccaaattcttcaccccccacacaacacacattgtttcttcccaaaaatccaatcttttggttttgggcccaatttgtcctcctcttaaatcccacttttccatcactccattctgtcataaatcctctcctcttcccctctcaaagttccagcttttcccactaagaaaatccaatcttggccactccatttattcgctgagcaaatttccagccttttttgcgcccaattccattgggagatggagaagtagattttagcgcaaaaaaaatcaggtttttttggcacccgattttggttgggagagctcgccggagatccgccatttgaggtaaggcgaggagctctctctcccatgtcggactcggagctgtcgcagagcacggtggtgttcgggctccacctgtgggagctcgtcggcatcggcgtcggcgcggcgttcgtgctcctcctcgtcctcctctcgctgctctgcctcgtcgcctcacgccgccgccgccggcggcgaggggtcgccgtggcgacccccgtgctccacctcgccaccgccgtcgcgccgcccaagcaccccggcaagccgcccaaggacatccaggaggtgccctcccgcgccgccgccgccgccgcggcgcccaaggcgcagccggcgcaggtaatccaggcgccgccgccgcagccgccgccgtcggaatccatccagatcgagacgggcaaggagcaccgcatcacgttccgggagcagcagcatcagccgccgcagccgccgccctaccaccagcggagcgggggcccctcgtcgcgcggcggcagcggggagagccgcggcggcggcggtggcggcggcggcggcggcgcggagcccggcgtgcccgaggtgtcccacctcgggtggggccactggtacacgctcaaggagctggaggacgcgacggccatgttcgccgacgagaaggtgatcggcgagggcggctacggcatcgtgtaccacggcgtgctcgaggacggcacgcaggtcgccgtcaagaacctgctcaacaacaggtagtacctaccactcttaccacctgctgctgctgctgctgctgcttcccatgaactcaagcataatagggcaaaatgcagcagcgtgcgtgtcgaattgggtctcttttttaagaatgcgtaggttcaaggttaagcattaaggaaaggcttgcttagtttcgtgagggcattaagcattacttgaatggagatgttgacaattgtagatggtgacatttttgctgagaacttgggtagtagagacgatcatgtcgtgttccgcactgaacattttcttatggttcacatgctctgtgtggaagctgtcgattttagaggccgaaatatatgtcgcgtgtgacgtgtgttggttcgttctagtgctctctctctgttgccaaatttagtaaaattttgatgcttgctttgttagggggcaggcagagagggagttcaaggttgaggtggaagcgattgggcgggtgcggcacaagaacctggttcggctgctgggatactgcgccgagggtaaccaaaggtaccttgaaatcaatggattctatgactgagtagcttgcaatgtataatattttctgtacgaatccttttcaggatgcttgtgtacgagtatgtcaataatggaaacttagagcaatggctccatggtgatgttggtcccgtaagccctctcacatgggatatgagaatgaagattatactaggaacagcaaaagggtatgcatctttcagttcattaccgtagactatagacatattggtaacattatttacattgtgcagcttaatgtatctgcatgagggacttgagccaaaggtggttcatcgtgatgtcaagtcgagcaacatcctccttgacaagacctggaatgctaagctttctgattttgggctagcaaagcttttgggctcagagaggagttatgtaacaaccagagttatggggacatttgggttagaaattagcacccttgtaatgtgataattgtacaagacacatgaatattttgcttatgcatcttttgttctttgcaggtacgtagctccagagtatgctggtactggcatgttaaatgaaactagtgatgtctatagttttggaattcttatcatggaaataatatctggtcgggtaccagtggattacaacagaccaccaggggaggttagttattgtttgccttgttataaggattctaaattaagatcttgtcgaatgcatctatgaaatcagcacattaatcctttcaggttaatcttgttgaatggctgaagacaatggtgagcaaccgaaactctgaaggggttttggatccaaagatgactgagaagcctacttctagggcactgaagaaggctttgttagtagctctgcgatgtgtagacccagaagcccgtaagaggccaaagattgggcatgtcattcacatgcttgaagttgatgattttccctacagagatgtaagttaacgtggcatgtggctccttttgtcttatgttcagtacccatcattttatatagtgaaaattgtgagcatcatttgcaatgcttgtgtggcccctaattcctctcgcacagttatttccaaggaaaaaatgacatcgtagtgaccatgttgagttctgtacacactatttagttttagattattataccaacccatttttgtttttcacatatttttgaatgtcaccttttggttcattgctgtattggtgactgtttttcttggacaacggaaaacatggttccaaaatcttcattccccaattttgaaatgccccatcattctccctgtaaattatgcatatgaatgacgtgttccaagtcagtctttaagaaatgaccaaaaaatatttattataatgtgcttaaattccatttttaatcttttctgaaaaacaaaaggcaggagctttgcctatatattagtagagcagggaaaaattccactttttagttgttgttatcgcactgaaatcgtgtacattataaacatatattgttgtcactccttttgccaggaacgtcgcggtggcaaagctccaggtcaagtgaaatcgggagaaataccgccagttgaagctggtgatagcagcgggaacaatacgccaaaagaaacaccaaaaggtcaaccgaaagatgaacctttcaagtggagaaatcaagcggcggcctagctattagcaagatggtgattcttctgaattcagtaagacgacgatttttctgaattcttacacctgatcaagaaaccgaatgccgcaaacttgcaaacagctcatttgctgctcgttagttgggttggggcacggaaacatggaacgcgccgagatcgtgagagcatctgtacattattgggttagtatgttagccatagcgattttttggttggtttatttggttatatttatgtactaagtgataattcttgtatgacaaattcatgttactcttgaggtaaaagttgatgagcggtgcttagataaaaccttccatgtagcaatatatcccccaaatgccagtttgctcatcagtcatcatacaatgctcagtttcttatacttttgagatccatacttgtcacctaaattgtgatgattcaatataccagactgaatcctcaggtgtgtgcccacatttctttttcctgtatgtaacaaaatgaaatgagcagcactacagtagtctgaattttgctgtttcatcaacctggagaagaaaaggaaaggcttggttgtcacatgatggagcctcaatgacctacctctggacactgatagcacacacaatcactcattatttagcaaagcttgataagccagcaagcttaattaagtagccactgattgattgccccccctgctactcagatcttctccagagactccagagtggcatccagctccaggcaagctcaccagcagcaagcaagaacccagacagacatgcagtgcctactactcctagtactccctcgtcccaaaataaatatagttttgtattgtttatatcaaacatttgaccgttcatcttatttgattttttttatgattagtaatttttattagatgataaaatataaataattctttatgtgtgactaattattttaaattattttataatttttttaaataaaacgaacagttaaacattggacacggatatgtacagctacacttattttgtaacggaggtagtagtactacctgactggaaatgcaggtgacagtcggttaacagatggcatccgggggcaagtagtattagcgtgaggtaatccggattagtagcagatgtgatgtgacacgaggcgacagcgaccaacaaacggaccaggctaggctacgttggatggtttttgcggatgatgaaaaggatctggatggacggtaggctggtggtggatagtggtagcagtagcagttgtaagctgggggccctagtgaaagctcagcttcgcctacgcctccggtggcggtggccgtaccgtccgtgatgccttctttccctcgtgtggccgccggccggcgccgacggcgagggggagttgctttccgggcatctgttgctgcatcattcctctttgtcgtgttcctctctagctcgagactgaggctgagttcgtttcagctttttgaaacactacttccttgttctctaacgaacatacttcctaaactactaaatgatattttttaaataaataaatataaattttaaatttatatactcgggtaattaattttatatttttaaaaggaagaattattttagtgtcgggtacttgggttgtactgacacttcaatgctgcagcttgtaaaagtctgaataacagagcggttttccatggtctgtgaataatgaatgaatagtatttgcttttaaaacccagttgttcctcaaaccatcattgaaatgtccgtggtttttttttcaacaaaaaatatatttcttccaaatatgaagctactagctatccagtttagagcttgtcggtaagtgggatttaagcaaagccacccattttagtttggtttta

SEQ ID NO: 79467 - DNA, 7350 bp, Oryza sativa
tgtaatgcaatactgcagtcaactatagcaaatcttgtgcagagtgtctgctttgccttatgcacaatagggtgactgaatttctaatagtacacaactcagaatatcttgattcgctaactgttaaaactgctctggttcaagtagttgttctcttgtagtcattctttgaattatgggagctctctgttcatgcaatgccattacattgtacaaaaggatgtaatgtcattttttttcatctatccaaatgtacagggcacagagacagaatcaaatgaagactatgggatgttattcaggttatcacaggagggaggcatcacctatacaaaattaatccagcaagtctctgtctcacctaatgcaattcttcctggtgctcaggtggcagtgactagaaataaaacacatattaaatgaaaatgtttaaactaaaactttatgtgcacagtcataacccccaatgtatttttttttgcaaaacagggtggtcttcccttgctccaaaacacagagattctaggtggtggaccaattgggatatttctaattccaaaatctttgaaatcaagataattaatctaaggaaacaacacaaaagaaaaagaataagtcaatctttagaaatattatgggtttaaaaaatgacttaagtaataaagaagagatgcatacagcaagtaagtgtccgcagccaccaagggtttttgatgtttgttcctttgatttactctccttttggaacttggctatgtatgtcataagccattcataaacaaactttgaccagttccactttgagctggacttgatattaatcagaggttcaaggtattttgggctggggtgagtgtctgagttggggcaaagaaaggttgatagtgcaaccaccatgaaacaacgtaggacatcatcttctgatagtttgttcacacccttgtcgctaagcaaccttgtcattcttgatctctaaacctccatttgggataccaagtatgaagttggtggtgtttgggttgattggtatggatctcccattgacaactatatctgagcagctgacatcagtgtgactagctatccatttgacaaaagatagtggtatagcacacctttgaaagtttagaagagaaccaaaagcagaattctcaataattaacctttgctcgttgctgagcccttcaatcaaattggaaaagtatgtgatgtttagtctgcttcttggttttggggactctgcacttctagatttattcatgttttgtgtgctggaagaaaaaaaatagagatgtaattatgtcttgttaacaaagaacaacataaactaattaacatactagatgtggaaaaaaatgtttaggaaaaaaaagacagaaagtgataccttttgtttttgtctccttactggtttgtctgtcctagctcttttccttttgatcgatcctgaaaactaacagaggcaaaacaagtatgaagttattgatagctgtctgtggtagtagaaaatgatattttggaaaaaaaggaagaaacatatataccagatcttttaatgtgctgacgagatctttttttgttatgtatttgtcagaatcactggtttcttcctcttctgaaatagagttggcataatcagaatctgccactttgttgtccgacttgctatttgatgaacattcatcatctgatgatgtcctgtcacttgccatgctggaaaaaagaactagagaagtaagcacattaaaaggaaaaaagagagatcttgtaaccaatcaaaccaaaaaaaaactctcaatgtcctgataggctgctaagacacatgttaaactatgccaaaaaaaaaagaagtagtgccaaattcaaacaataccatttgcatcttgttgctttttgaaaattcgtgcaaaggttgaaatcatgtgcaaaactgcatatgcaggtataacattattaattcacaaaatttaatgtgttgcacagaaaatttgattactatctcatataagtaaatgtcaactacaacatcttggtattgcgaaaaaatgtgttaactactagcatgattatagttgcacaaaatcataattaaagttgcacgaattaataaccaaagttgcacaaacattaaaaaatggcgactgtaggaataggaaggtgcaatttttgcatataaaagtaacaaactggatagatatggcattatattattcgaccgcccacatttccaagctcaccagcaaaatcaaaaacttagcagaaggaaatgtactcttcttggcctgcagcaagctcctccccctgtagatccaacgctccctgaaaacaaaattgtagtgagctattacatctgagcatacaatcaatctgaagttgtgcttgtttataaccaaaattaggaaaaaaatcataaagtagtcagctaaaaaagaattagttgcatgatttattaattgaaattgcatatatttataacataacttgcgcgaaatgtatagtattagttgattttgctatttggactatgctgctggggtgtagatggttgaagcggaaaaacacagtaaatgaaaaaaagagacacacttgatgtcgtgtgttcatgagaaaaaaaagatacaacatgaaagtagtatgggttgcaaaaagaaaaaacacatgaaaagttggacaaaaaatctttataaaccaaacttgtagagacttaacctagaagttgcccatgtttgaaaaaaaaggcaattactaagctatataaaaacatattaatggttgcgcatatttagaaaagtgtcaactacaacatcttgggtgtgcaaattgtaaaaaaagaaatcagtactgccaaagggatttacgaaaaatgaagaaaaaggtaactaataacaagggaactaacttccagccacaagctccaccatcccactgtcaaaccactgccaatccttctatatccaatccatccttagactactccccaagttacagccaaaaaattgcaaagagagtcactgttgattatactactactgtattagcatccgcagtttgctcaagtttttcaccagatcaggtttttcaccagaaaaacctgagctcgccaaacatccaaaagaaccgccgatttgttgtggcgttgatcccgagtcccgcaaaacaccaaatgaatccccttcccatcataataaaaagaaaaagaaaaggcaatgaaattactaagaaaacaagttgtctaccaaaagtcctcacttgtatgcatgttttcccaaacaacaaacgctatttatcaaagtaaacggaaatttggttaaaaaaacattagttgcacaaaattattacacgacttgcacgaaaattcaaaatggctactacaatagtcagggagcgcaactagcgtagatacataattttcagaaaaagaaataatgaaaatttagggccatgtgctgatcgaaagcataggttttagtttgaggccatatttaaagcagtaaataagtgaatcacttatacaacataactgtacgtagcatatgaagagatatgctttatactgtccatttatacagtactatcgtaaattatattgtccatttattctctatattttagtttcagattaatcttactgtttccattaatctcaccctcgtttgcgtttgccactgtcatttgctgagttgctaatgacacagaccgatgcttttgcgaattgcgattactctcctctctcagtgatctactaagattaaacataattgataggagcagagcctggagttcattttcagggaggcttatctcagattgatcactgatggaatggaagcaaaagtggcttagtatgtcacagttgagcaggagtatgtcacagttgagcaggactaccgttaaaaaaaatacacagcacagaaaacaaaagatagcttttttctacaagcagaaaacacaactcctccctgtatatagtgacactgaaatccaaaaaaattgtggtatccctgtatacagtaacctctgattaactccctgtataatctgacaatactgagggacaaatgtaagagcatttgctgggatttaatgaaatattggttagttcttgagctcgaattgctaccaaatccctaaacccctttctaaaatgccacggcacagaggtcatcactggcctacaggattaacgactaaatctagagtaaaaccatgtgtgtgcattccatgatatatcagatccaagtagtgaaactgcaaaattccctaacaaatgaagttagagagaaaataattagtgccaaggtttagaaccaggcagcggcatagcccacctcccgccgactatatcatacacgatgtgcagtaaaaccctaaaaaaatttcccaaactacatcgaacaaaacatcaaagcacacacaccatgtggtttcaaatccaggatgctttactcgacattgggcaaaatcaactcaaaactcaagcaatgaaacaaactccacgggattccccctccccttgaaatggtagccaatccagccctaatagctcacaattcacaggatagaaatctggaccaaaggaaatcaggccgccacggcgtgaggatttgaacaaaaaagagagatgaaaaacctgcagtgcatcaactcctctccccccgcctctcttctccggcgccgtccgcggccgctcgcggtgcacagcccacctatcgccgcccccctccccttcccctccactgcctgccttagaagaatctccggcgccttccgctcgcaggactccgcctgctgctagagaaacagaaacgtcgagaagcagaagcgctctctagagagtcacaggtgtggtggatttttccagagctatttgtgggctgtgggctgtgggctgcgggctctgggcttattagcgaggaaaaggtgatggaaaagcacgacccatataaaaaaaagagcctttccactagcccgaagtgcgcacaaaagttgactgatcgattaaaattttgcaggcgactgcaaaatagcaaatgcgatatatatatatgcactgcctgcaacatgctacactcatctcctgcaattttccgtatagtttgctacgaagaacactcgccttaaggacgcctagctagcagtctcgttgctgtaagcctagttcattgatctctcagtgctaaccaagctttgttcaaacgattgttcgtgtaatcgtctacggcgacgattctgaaacgtatgtaatgccatgactgggtccttaattttaactgtacctaactgtacaatgggccaaatgccccatataaatccttgcgtcaaatcttaaatagctgaaactaattaataaattagtgtggccacagtagttttcaaatacactttattgcaagtttgcaaccaacatacagcaggggcagacacagagttgctagcaaagaccatatatataagaaagcagccatggacagacatacacatgggcggctgtttctgagttgggaagcgtctcagctttgttataagtaggcagtcctacaggcagcttgacatgttcgctaatacacatgcttggttacactcgcaacccagtattcaagttaggaacgagaggcgtcgggatattgggagtctcattttctcgtcaactaggcacgggactcgttggttctcctgcttcaagtaatctgtaggggagcttcatatcccggtattctgtggcttttattgccgttcacgaggctgggccaaggatgcatcaagtttcggagatgactatctctggactaacttgatcagaacagcattggatcaagcacattgcagtgcgctggtagagcggtgcttgcgcatcagtttctgtaggctctgtcagagaccaacaaggatgttgagacagattgtaaacacatgtgagtaataaacgttgagataagcccttccttgatctttctggtgtccatttttgtccacactcacggtatcgttgcacaaaaaaaataatgttgcaagtcggcaaaaacagagttggcagagtgacgagcagagtgtgaattgtgtggtattgagtttcccactgggaaaattttgataatttgacacttttttcgttgcccaattgctttaattgacatttgtgtggatgtcattcgtgtatgactatgtcaaataataaaaataatttaaaagagtgttaaattatcaaatctctcccccactggagacactgctgctgagttacggtaaggcaagatccacatgtgtgtatatttcagcagtaagtaatcaaagggtattggccatagccaatcatcagatcttaattttgttacaagctaagagctgtgaacaggggacatcgccccgtagatcttcgatgtccatgtggtgttaagtcggtagttctggtcggctgtttaattagcgtattaattacaatggctttatgtcgtatgtagataggttagctctttaatttgtaagatcaatactgagacatactcatacacgagaacataatagcagtttattaaaatcaattttacagtacttgtggagttatcatgagacaccattttttctattacaaatttggtacctaggtactatgaggtatcaatttttacactaaattttggtatctcatgatatctcaaggattgtaaaatttctctatttcaaaagggtgagtgttttatgttctgtctaatttcgtgttaaaaatagcccaaattaggggggccttttcttttctggtttatattagttgtatctatttttgggagcaaaaccacttgaatatctaccactggtggagaaatccatctttcgtcggtcggccgaattccacaatagtcccggatgcaataaaaaccggggctaaaaataatctttagtctcggttaaaaagggtaacgggcatatttgatctttagtcccggttggtaacaccaaccgggactaaagaatgctgtcggggcctgtcaggtccccccgggatcaaccaaccgggactaaagatcgtaactttagtaccggttggtagactaaagatcccggggatctttagccccggttggtaacatcaaccgggactaaagtcccacccctatatatatgtcttcttcctcctccagctgcccgagcaaacttcaaaatttcttcaaaaaagaggggaggtcatgccaaaatttctagtgaatttattttggtgattacatataaatcggaggtgcctaaaaggtttgcaacttcatcctccaatgttttttttgtcatattacatttgtagctatgttttgcacgcttttttgtctccaaaattttgttgtaagttgatgagggagaaaa

SEQ ID NO: 79468 - DNA, 7946 bp, Oryza sativa
cagtcttcctaagctagttggagagcatccagagcttgtacgagttgctttgatagtgacgaataacatgagtagatttgctatcttcggaagacctgaacatgtgtacgtgcttgtgttctttcttattccccgagcacatctggacacgccgtcagcatctagaaccgtacccctggttgatcccgatttatgatttttcacgtttgtcggtgttaatactggtttaaaattaaccaagactaaaaaatggaccgataaaacaaacaccaaaattaaccttaggattaaaattttaaaattcaaaatttgattgtatgtaaattgcaagctaaggtacaagggaaatccaactgaactactatattgttcaaactgagtttattataaactactctatccatcttaaaatataagtattcatagtattcaacaaaattaattttagggtattgccttcttcaccgactatacctgaactggccctcatttaactttttacccaattaattttaccttaaaccccaatcccactcgaattgaatgacaaagggagtaactaatactacataatcgaaggtctcccataaaacgagccacagagatattatatcaaaatcattaccatgactaagcatatactgaacatgattgcatatatatactccatatatggaattaattgaacattagtgttattcatgcgcgattagatagaacttagggccatgctaattggctgctagctagctaaatagagctagagttagctactaattacctactagctgtttgcagcaagctgatagtgcaaccttagctactagagctagtggccttgcatgtgttgatcatcatctttactctggaatatgcatatccagctaacaataatgcatatgcattgcgtacatttgatgcatggctaacacaacgatcgatcgacgccgctcctactcgatcgtttcaccaatgaataattcatgatcagtttggctctttcttccaagccttttaatactatagcatgtagtatgagtaagagctactttctgcaaacccaagctcatggaccatgcgtgtactttatgttgcagtgttgcagctaattactatgtctgtttctctattgattttttaaataaagtttaaacatttgtcttatctaaaatttttgtgtaaatatacaaacatttaagtcatacttaaatacttaaagaacatttaacgataaacacaataaatgataattacataatttttttaataagatgaattgttaaatgtatctaagaagtcaacagcgtcatacattaaaaaagatagagtagttgatatagactagtacttcaaaattgaagtatagcaactacaaaaatccaagctgcattgcattccgcgcattcatccgccgaccgatcgatcgatcagcagtgatgggatgcaacatgggacctcttgcttgatgaacaataatatgatcatcatacgccggtgccactacttcttatcgtatacacactcgtccataaattaataattttcatcagactagtatataccgagttgtatgtatgtgtatgctgcctgattaaaaaggctgtcgtttcggacacaggtcaaactttcaaagttaagcaacaaattaataatatatatttataaatatttggaatattgcacacattcttaaagtcccaagcctccgaggtaggttcatatgctatggacttgatcacttgattagaggaacttcatcccaaatattacatactcaccgttgaattcttctttacaaaattcttatctagattccaagactaggtaagtacatagttaaaataaaatatagtacttcccccgtttcacaatgtaagtcattctaacattttatatatttatattgatgttaatgaatttagacatatataactatttagattcacttttgcttccacccttatgttatgatgcgattaaccaccgcatctacttgagagaggatcaaatacacaagcgtttcattccaaccaaatattccagataacagataacggggggatgagggagtcgaatcattttttgaggtgatctcggtgagagcactcccattagatttgaagtgccggccattgactagacgaagaggaaggaccaatttgatcttgaccaacaactcgtgccatgccaatgcttgtaaaaactgctaccgatcgagcttgatctcatgcctggattgattgaaaccagctaattaaacacgtgcaatataattcagactctttaaccgatccaaatcttggcattgtacatgtaatagtacaaaatatgcatggcagatgcatgctctggttggccacatgatcgtcgcgaaacgtgtgatggacgtacggcgatcgggtgagatgggatccccacatgcatatcatcaccgcttcatccgcctccttctttgtcctcatcttaagctaagctaaactgagaccatagagcttaataattgatcaactatatatacatctatccagtgattagtagttcttgttgttgccagttgccttctcttcagatagatagcgagatttgatcgatagatcgagataatgattaacttgtacatgcaggtgatcgatgcgtcctactactagtagttaatttctccaagctattttcaattcaaagaaatagtttcagcctctgaataatggaagcaagcggatcaacctgatcaagacgattaattgcatcataatcaacagagagttatttaagagctagctatttttaggccttatccgtaggctgccttcacatatatctctacacatcgagataacaatttttacagacaactaaaatacattaatatttgtgtagagatggtagaaccaatcgtctcttaaaataacacatgaaaattatacgtctccagtttttttttcacgtgaaagtaaccagatatatagcttgtttatttctagctatttaagttcatattaaatcattactctagtttactaatatattgacgtacaattcttttgcacgttcgggaaaagaatcttactctagtttagtttacttagtaattaaataattagataattaatatgtcgagacttctggtaatttttattctagtttctccactgaccagcgccatatgaaaaacaatttccaactacgatcggcttaatgccatctcgagcgaaaaccatctccacatgtgggcccttatgccagccgttgccacatatatttctttcatcccataaaaaatcaaaatagaatacaaaagcacatccaaattcactatattaagatatgttatatccaatcctatgcttcttttatagagggagtacataagaccacatgagttgcttgtttacactgataccttgtaagttgtaatgtaagttcatgcagcttagttgcaagatatatttgatagcgcagtgaaaaggggtgtgtggttttaaccttgagatcacgtgtttaatatttaacacgcttataatttttttagaaaaaaaaatatttggagagacgattctccctcgtttttatgcagctcagctgccagctcgatcgactcgaccagcttatgcattcagagatggacgatggctggccgtcatggggtcctcctgcagctgggcatggtggttgcgtcgttgcgagcattcgatccgatggggacgacacattgcgccgctagggcccccggatcgatcactgttcatcgacgtctcgtcggcacctaccaatcatcatcatcatccatcacacattcattttcgcagcaaatctctgaataattcagcagcagctcgatccatccatcagatcgcaggatgaagcatgtcatcgatcctgaatttagcctgacgagactgcatttctgtttcatccatactactatatgcaccggcgaaaactatgcaccgtgtacagtgtacagcgtagaattcagagttcagagtctcgtatcctctcactgggtgttaactgaagaatgttctcttgcagtgatagtattagttgttggcatgaacagctaggagtaattaatagagatatgacgagactgcatttctgtttcatccatgcaccgtgtacagcttagaattcagaatttagagttcagagtctcttttcccacaaattttgacaatttgaccctttgcaaaaaactatttttacaaataaaccgccgccaaaacttatttcaaatctgacccttttactcaacgccaaatcgtgtggcgctgaatttagacacctcagcgccaaatagcatggcgctgaatgtacgttggcacgctgacttagtctcccatccgcatggcacggcattcagcgccagctgacgtggcgctgaggtgtctaagttcaacgccacatgatttggcgttgagcaaaagggtcagatttgaaataagttttggcagcggttcatttgtaaaaatagtttttgcagagggtcaaattgtcaaaatttgtgcctcccacaggatgttaaccgaagaatgttctcttgcatatacagtgatattaactgttggaatgaagaattaggagtataattaattaatagagatatgactgagatgttatccactctgacgacaaatcatcaggaatctgtcaaataaagcggccggctatcctgatgaaccctagaagattttcgtcgctggaattgaatctccgggcactttgatcagcaaaacctgatgtgatgccaaaacgagcaccttgtcggctccgcggtttatgcgattggacatcactcacgcttgatagatgagataatgcgtatgctttcattagttgttgtactgcagtacaatttctactcagtcatgatatcattatgaatgaagctttgcattgtccaagttttttttttttgcagataaatgcatttgttaagaccagtgcgaccgatctgaggacaagaattattgcccattgacattgcgaatggtagtgggcaaacataattaaatgtttgttttttacaaaaatatcatacaataattttaattagttcatccttacagctcatgttgcctttttttttgtttttactgtttggcaaaagaattgcacgttactatattagggttttgttgtttatactaaatatgttcatgagtattttagggcctgttcactttgatgccatttttaaccttactaaattttagtaatgttgccaaaaagtagtttgctgcaaatttttggtaactacataacaaatcctgctaaaattttggcaagacaatgtcaaaatttggtaaggttgaaaatggcaacaaagcgaacatgcctttaaacttttcaatagtttacgcttttcgtctttttgttttaaaatatagtaacatagaacacgcaattagacatcagctaccattacaaaagatatattagaacaaaggacatctttactctctctatctattatattattaaaacagctttgaaagaaggcaccacgttcgctgtggaagttagaaatttccacattaatcagtgaaaaagaaaaaaaaagaagagtccaagtagaagtacaatctaaaaatagttaaaattaggaattaaaaataagcaatattgaaacaagttttcatataggaacccaatacgagattaatcaagattcaaaataaaaataaaataaaatccaaaattagaaaaggaaaggagagtccaagtataaatacaattaaaaatagctgaaattcagaattaaaaataagcaatgttgaaagaagttttcatataagaacccaatacgagattaatcaaaattcgaaataaaaataaaataaaatctaaaattagaaaaggaaagaagagtctaagtagtatacaatttaaaaatagctgaaattcggagttaaaaataagaaatattaaaagaagagtccatataagaacccaatacgagattaattaaaattcagaataaaaataaaaataaatctgaaattagcaaaagaaaataaaagacgagttcaagtaggaatacaatttaaaattagctgaaattcggaattaaaaataagcaatattaaaagaagaatctatataagaacccaatacgagattaattaaaatttagaataaaaataaaataatatctaaaattagaaaaattaaaagagagttcaagtaggagtacaattttgaaacaactgaaattgaaaataaaacattaaaacattaaaataacacaatacgatattaactaatttttttttaaaaaaatctgaaattagaaaaagaaaaataagatttcaattaggcatacaatttataaataactaaaatttgtgataaaaataaagattattgaaagaaaagaccatctaaaacacatgacgagataaattaagtaacatgcctataaaggagtagagtggtggcggttgatacgatatatagaaattgttaataaaacactaaataaaatcctaatgacgattaaaaggagggacatcaggcaggccgtaaagcaaacgagtaaggcggtgccgggacttctagaaagtaaaaaaaaacccattgataatcatattcattttttaaaatctcaatgacaataaaaaggagaagcagcgggcgggatgtataagagtatagttacagagccaccgacggttgacgggacttctagaaaataaaaaatgaattccaacgatagttatattcaatctttagaatcacaatgacaataaatagttggcggcggacgggctatagaggggcatagtggcatcgtttgatgggacatctaaaaattataaaaaataaaactacaagtccaatttttaaaggtttaaaacttctaaaaagtaaaaaaaaacaatgataatcatgttcaattttaaaatctcaatgacaataaaaaagggaggcagcgggcgagccgcagaggagtacgatggtaaagctgctgacggtttggcgagacttctagaaagtaaaaaaatgaacccaaacgataattatgttcgatttttaaaatctcaatgacaacaaagagaagagatagtggacgggccgtagaggagtataatggcaacgtttgacaggacatctagaaattataaaaatgaaatccaacgactctaaaagctataaaatccaatttttaaaggttgcaagaagaatgaatagaaatagtggtagatcgagcaagcaaataaagaaggagatgacataaggggtagcaactggtgtgacttttaaaaactacataattataaacacgaggatgataagatttggaatttcaaagtctcatgacaatgagatagccagatagctattttataaattttaagtaaaatcatactaaaaaatattatgattttgtttgggtgctagccgcgcaattacgcgggccagccagctagttaattatataatataacaatataaaacacggaattgacattgtggaacataggggtcggagtctcgaaggtggctacagaggggaaggcaaaaggcccaccaactgcacggcccaatacctgaccaatcgaaacccaacaggccaacactgcgggcaatcccgttccggcccaacttaaatgggccgtccgtaccacggcggagctccggcgagctgccacggcggacgcggagggattcttcgggatcgcagaatgttgggatcgtacgttttcctagtactgaattcaaacaattctcttgaatctgatccaaattcatctctatttcagttgaaaactgatttctacagtacagcaacagagtacacggggtgaaaagatttcccaatttcaccaccacatcaccgggctcgcctgcccgatcgccggcagctgctgctgcggcggcggcatgcagtgctgcggccaccgccggaacaggtacccctcgccgcagccggccgcggcacc

SEQ ID NO: 79469 - DNA, 6929 bp, Oryza sativa
ttatagctggctaatagcctgctattcgctcttagagtaagcccgtgccttttggctgcccacctggaccaatcggaaacagaaagggcaaaaaaaaactccccgaaaaaggtcggagtagttgtagctttcggtcttttgttcactttctctctcgttttcctttgacacaatttttaaactactgatggccctttgatttagagaagaaaaacatagaaattttgaaggattttaattctataaaaaattttcctatgaaaacctttaaaacaaaggattgaattctatgttatcatttaaaattcatataaaatggataatcctatagagattttggagaaaatttagcaagaactctaacctcttgaaaatttttcttcgagtctatctctctcatccgattcctatgtttttcatgagcttcaatcaaacggtcattcctatatttttcctatattttgcaattgcatttctattagaatcttgtggtttttctattcctctatgtttgtattcctacgattcaaatgggcgctaaacgatgtgtgttttaaaaaattaacgaaaaatacttttaaaaatcatattaattcatttatttttttagtaaatatttaattaattatgcgctaatgaacaatatcgttttccacgaaggaggtggagttcacctcccgaacacaaccttcgtcaggaagggagcggtgcagaaacggaaaccatgagaagaagcaggaggaaatttgttcctcgttcgatcctgacgaaatttgcccggaatccatttgaatccatgaggttttcaagtttcgggcgacagttttctgaaacttcgttgtctgaagcagtatttttgtagggctggcgattggtgcagggaaatagtagtggcaagggaaattttgccaggtttgtctagttctgaagtagtttgggacttgggatcaaggtgctataaattgcgagagctactggatgaaagtgacgatacatcgaacggtggcccagtgctgaaaaagggcgaaagcaaccagtagaagataggcaagggaatgaaacagccgatgtgtataatccccaagtggtccttgggtttgtgctgttgttcaatccaagtccttgaccacctagctttaacatgatttaaattcattggtgcaacttaaatataagctaggtggtgtccgtgttttgctgcgaaaattacaaagcaatcttcagaatgtttttttttccaacaatcaagctaggagtccaaacgatattagttattaacaataaattaaactggtttaccaagctatgtttggagagaaataaatttagtagattatataggagattgtagatgaaatgttatattgttggctaaaattcgcattgcaagaagcagaagatagaaaaaaattaatgaaacatcagggtttatcaataatgatcataaaacaaacaaatgatactcacactttgatacaaaatatattgacatgtatatgttttaagtattatgttgaaatattatggaaatgatgtgagtggtgatgaaaggatatgtttgcatgttgattaagggtgtgtttagttccacgctaaaattggaagtttgactaaaattgaaagtttgaagaaaaaagttaaaagtttatgtgcgtagaaaagttttgatgtgatggaaaagttgaaagtttgaagagaaaattgggaactaaactcagcctaatttgtagaattcaatagattgtagattatgttacatgcttacataaggtttgatatgtaattattattagtgaataatgatgtgacacggatacatgttgagtttagtatatgttaactatcctagcccctattatcaatggcccctatggcagcgtcccagtcagcatgaacagtcatacacatacgaggaattaacgagctgtagcttctgaacaggcacaatcttatctcattttaattcacttatatgcatatttttttgccatcacattgcaacgtccaaacttcaaacagtacgtggcaccaactaacagaggtgatgtgcatctcacccaaaaaagaaagtgagattgatgctttaaaattgaggccaaataattggattcgtcgtgatatagtcaaattctagaaactacttttaagccaaatggaacattcttagctccatcgtgcaaaacttggttcgtgttacatcaaacccttggacaaaaaatgttgaatttctcgtccatccagaactttataccttgagtaaactatgctcacaatacatatacttacgtggtgattataaataaatactcgtaagtatcaccttgtaaattgctagttctggtacaataacttatctaatccgtgcaagcgtgtgccgaaacaatcaagggaagcaaattaatttcatataacatggcgcaccctgataacgcctttgcatgctccggatgtttgtagttgtgtagacctgcgcacgctagtttaatttcagttttgtagaacttagcagttaacagtaataattttgttgcaatcttttgcaggtgcttccactactggagtacttttttaaaaaaaaaaaaacaaaacaactgctagcttgcattgctgatcaatttttcatgtgcgatttgttttgtatcaggttcacatggacgtactactatacgcaagttattctatccgaataatcaacttgtaagttgttgttgtacatattagcatccatcctgcaagttcattcgagtgtatgtattaacaagtacttgtctaaatctttagttagaaataaagtttgtgtgggagtgggacagagtaattactgccggtggtgtttgaatctcctgaagatgaatataaaaatgaagattaagtgttttacgtaaaacgagatagtaataacgtgtgattaattaagttttaattattacaaacttgaaaaatggattaatctgatattttagaaaaactttcatataaaaaattttcacacgaaacacactgtttagtggtttaaaaaacgtgccataaaaatccaaatcttaatccaacctttccagaggaaatgaacggggccgacacagaattatcctaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttataagtagtctatatttaatactctaaattagtgtctaaagacagggactaaagttaagtccctggatctaaacaccacctaagtactccgtgctggcagaaatgttaaatttatttatcactgacagcctaaaaacactacaagtataaataaggagtacatttaatagtattaaaagtactcgtatttatacaggaaatggaaaatgggcccagctgtcatcgtaggttttccttcggcgtacgcccgcgaatctcccgccgggtataaatagcggcccggaacccacccaaactcccaaattccaatccggtccctcgcctcgcctcgcgtctcctcctcctcctccttcccctccccgcctccaatttcttcctactcctcccgcctccccgcgaagcttccccacgcctcagccgccaatccagccctagtgtggcggcggcggcggcggcttctaaaagccctcctcttcccggactccaggatggcggcggtggcgggtagcgcgagcgcaggcgccaacggttcggcggcggcgcatcgggtgggggcgccgacgaaccccatggcgacggcgctgctcaccgatcagtaccagttctccatggcctacgcctactggaaggccggcaagcacgccgaccgagccgtgtgagcgctccctctccttctcctcctccttctccgacgtctctctctcgttggggccgcgccgattggattggatcgggaggcggcggtgatctaggggagagttggtgcgctgaggttgttggggttatggattgggagagagagagagagagagagacagagagagagagagaggtgggattttacggggagatttttcacctcctgcgattctcgcggtgtacatgattgcattctctcctcttgcggctgccaatccgatggtttcctcccacctcccgttctgttcagatcgttttatttttatttatttacttattttgttttcgtagagttgttttttttcttcaaagttcatattgtttttttttttttgctgagatgtagtactgatttagtgcacggtaatctggtggttaacctgtactgctctgagctggcaccctggttttttgcttcgggaagctctcccctccttgtgcagtttttaatcatctctgccttgtcactttgtcagaggtctaagattctcactatttctattgcatatactacttgaaatatgatgtcactattgttgaaacgatttaggaatagttgtgtgtggctctcctttttttttttgggtttatattcgtgtatttcttcaagttgtgtgttggacctttttaatgttgctttcagtggccgactttgtatttgctggaagccatttttcagtttgtaccggtttatttataatcgcgtaatgccaaagttggattcgagttgtctttcaattgtttggagtttgagcaattgagctggttccacgtgggccctcgatattatactctgttgataaacctggaatttaatattgtttatctcgacgtagttccaaagctggtgttccttgtgattatcggtgaagtacatatcaattacttcttgtgatgaaccacaacatacagcatgtcatacagccagcaccgtccatgagttttagtgtgtaggtggagcactttctatatggtgtaatgctatttaataacggttcagatggagccaaatggaatggaaaatctggatgattttaagtagatttaatgtgcttcgctacttgagtaaacaaatcagattgttggttcttgggtttcttattttaattgatttggctgttatctgttgtcttattcatttattttttaatataaaaagtgatgtgagtttgaggattcttgttcagaagctgggaaggttacaaaacgtagcgtttttattgaaagaatattctgttagttacgctgaaatcttgagttcgcctctgagtcacacttttgtatatttgctgggaacaacatgaaaatgcaaaatttgggagttgtcaaaactacatatgaatattgatacaaaagagtcaactttggaataaagataatgttgctctatatttgtattgcatgtgataattgtctatgatgtctaatgatttttcctaaactaatggcatatatgtttctgaatcactacgctatgggacatgctttatggttatacttattactatcacatttttggataattatcctttgtttttttagttttgtgtgtgagagaggtggggtgtaatccaaaaaaacactaaagactaaggaacatgtcactgtgtgaaatgcatttttctcaagttctgtttttatggatttgagcatttctctggggtatgctatgtctttggttttaggtacttgggatttatgtcgactgattcagaatctaccaactaatttacagactcagaatctaccagctaatttatagattcagtagtaatgcagatgcattagctgattgtgtattccattggaacttgaaaagtactttggcataacacagaaccacttctcttcaagttactaaaagcagatttaatttaatgtgctagctctttagatatattgagttacctttttatgtccttttgatacagaaccacttcttttaagttactaaaaagcagttttgtctaaaaatgttgtatagagcaatcacatgtgttttttcgttgtgcactattagtgtaccgttaatcataaacacttttttttgtctagttcatcttggaagttggaagtaatacttctctgttaaattattgactgaatggaccagtttcagtaaatgctgaactatggatggagagagcctatttctttagatacaaggcttgttttggatgggcattaggattaagaaggatatgaaaccaagagaaagtgaagacaaatgaccatgtgttaacacttaaatatcttgggaatgagtgagagagagagaatagctggtgaggctgaggacattacttataaatgtaggtcagagaagatgtgctaaatagaggtgttaaacatcaataaatttgcatgcgttccttatattttgtaaggatcttaagaaactatgggccttgtgttttgaaaagcagggaatgtaactagcatttcatacattggtcgacctcatgctgacctggttccatttctttttataggtttgatctgtacttcaggaaaaatccatttggtggagaattcactgtttttgctggtcttgaagaatgcattaagttcattgcaaattttaagttcacagaagatgacattttgttcctgcaatcagtcatgccaatgtgtgaggtaagctgttacataaaattatctttctgtcttaaagtggcatatggttctgatataagctgctatactatctaaaatcctattaatttgccatatttatagaaaggcttgttagcatagtctacaaaaacattgccatttcaaatgtcagatctttaatgtatcacttgttagttgtttgccatgataaatgttcatttactgatgtgatatgcgattctaggatgcgttctttgattatctca

SEQ ID NO: 79470 - DNA, 31475 bp, Oryza sativa
gatccaacggtagtttctaagtttccactatatatatggtttgcactacatattttccccggttttccgatcaagttcaaaaatgatcaaattgaattttaaatttttgacaagatttgtttggatctccttggattttgttggcttatcgacggtttccatgaaatctgaagatatagttcatgagcggtttttcatccgatattggatcaattgtgaaccgtagtcaatctggtcatttgaaatcaaatccggagacccaaattgatgtcaatctaggccatttgaaacatttcgacctaaaggcctcgagtggctggcccaccttcaaatttagatgtagtaaccaataatgcacataaacgcctataaaaatgtgaacacgtacatacgatgagtccgtctggttttccacttcccaatggcatcaatcttaacgacaatgcctccttccatcccctctttttcttagacagtcatttctccctatatcttcagttcaaccatgtatgtaagttgttgatttgcttgatctcacgtctccttttccaacaatctcataattcccttttctcgaacaaacatgaggcgaataatttcaccgcacggttgatgcacgaaactatggtgtataactagctaggcaaaggaggtattcggaatggttggaggcaacttatgacgaccatcgaccgatccgctgaaacaagaacgacaacaactaacgaggttggcgcagcggagaaaggtgagggccatgtgactcaatcacccggcgaagtaatgatgctatgaaggagtctggtgaagaggtacatggcaaagccagggccacgcgaatcttggtgatgcgatgaagcgaaatacctggtggcgaagcaaatgcaccaagtggcaaagcaggctcggctccgtcatgccaaaaccaggggaaaccatcgaccaaccagctaggccaaaagacaattgctatcctcataaatgtctccatcagagggacaaccatattaactcactagcacatcaaactatagggttgtaaatctggccagtaaacctataaatagaccttaatggcggtttaacggagaatccaaattttcaattacaccatacttattatttttcaattccttccacttagagtagagcatgtctttcggcagaggtgttcgtaattcgaccacgggaatctcatggcatatcatttgctcatcaaatggcccgggtttacaaaacttggtgtagtagcagaacgcttgccaaagtgacttccaggtaattatggtaccgatgagctgctgttcaccaattacatggatccaagatcccgcctcgccagtggggatgagttcacctcgtcctcactgatcatgatgggtcgtcggcgttccaacagtgcgttcatcagcagttgctcagagtaaattaaaggaagtgcagacctagctatacgatgctatatacgtatatatatatatagctattctaattcgttttaattagtaagtcctacaggaaccatccgccagcgtaataagctgttgtacttgtaaagaaaacgtagaatattaaagattggatagcaaaagctccatctctctcctctcaatctcaccagtgcggtaatggcccaggcggtaccaacttcacacatatataatgtactcctagctactagcacatgacactaattatgacatggaattaatttttcagggtttcttctaaactactggtaactgcgagagccggtacaataacggactatgaatcagctataaaactttctgatgaatagcgtacttaactagttattttccccgggcaaaactgcaaaattccatacgtacttcatctatctatttatgccacactaatacagttcttaacaaaatcatgtgtatatgctttgacaaaataacctttgagatgcattctgaaaaataataataaaaaagaaccctttgagatgcaagtaagcacctagctgcagaaaattaatgaccaaggtgttttgtgcgtacatgtattatttactactaggcatattctgagtatattattgcacgtacacagcagttaagttttttttttcccatggactatatatgaggaaccatggccttatctgttctgtgtcaagggtctccacacagggtaaaaaccaaaaccacaaatacttgatcttggtgctctgagtgaatcaaagtactatttgttgatgagatatcccatgaaacccaacataatgttgaataagccatatgggtttgggaggcctcaagaacttacctatatatgccgaaattcacatcagatgttagagaatcgatgacagttgcccagcatcgcttaatcttcttccgtgcattccttctctttgctctacaagataattttacatggtaaatctaccatgtgatatgacagccatcttgatcgcaactgcaagctgatggtatctcatgcaatgtgagatcattagttgtagatgaacaggttaatggtcagcagttcttcacaacatgtattttccttacaggaagaaactttgcagttaattagtatcagtattgcagtatcaaaacaaagcatacaacaaaattttgcaaaatagaaattcatatcctaaatgaagagaccaaaatgaaaagtttttcctcttgtcatagtacggttttaaatagtttaaattgataaaattaaactaaaacaaaaaccaagcaaaacaaaaaaaaacaatgaagagcgtggtattacacgatttcattcccgtgatgatggcattcattgcatataaatgggataaaaaaatgcatcaatgaccaaagtctaaaactccaattttcccctccaaggtgtcttactcaattgttttccccttctagtgtttacatacccatacttgaggatggctctcaaacctaataggattccctcacacatcttttccctaccaaataaaaccctatcacattgccggttacaaaatgctcgttgctgccgatttggaactggcattgttgctcgaatgctatcgctactggtccaaagaaacaacaatatatagtgcttctagaaaaaaaaacaccgttgtctctctaactcgcagcagcaccacatcaacgtaccaatggccatgcccgtcatcatcatttgcagcaactagcacccaaaatctgttgccatcttttcccacaccaattaagctagagaagctagatcgatagccccgaggtcggaccggtcagatctggcaaacaagagcttggtccagctacaactgacctagcttgttccctgtaaaattaaatcatgatataatggtctgaaataaatcctagaagcctaaacatcaattggcaattttgacctttggagccgaaggatttgagtggcttatatttgtccagaattgcataggtgtactctaacatgtgggacagagttcatgtggatccccatcatcatcatgatgggatgagattaatttgctccatcctgcctagctagatccaacgatcagaaacgatttggtactatgaggtaccggtacctcgaagtactttttgttgaacatgagtaaatctcatttgcaatagaggctttagaatgcaggccatccatcaattggggcagcagctttatgcaccatgaaaaggacaacaacgagctctatgtaggcctggatcttcatacaagtagtatagagtgcaccttcttaattccttttctgttcggctctccctctccataaaatttattacttccaatcttcaggttcttcgtctcccgttcttgacctcacttctctcattacaacttgctcaaatctgcctctcttcttgaagtaatattaggcataaaatttgaccacaccaatggatgcaagaggtgatatagtatgtgggcatgggaggtgtagggaatggcaccctcatcaagcaagcgtgatgcatctttcatcagtgatctcaccaaggttgcaatccaacagtgtttacatgaagctgttcgccgcctgcaccccagtatatacatagaggtttacttttaccatgcacgtatggtgccctgtcgttcggagatggttcacttcttgagttgcatgaatcgcagaatggaaagcgtatatagtctatgcagttgaggttttgttcatttggcacggtataataaatgagtgggattatcctatgctgacaaaacaaagccttagtttagtgtaggagttatgtagtggatccacaagctgtcaagagctgaagtttcagacgttcaaaaatggatccagagttagggtttgaattcatcttgacacaaacgtgggctgaattattaacttgtgctacctgtaccaaaatttcatttgtatatcacggtgacaattgtcatttctttaattttgacctcaaacgaacaaatgctaactaaaggacagatcaatcatcgcataggataaacaatctgttgaaacatagcaagtggagtagtgtctgggtattctacctctgattgggaggtgctgattagtgtagggccaacatgcatgggagcatttctatcatggtgagagatgtgtttatatgcagccaaacaccagcatgcatatatctctcaactgcgatatctaggcatgagagatgttgggaatttcacggcctcatgcagtcatgtcctgatccataagctacgggaaggaagaatctgtttgtagcataatttgactaatatttagttttatttgggtaagccacattatttagtttagttgtctagatttatcgagtggttagttaaatgtgtgtggattgctgggaggcttagcagtgatacttgtgacatagagatactatgggtcagctaagtttaaccacattcaaggaaggtttttgcgatggtactatttgcatgtacattagagagtgaagacctgtgcagttggttacttggttgctggtgaaaatttgctgcagtccaggatccttttggggctgatgatcatattcgtgcagtggagaagtctatagcgtgctgctacttgactcttctcttaaccgcttgcatgcgttggtgtgcggctgcgtgaaagatgcagctgtgacgtcggattgtaaacgatacggcatgattagagcgtgcagctgctaggaagatagagatatatattttccatcttatcagtttgtttcctttgtttgaacgttgctactttttgtgttagaccgatgaccatgctacccgtgtgtgtatatatatatatatgccggtgtacggttaattgaggatgccgaacaaattattaatctactattttcctattctttactttcctgttattttcttttttttttgtttttatggctgagttctagcaacataagtgtttggttaatctttaccgttttgcgttgaaaaacggtcgtgcttctctacgaaaacgagaaggttattatcctttgcaaacattgctaggaaactagtcatttgttgttacgtaagtacgatattatcttcttggctaattttctcgtaaattagtcgtgtttggttctacgaaagtgaattaatctcaaagtcggtttagttggccggttttgatttattgattttggtgactctgttgattacaccgtacatcgttagatgatcttgtgttgaccacgaaataatgtcaacggaatatttttcactaattggcttctacacactctcgcaatcccaatggctttgtggcagatgccacacatttcttgccacagagaatattgaggatcattagggaaaaatatttaattgatgatttggttgttttgcactattttgttagtggcatacgcaatgttttaatttggtggtttttgcttcgtataaagggttaatccgggatattattagggatggcaacggggcagggcgggcgcgtgttgggctggaatgaccccacccctgacccccaactctccacctggccccggctccgagtggacatgcggggccaaatcaggccctgccactggcccctacggggccccgcaacctgacatgggccccgcattgagtagcaattccatcgaattgccgtgcgtctcagcgtttgtccatgcacgccgctcgctccctgtgcttgcgctgtgcctgtgcactgccgccgcgtctctgtggcaccgctgcaactctgtaccgcgctgctaccggaagagactaagagaggggcgtgcgacgggagtccggaggggagaggaggggagggaactggggagagcggcgagcccacgagatctggcgaccggagagagccgggagagaacgggaggggactgcggagagggcgaccggagggttggggactccggggtcgcatgagtgtgtctgcgcctctgcgggctgcagctgtgtggtggcgtggggaacaaggtgtgaggggagccggggtggtctagttagggtaggttagggtttttttccttatatatgctgacttctactgttttactaagatgggcttcttgggcctataatgggctatattttaagaggtaatatacggggccccgcgggtggaatgtctcccgtcccctcacccgtcaaaatgcggggccccggcccagacggacccacggggcagaaatgtcccccacccccgccccttagtgttgcggggacccggctccgtggggaaattgccatccctgctattatagttgaagcataaggatttaaatataagcagaccaccacctaactatatttcaaacgtggtactaaataatcatcactacagccacgcctcacgcctggatcacttggtcctaaaccagaccacgtgaacacgtcaagtgcaattgatgagctatagtagatgttacgagatttactccggtccaataaaaagtacttcgaggtacctgtacctcacaataccaaatcatttcggatctttagatttagctgggtaggatggacattgttagatccaacgatcggaaatgatttggtaccgtgaggtatgggtacctcgagatactttttgttggaccagagcaaatctcatatgttatggatctttagaagaaagtaaatttccatcaaagccaatatctaaagctagtttacaaagtcctataagaattcggcttccatcggatggtctattcaaccaaagaaaaagccaaaatttgaattttcaaacttaattttgatattgattttgagatattttcaacgtagtttctttttcagcattggcttttaagtcaccgagaacacatatataaaagttttacctataaatttatttttattctctaataagccgttttggcttattaaaagaaaagccaaacgattgggcccttcgcctcctattccacaggagcatcttttctcctaaaaggatacatataccgaaggttgttgcctaatcgataggtgcatctaattttggaagaaacttaacacaattcatggtaaaaaaaaacagaatcacatgcagtaattgcgccgaaataaattctagcttattaaaggtggtataacactacaacagtgggttaatttggatataaagacttgcatatataatgagaaaattttcctatattctctgtggaaaactaggtgatgtacaaggaactttgctctccagctagacactatagcaaaagcatccaccttggtttcatttcgaacaaagatagctaagcatgcgaataggaggtgtcgggtatttctttcctaactagaaggagaacaaaggggcatgcattttgttgctttgcatctgcagatgaactatgcagattgtaccactaacaaataaaactatgaatttacccccaaagactttgctaaatgctaattcgttgtgatgggttctgtgaaatgcatgactatagataaaatataatagtcatacattccacaatacttggttttaattagtgaatcgaatgctcgagaaaatattttttttcatatatgacaaatctctctgtagtatttatttttcaataattgagcctttttatattagcttcttattgaaccaaacagtaagaaagataaaaaaaaagtgcataccattaggggtagagtcactcccataatgttagcatggatgtgcaactggtccagatgaaccccctgccacaccacgttcacttaaccatgtcaaagtaattggtgtggctaaagacttggctgtgttcttaatcacctcttaccaactttactctctcgtttttcactcgcatacttcctaaaccgctaaatggtgtatttttcttaaaaaaatctatataaaagttattgaaaaaaatcatattaatccatttttaagtttattttagctaatgattaattaatcatacacaattagattgttctaatttgcgtgcgtggatgattaattaaagttcccaactttcacctccgaatgcagtctcaaagaggttcaattccaaatcccttctgtgctatcgtactaaatattttattgaaaacattttaaaatatgaatgagttcactttaggtcctttaattggcatgaaaataagaaaaccacaaacactggccttgaaaagagtacttataaaggtagctcatattgagagagggatctgcactcacatacatatattttttttttactaagctcccatgcatatattatatatagagagaaggcgggtgcactgtggccttgtggggatgggaggcatgaggaactcaacaaagcgcagctgtcacatataatgctctcagcactgtcatgccataggaataacctcgcaagagcaaagcaggtgttatttcttggccgatcactaatggtagctgtggcttggcgggttttgatcgagcttgtaaagcgcagatatctttgagcaattttctcggcaattgagcgtacatcgtcgtccatttctcctgtcgacactggttgatactctctctagttcatattataagttgtttgattttttttttttgctagttaaacttgtttgagtttgactaagtttatagaaaaatatattactccaatactttgatattttagatgttgctaaattttactataaatttaatcaaacataaatataaaaaaagtcaaacgatatgacataaagggaacggaaggagtaggaccgaaggatatatagtatcagggaagagagagggaaatcaacatctaacacatgtatggaaactggacatgaccaaacatacgccgttcaacaaattcattaagctatccataagtgatttgcactaacgcatacatggcttgtaacattgtagaacgttcaactcttcaagtgttttaagacccatacagatcttaaggggagagcacacatatggaggaaagattggtttcatcagagaactaaaaatcatgtcctttataaattaaccatccattcgaagtttcggtgcaagttcagggtacaaattaaacatactgttaccacggggaactattttaaactctcaatgcatgggacatcccatcgttgtttgcatgtcatcaaaatagttaagaaaaaaattgaaaaaatttaacaagaatgattaatatgtgataaattacaccataaacatacaaggttaaatttaacttctataagttgcaacgaaaaaacaaatttaattgcgaatactcttgtatgtttgtggagtgatttattatatattaatttatcttgttgattttttttaaaaaaatttataaccatttatatgacatgaaaataacgaggggatatcccctcgagggtttagaatccactcccccgttattaccacaccccacgagtgatccggtcgatcaaagttgctctgttgccaagacgcgacgaggcatatttgttgaatgttgatcatattgcataagacaatatcatatatgggtagtcttatgaacttaattatctatgctgaattttactccatgtattgcttcaacattagaaagcctgttgaacgtacagcgtgcctttgcttatttattgatgaaaaatagggcgaactgggtattttagtggcaaataaggtaccagtacagtttcaaactgtaaaaccggtctgggatttttcacgtttgttaccacagtagtatatcattggtcaagcaagcatggacagaatacctgacacaagaagttaagaagtactcctaaaaacaaaaacaattgttcagactcacaagcagttcaggacatgtactagtctgtctgtgtccagggttcgtagccagaatttaactttttttgggacggaggggtatgtccttatcttttttaaaaaatatgcgtcaataattagcatttgttgcgtcagaattgacaagtctcaaaggaaatcggattagaaaaaattatatcaaactggcaggttgatgagatttgtagttatatagttgaagctttttcgtttgagtttaacatgccagaaaagcgttataagtggtgcaatctattttgaaatacaaattttagaattgttcaaaccaactcggatggtggctatatagaagtgatagaacgctaagagatatacatcttagagatatacatctttttcatttgaaatcatgtttctttttttgcgaggaatgtattaaatttttagacaagaagagtcaaaagaattgcaacaaagaaatagataataagtgtcacgccccgaactagccccgagcggaactagcccgtgacgctccaaattaacctgttaatcgataccagtcccaggaagcagtgctggtatcacaggaagacagaatatcacagcaacagaggtctctttattatagagtaggagtacagtcatgttgggctgcggacagatcccgagctcacaactgcatttcaaaagggaagcggaagccaagacttggaccaaacatcacaggcgtgacttgggaactaggccgaaaccctaaaactcatcgtagccgacttgctcctggaagaactcctcgtcggcgggatccgcttcatcttcttcagcaactgggggagggggaattatttatatagagcaagggtgagtacaggagtactcagcaagccatggggattaagtgtttaaatgtaggcttcaaggaaaggctgttgtttttgcaattgattttatttaaactcttttctgaaacaactaagtgagtgcttctcaaacgacacggatgggacagtgcgtctcgtccggtcggagtatgtgcaaggtatcagtcttttgaattgatcaaggttggcatccggccaacagctttcaaacggccacccgggtctggctgatcccatcagccgcagattttccaaacatcgaacccaaaccacatcagcaaatttcacaaagcagtagtcaaacaaaactacgctggaatcacctcacatccgcgcatgaccgtgggcacggctgttcgaacagtttaataacctctgtagagggggtacactttacccacacgacattactaacccggatcatccagctcgtgcagaacggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccacccatgtggtcgtacttgtcttatgttcggatgaaatttcaaggaaacggtccttaagtgcaagagcgggaaaccgtacacccggtacgttccccggtccacgattttttggaaattcatttagttcgcaagcaccgacccaggtgtcgggttttccaagtcttttaaaacccaagttttacccatggttggatattttatattttgaggggggtgttccgatgcgcatacccgaaggcccgtgcatcgaagcacaacagttaacaaaggaggtttaagtgttcaataattcaaggagggtaattgcagcaattaggattgggggccggtaggccgtctcgcaagccgcggccgaattacttgtgtaaatcctattcatgcaatatttgtggaaaagaaatacttagatttaaattataggtgcaagatgattgtcacgcctggaaattcactagtaatttccgaacttatttgtgcataaaatcctcgtccaggaatcagccgaggtacacaaactgacagtttaatatacaaatccatcataataataacgttagacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccttaacatcatgtctaccatgcgtcgcgatactagaaagtacccgaatagaggctgtgacaataccctctgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctctaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtacaaaaacaagcataaacagtacatgtggatatttttaacatgtagatctcgattttagatgaatttagcaacttgaaccactcaaaacagagttacgatgatttagttatgaatttttaaagattaaaccggattaaagcatttatatggattttaattgaattatgacgcaataatgaattacttttgaaaaggaaaaggaggattattgcgtcatcaaaggcagtccgggtgcatgggacggtctaaggaaacgaacggccgagatcgattctatccaaaacgggcggccgggatcaacttgatctaccgcggttcacgggacaaggcgacgatgacgtcagcggtgacgtcagcgatgacgtcagcaccggcgacagctcggcctcgcgcgctcgccggcgaacgacggcgcaacgacgcaaacggaggacaccaatgggtagaggacaacacggcgaactcaccggtgaccaaaaccacggcggaagagcaacggacggcgccgacgatgaggaagaagcggcgacggtcttcgggtcgacggtgacggcggtgctccggcggtcttcgacggcggcgaagcagtggacggggacggcgacgacctcgcgatcccgatggtggcgatggcgaccaacgacggcggctgcaacggcggcgcggcgcggctgaaccgacggcaacgacagcgacggctagggctacgcggaggcggcgctagacgctacggcgggctaaggcaaaggtgacggcggatagaggagagctcgggggtgcttttaaaggggctagcgagcggcgacggaggcccacggcgaccggcggcgagatggaaagctagggttggagggagaaaagtcgatccgaatcgagctcaaattcgtcgatttccaaacgaaattgaccgaagtttctataagagaaaaggaagagaagatcgaggagattatttcccctcaaacgatttcaccggaaacggaaaggatcgaccggattggaaagcggcggcggctagggtttcggccggcagcggcgcggggaggaagacgggcctgataggtggggcccacctgtcagcggctgagagagaggaggaaggggcgcggcggattgggccgactgggccggggagggagagagaaaaagagaggttttgggccggctttcggcccaaagccaaaagagacttttaaaaacctttttcaatttaaattattcatgaaatacttccttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttataatttaaggatttttaaacaagaaaagctcttaacacttataattagatcattaatgatcaaataattactgaactgttctttgtatcatttaggaattgagctccgaaaaatccgagaaaatttcagagagtagacttaatcatggagaatttaataaaaattaaatccatccatgctttatatttaggaaattttatttcccacatttaacttcacttgtaaattaatgaacatttaatataaattctaataatgatttattaaataatttataaatcctgaaataaaaatcaggatgtgacaatgatcaacggtgacttgccttgctcgagatcttgaacttcatcttcgaaatcctcgcactgcgggtcttcgggctccgaaactacacgggaaacgggacaactcaacaaacggtgaaaataaagccctattattgacctctaggcgtggcattagatagatctcgagatttgaggagttttggaagttgaacggagtcaaacggtcatacgattgggaagatattgaatttctaacattattggatttttggtctaaaggaaaaggatttatttaaatcctttttgaaatagaaaagaaaagaaaagaaggagggcgggaaattagactttccttgggcgggtagggcgcggcccgagagaaaggggcggcttggccgaacttaacgggccggccggcccgagaaggcggcccaaagcacacgcgcgggcggggaggagagaggaagccgatgggccgggtccaccttgcgtggtcccgggtgggacccgcttgtcggcggctcggctcaccatgagcgaggtgcacgcggggcgtgctagggtttggggaggggaggcgcggcgcatgcgcgtggttcgcggaggacgcggtgcggcgggcccacgcacagcctcacggctcgcagttaaccgcgcgcgcgggcagggctggagggagcggcggaccggggtcagcttgacccggtcgcggccgaggtggcgctgacgtggcacctacgtggctgccaggtagacgacgacgtcggccggaacggacggcggacggcggcggcaagcggtggagcgaaccacggcgatacaggcgaaagcgagcacaccgggaggttgcacgggacgaggggagacgagccaacggctcggattcgccaggggatgctcgacggcggcggattgcggcagcggcaaccggcggggagagaagggggaaacggcgacggcgcgacgggagaccgattcgggcgagctaaagcatctacgtgactccgggaatccgttgctagcgtcggattgggcggagctacgccgagcaaggccggcgacgagcgggcgctacagagcacgggcggcgacggcggcgagcacacagcgagcggcggcaacggtcggggcggcggcagctagctacggggaggctactcgtgctactacctaagtctaaggggaggagatggaacgaggaaggagaacggagggaggcactaccgtgcggggtgatggggcgcagtgacgaggggccgacggcacgggagtgatctctccggcctcgggccggggaagaggaagaagacgagcgcccggagtccccttccgcgtcctagcgcgcaccggctcctccggcacacgcgacggtggcggtcggcgagagagatagagggacggcaatggcgcgagcgaaaaatagggaagattgggatggaaaaaggaagggagggcgcctgggtttatagggtgacaatgtcggtttggaaaccgaccttgggcggtcaaggcgcgagctggcgcttggcgctcgcggccaaaacggcgacagaggcggatgacgccggcggggaagagaaaaggaaaaaggaagggagaaagggggcttgccccttgcctattcgggaaaggaaggagggagagagggcgatgaggaggagccctgcctcctttccttggaagcacgcgcggggagaggcggggccgagttgatgacgacggcgatgacggcgggggcggtttggaaaggagcggcgacacgggcggcaggcacgggctcaggcgcggcaggcactgacggcggcggcgaccaggcggtcggccaccacggcgtgcgcgcgtgggaagcaacgggcggcgcggcgatttgggcggcgtcagcgggaagcggcagcgagggcggagggcgctcggctcggcgcggctcacgcgcacgcacgcgcagcgcacgggcagagcgggggagagagagagagagatgggggggagggagagatgggccgagaggaattcggcccatcgaacccgagggaggcaaaatagacttttgcggagggatttgatttgggaaggataattgagattagggtttggatttggattcgggacttgaacttgacgatagatcggggatttgagatccggaatggcacggagactgactgcaagcgaggaaaattttttttcgcaattaaggtttttagaaattacattttcccgctaggcgccacgacggaacgggcgctacaataagttttctacaggtgagagggtaagaatattacgtgtggagcctaggttagaatcctaaaggctgcacatgcgttgagagtgtctattgagaaattgtgtgacttgtgatgcactattccttgtaaaatacaaaatattttttctgtgcttcttttagctcttataaaattttaaaaactcatataatgcttgttgtcggtcgtccggcgttgaacggaaaatcggacgccgacgccgacagttgtagaaataattttctctctcttcattctccttcccacgcatctactatatgctttctgctatagactttatgcatgcatgtgtctctatttataagctttaaatatctttttcttcaaaacagtttatccgattgtatcattgtatttgttgtaattaaatctttacaacaagatctcacttgattgtatttagacaaaatatgtatatatatgtttcagtgtattaaaatttaatgttttgcgtgtgagaaataaatgtttcagttggaatttgactatgttgcacattttttgttcaatgttgccattgattttttttaagtgttgcacatggtgctatttgggtgatttaataaatatttttttatgtttcactagtgttggcggtatgtcatgagaccctccgaccagacctaccgagaccaagtaaccagcaaggcttcaagcccaagacggcaagttcatcggggcgaagcccgcatggcgaagactatggagcaaagacggcgaagggcgaagaatcgcgctggtatcccgcaggtccgaaggcgtctcgggcgaagaccatgtgccgaagggtgcatgccgaaggaaggtgatttcgccatgacaagtcatgctttggggaggcccaaggggccatcccagctgctctagcccattggccattggaccagcgttcgccaatcggccaagtggaggcccatgtatctcaattacatcgtgtacccatgtaagtgtccttttcatgagggcaaccatgtgaattcccctgtaaaacctaaaccctaatagggggacttgtaatgggattataaatagacccctagggccatgtaatggggggatcccaagaaaaaatcttaaatatacacactcatcgttcccaacaactgttgagtaaccacgtccttcgacgtacgcagttgtcgttttgacaacaactagtttatttacaaatgttgcatgtggtgttatttggatgtttcaatatcttatgatgttttactaattcatttataattgttgcacgtaatgctgtttgaatgtttcattaagtattttctaatgatttatcaattacaattcgttgtttcatgtataatatagaaatgtttcaaaacagaatataattatatttatattttttattataaacataatcaagtgagatcttgttgtaaatatttaactataacgaatataatggtgaaatcatatcgtcgataagataagtaatttagaaaaaaaatagtttaaagttttactaaaaatattgctaagagagataggggcttgtaaatggtattggagctcataggcatgcaacagctatcagagaatgacttagaccatttcttttgcaacgtgtagcatgcgccccgtgcagtctagcagacattgcaacgtgtagcatgtgccccgtgcagtctagcagacgtcagacatgcgtccgatatttcgtaaaatatcgtacatccgtagctctctcccgtatatgtcatccgttatgggtaataattatgacgtacggatcatcactagtggggtggtatgtcaccctgttgttttgtagtgcagtactgggtggttattagggaccgttagacaagaccatctatgggagttcacacattacatataaatctcgtcattgacccatggtctatttatggtggatatatcagttgcaagtggggtctatgacccatcacatacgatgggtttttttatatgacttttaaatatgtggtccgaggtaatccaaatgtgctttcacaatgggagaataacattatgtagaattggtcaaccctgtcttcgatctttttcttcttctttttttctttcaggaaattgctcaacacagtcatgcacgaaatttggattactcgtgtagcatggacagacacgagctgggtgtaactagtatggcaaccagggccagatggatatagactagaccctgttagatcgcacccaaaaatttttcaccctgtcaaatcgaacgtttaacacctatatgaagtattaaatataggctaaaaacataactaattgcatagattgcgattaatttacgagatgaatctgttaagcctaattactccatgatttgataatgttgtgctacagtaaatatttgctaatgatagattaattaggcttagtaaattcgtctcgcagtctacccacggattctgtaattagtttttttattagtgcctaaacaccccatgcgacatcctatataatatccgatgtgatacgccaaaactttacacccctgaatctaaacactacctcaatatacaagtgcaggactctcccatattaaaagtgaaaccattattaatgaataaacacacaggttttataaatttcaaggatggaataacccatgtacccatgtatatattttatttctacgctacgcaaattaaattgtgatgtgcacctatataaacattctccaaggagccacaagtgatatgatcaatcaaccagagatgttgctgtttatcaagacccgacactcgataatataatgctatatatgtttgtcaacagtaattgcatattttcagtaggtatgggagtcatcagaaattagctttgcaagcttagcgctttgtaagtcgcttacaggcgtcataatggagcatgctgggctcaacctgtttcagtgtctcatccagtgtgtcttctagttgttactcctacatagcacttccttagcttaaacatgcatgcaaataccagcttgttcgatcttactagaaatgcagtactagttagttcactcctgatggacatgttccagacataaccgctgcccatgctgttgtgaacacagccagctatagccatagccaatagctaaccttcaagattcaagttgcttaattcctgtgagtaataatacctaaaaaattcaaaccatatagccatagccaatagcatgtcagttctcaccaaaggaatgctgtctagctagctacttgctactgatcagcattaatcatgttaaatatctatacctatactaattaggcactttctacgagttctcacgttaaccagaaatatcagaccattgattagatatgtcatattatcgtgacggtagattaatatcaaccgtacgtggactctctctaaagcccaaccaatattgcaattgggcccacatatgaattttaggtttcatgcatgtacgtatgacagggtatatcaatctcagaaggagtcctcataggagatcgtccccaaatctcgaccgccggggcaacgccacctgcccatgcatatagaagcgatcaatctctgaagatgaaggagaacgccgagtcaccgacggcacgattccggcgtccaccacagttcctgcataaaccatcgtacgtcaccaatgaaatcactgcccaccgtgtcctgcactatgcaacatcaagcatgcagtacgagagatcagggtgacgatcatgtgcagcgtccgtatctagatcgacgtacaataaaacgatgcacatgacgtgcaccaacgatctgcttggtgtcgaacaggatggaccttggacttgcagcggctatcaactgctggcacaattatccgcaccatcacctatcacaagcaagatgaccgcatatttaatccccataggtatatattctttttgtttgaatccagcaatgtattgtctgaaaatatatatgcactctaattttgttttagcatttggcatttttgaacaaataatacatgcatgttgttcctttatcacatgattacaattttttatgttaatttctcttgataaaaaatatgttttatgtcatcctttatttttgagattgtagatttaggttccgctggttagtgttggttgggaactaatccttcacgcacgcaaacggtgagacagataataagcatgattaattaaatattataaaaaacatgaaaaacagattaatattatttttgaagcaacttttctatataaatcttttttggaaaaaacataccgtttatacgttttgaaagtgtgcgcgagaaaaataggagagtagaagttatcaaagtgaagaaaagaacacacccttaatgatttgccatcctggtgcacatatcagggcaccacaagtcgttggcatgcagtggagtggacatgaaaatctaaatagttagcaaatcattaaatttgccacacgctgcatcaaaatttatttgaacagattaactttctctaataatattaattgttattgtaaatattttgttgacaagtaatatgttttacgccattggcagcgaaatgacaagtgcacatgtaaacaattccaaaggtttcacaacaagaagaacaccatcaagttgaaaagtaaaaaaaagaaacacttaacatccgaaacattttcactgttcaagagattaacatttcacaaaatatggcaagactagaacaaattaaatctctttagatttccatgcagtcaggatatttaccaataatagcctgcaaaatatatttatctagcaacctgtaacttcggagcattatttactagaagtaaaaattatttagtttgctcacataaaaagaacttcattattcagtattcatttattttaaaagatgtcattggcagagcatattacattaccaattgaaacacatgcaagttctgggatatatgctctgaattgagtgatttcaactaaaataaattaatatatgtaatgtatattcattattaaaaacactgcattcttttcagcagcatgttttatatatttactgaaaaggctaacaacactgcctatatgtagagtattcaatatcatccacaagaaaaaaacctacattgacaaatagcggagctgcgaaacaagtataataatttattatagcaaatcaaatttccattgtctggtaactgctagaattctttaataataacccatgcaacgcacgggttggcggctagtaatgtaaatgcatgactacttccagttggacccgttcgatacatccagttggaggtatattttcagcacatgcaaaacgaatgaactcattagcacatgattaattaaatattaattattataaaattgaaaaatagtattatttatttttttaacaacttatacatataaactttttatcaaaaatacaccatttaatagtttaaataacatgctaacggaaaacgagaaagttgaaatttagagttgagaaaaagaactcatcctaatggtaagatgacaattgttctttatttttcttggtgggtcaggtaaagtgacaaattgacaatgtaatagatttttttttcaaatacacgtgtactgatctttgtagaaaggtaggacaacacacatgtgacaaccagtacgctttaaggtgccaatggagaattattaactcacatacatgcagctttgagggagtggagctttgtacaaaaatgacattaagaagccatggtagttatacatagaggaacgaccttccatagaaacaccaggttctctataatgtgatcctcaaacatttggtgaatgacaccgcgaagccaattccaactaacttcgatttacacagttctggatgtgaattaattactgaattgcaagaggagtggatacttaggtggtgtttggatccagggattaaactttagtccctgtcacatagatagactacttacaaaactaattatataaataagagctaattcgcgagataaattttttaagcctaattaatctataattagcacatgtttactgtagcatcacatatgctaaatatcgattagttaggctcaatagattcgtctcgcgaattagtctagggttataaatgggttttgtcattagtctacgtttaatacttttaattagtgtcccaataactgatgtgatatggactaaattttagtctctatatccaaatagggtcttagagcctcatcgcttgcccatattccctaataagcacttttgacttattaggaaattaaagttaatttatatgtatttttttatacatttgttcgtagggaccaaaaagccaatattaaaaagaaattacattgaaaatatcttaaaatcaactttaaaatcaaaattcaaaatttggttttttgctttggcttgtttggacaaccgagaggctcttggcattcgttagaattgcacattgaatgccatcagaaacgaaaagtgatccccgcattgctctgcagactacagactgaatgtgtgctgtgaggtttattctgatttcgaacgctgtcatttgtagcaattcaaaattctacactttcaccccccggttacaataatcaaaagtctgtgcatcgtacattcgtaaggatagagaggggaaagggtatggattacggaacgattgctcacgaaggaatacaatttcatgtatcttctgaattcaaagaactagttggtcagagcttcttgtattcgagggataatctgtaggaactcagtcagtcagatcaacaacttaaaattccttcacatcatgttctagcaagaggaccctaatttaaaaaaaaaacagtctgctttatcatggctctcatttaatacgcgaaccaaggaagcatcatcatgaaatgcagcatgtacccatgggtagagacgagtatatatacatagagatgccatatatactaagagatccaacttgggacgacacgtcgaaaatgaaagagtgaagttgtcttcaaaagccattggggctagatcgttcattattgctgcttgcccagtggcatagggatgggaggcatggggaaattagtcggaacagttgttcacatcatctcttatctggttaggtgatttatccggagctaagatttaattcagagataattcctccatgggatgataccatggtgcgatgacttgatgaaggtgagtccaccagcccgactgacttacacacataggctcaagagaagggaattctgcaacattccctggcaaaattcgattcgaaacatttgttgtccattaggccatttggtggtagatgctacagatagagcaatggagtggccctttgtaaaattaaagtgtttttattattattctgtgatgaataattggcatatgtgattattagttttgatatttggagattattggcgaagtggttttggagatgattggattttcagatgatataagggtactactggatatgtggtccggtcagaccggcgagtggttgccggttagaccggcggtatgtgaccggccagcacgcggtctgaccggccgactctgtatcggtttcggtttcgggttgtttgtttggatatccatggatgtttcgtgtttatggctgtcgccgcctctagcctccaacgccacctccagcctccaccgcgccgccgccgccgcctccgccctccaccgtgccaccgccaccgcctccgccctccaacgcgctgccgccaccgcctccgccctccaccgcgccacggccgccgccgctgccaccgcccgcagccgacgcctccgccgtccaccgcgccggcgacgccaccaccctccaccatgccaccgccaccgccttcgccctccaccgcgccgcggccgacgccaccacctccgccctccaccacaccgccgcctactctgtcaacgtttttcattccaaacttacccctgaaaaattttggtcagactgagaccgagaccgaatttgccggtcttgagattttttggatgaaattcggtcctaagttttcaaagaccaaactgaccaaaaaaccgaagaccgagaccgaatttttcggtctgaccgaacgcccacccctactgggttcgtatcccactagcgcacctttttctcacattttactctctccaactgcccccgtacgcacgtgaccaccttgcacaaggcagtccgggcggttcatctccgattttcttggcggttttcctacaaaaccgggtggcccaaccggtttataccaacccaattgcatagacggtcttttaactagaccagaccggcggaggctttggttctggttttttccggtccaactgccggtccggtccggttctaataattatgtatctgcatcttttttttttcccaagctgtgagcatctattaggtgttaattttgccgcccatgattttacatagacttaacgggtcgcttcctcaaaacagattgccatcattagtgaacaagggaagaccatagagtaaaaacttgaaaggtgttcgtgaggtttaaactacgcttgttttgcatatggtataataaattggaatgtttagccattgcattggtagcaaatcctcccttgctgtggcgacaaactttttagatgaatcaaatcatgcaattagtgcccaattgtattagtgtatcacaggaagctgagttcttagacaatcagctcagtcaaaaaacagtaataaaaaataggtggattggattgcagcccacggatggagtgcgatacttcagattcatggtgctttcggcctgttcacaataggtcaaagccagaaattaaactggaagccgaaataaccggtactgatcatgtcattaagtttcgttcatggttgttgagacttggttttttcttcctcatcccaactcacgtatgagctagctagcattatataagcaagagaaatgatcgggtagtatagacatgctagtcgttcaggtgtagatgctagacatccttaatgattttcactgcccatacaaataaatgagagtttatagctactaacaggatatacatacatggctgatcactgtaccatgatcttgtgttttggggtatagagaaatagggagtaggaggcatagggaatttacgtgtgggtactcatagtgctcatccatggcacttcagtggaaaaccactacgatcgccaaggcacggcacgcctaatcggggaaatgctctcacagctctagcacaaagcctacggagaaccatcgacactctacttgggccaacccggccgagtgcccagccagcagtgtgtgttgcagtagtcgaatcggccggcttcgtcgatcgatgctggtcctgcgggcattggcagttaaagctaatcgccaatcaattgaatcctgctatcactatccgcttcaagagtgtacttcaagtcagggtcctctttcttcaacttctggaacaactctaatgttttcttgcacatcatatcatttgattgttcctttgatatatatttgatcgcaaagagtcttcagagatctcttagtgaatggaacgtcacgcattgaaacaaaaaaacttgcagttatgcagtacacctttgacaggttcacattattaatgcttctgagatgtctcacgagctctttggtgtgtatgtctatgtgcttatgggagctccagtgcttgctctcaccacatgtttctgacaacggatggttatgctatgatctgttttcgctaatgtaccatccattgtcctgccgacggtacactggtacagcctaataagagccttgcaatctgttttcgatgttaccctacataagattggtgcatacctgtcatcgactggtgcatatcacttgtcgaaaacatagtaatttcaaagcatcaatcaattttaagtatattttactgaccgcacaagcacatggcagatcctggactgatttatctgtcccaccatactttacacttcttccatacctgcaacgatgcacaccagcatactttttctcaccaatagttattactccttatgtcccaaaaaaattataaaatttagcatagttatgtcaaacatttttaattttaactatgatagcaaaaaaatgaatagcaaaaagaaaaagatcaatcatgtaaaattgatgttactagatttatcattaaacaaactatcataatatgcaacttttttatttaaaacatcttaattttatagatattatttgttaaattagcatctcgaagactgggtcgaagtccaaaatacgtatattttgggacggagggattactcattaacaaaatccatggcaaccattgaagatgcatttcttattgcgaacagttctgatctttgaagaataacttgtctttaatggtctaaaaaatctatagtagtgcaatgtactatcaaaattagactttacatacttatatctattttgttggatcactactttagatacttgatgccaaaaccaacctcctaggaatgcaaattgtagagatcgtacgcttcctgtagagagtcgaatgaaagacccactttcggttcactaacaaggtcaaccttcttctcaacaaagttttcgatacttgattccaacgcgcatacacgaccactgattaaatcttctgtttccatttttattataagcacagcccacatggttataatctctcgtcttgctcaacataatcaaacctttgtgagagatgatggaagtggtgacttgtctttctataagaccttaggacttttacgttacactatacttgcaatatatacttacaggagtcctactccggtactttctactcggagtagaaagtaatctaggcccttgatcatatttaattgtagggttaagatctagttctactcctaccagaattagtggaagtagaaatgtggaggggtgtttttgtccaggaaaaataattcgcgaaggggtattattgttttccgatccatagatcgatcaccatgtcatcctcgtcggagttggtcgtgcaagatcttaatcgatccatgtaatccatgaaacaacacagtgatcagaaacggcaagaagacgaatgagccgagacgacgccgccaagcaaatgacattgcgtgcgtgcgtgacgctgccgccgaagcccaggccagaatttttaccaccgccagaactcctgctcaagattgtcgctcgctcggacgccaccacactcgtccgctcccagacggacgatgcgactgaggaagcagacaaggcggcgacggcggggaatacggatggcgacggagggggtggacaaggcggcgaggccgggggaggaatagcgaggtgactgcgtgcaacggagttcggacctgatacgatgcgaacagaagaaaacatcccatgccaaaattacctctaaacgatattaggagattacttacctgccctttaaaataaacggtcaagattaattctacttggagtagaatactgcaagtagattgcaccggagcattactctacttacagtataaacaatctaacagtgtgaatttatctgatcttctttttaccgtataaattgtgaagggtatatttgtttttccatatttttgcggaggatatttttgtattttcgcgttttattctttagtcagatccggatagtgagaaagggactcgtcccatactcccatgcgctaccaccgctgccgacagccaccgcgtcgcgccgccacactcgaacgctgtcatgtatggggagagaggaaggggaagcagcacagagcgcactggagcagcaacatcagctccgcagttgttgtgtctctctgatatagttgaacgagtgtgggtgattcttcagagttcaggctagtgtgcaagatggaggcagatgtgtgtcgttactggcttactgcatctgaacttatgtactgaatactgtaaagaaaaatgtaaaaaatgtaaaaatgtactgaatactgtttcgattggaaggaatcgctctgcctccacgctcgctcgtccgtcaacaatcgatccgccgccacgcgcaatgtattccgaagaatcactgctgctctagcccaatgtgctacgagatccagaacaaataccaactaaacaaccctttcgagattaactcccggtgcaaataaatcgcaaatttacattactaaacagccctttctatatttttaacaaatatcaaacttgccctactatatgctgcaagtatatacctgtagtagaatgtaacgtagaagttctctttcgcgaagccttgtatacatatttacaacacaaagatatgatgatatatgataccttagtaagtcagggacgaacatgcgaaacttccacataacaatatataatttgtgctgcatttatgacatcagacatatgtcgccaagccagatagagcaccaagtgcttggccaaagatttcaccaagctatcagcaagcaaccactactccttttcttcagttccacgttgtttgggagctgttctgtttgctgaaatgctgaattccatctcgttccaattaacctgctcaaatttgcactctctagagaatatgtaggcatggaaggtgtcgggaattcggccttcacgttgttcagtcttttgccatcttctgtcaaagaagtaaatgtcgttgaagccgtgaacaacgatcgttaattcaaaataagtagcaatattgatcaatcagagagaagataaggagctggaaactgcggttcggttcttgaagtttaaatgttgttctttcctctctctctcacttttaaatgggacaactaagcaaagtttattcttcatgaaaattatattaaatgttttccatcgtgtggctggcctgaacaaattcatctcaacgagtttttttttcttttattgattcagaaataaaaataatgcttgcggtatcctttcacaaattactgtttttggatgtatctaccaactatgacatgttttggccatgccccctagccacatttgagtaccaatataatccgagagattggggaccttagagccccttcgtggggccttgcaattgagccatcgaggtaggtgataggtctacagtttataggtggtggagtatttgggttattatgttgctttcggttcgaaatatttcaaaagccaaaattaaaaccagtcatgtactagctcaaaatataaaccaaacatcaaactggaaaaggaaaaccagtactacttcaggtcgttaaagctcggccttgggttcagggatgttttttttcccatccctacgtgtgctcacatctgagctagcacccttatataaactagatgataccccgcgcattgctgcggacatggtagagaaagtttaaaaatgcaataggagcatacatttgagacagaaaaagagaaaaactattaccatataattgactcgtaaaaactttataagcagtggtaattataagtaaggagtacacgatgggtgtctccactcaggtagcggttgttggccaatgcaactaacacaattgcagctgaaatatatggctattgaccggataaagctagtactaataaacaaaattgaaggccgctaaatattactggagagtgaaaaatatcatatattattatggtaaaaagaatgttaatttagtaggaaggaacatatataagagcacattagttgcatagctgatcaggaatacagtcaagtcatatagcaaacatactgaaacaccatcaatattttatatttaaacatctacagatatagtccaattatctacagacattaaaactattatgtaagaatgg

SEQ ID NO: 79471 - DNA, 32865 bp, Oryza sativa
tttgatttgcttcaaatttagtcgtcgttgttgaattgaactgctttaaatttatcattcttcgcaagtctggtttgagttttcagacataataagttgtgtatgaggtggaacctccagttaattgtcgtttgcagacaatgtttgtttctaataatttgcagtaattgtgggtttgcttatttggtttgagagaaatgtggcttgtttacatgttgctattgtagctttggatgccttcgaaataattctctataggttctgcaggatagccttcctctcaacactctgcagaagaaagttaacaaatcgatttatgagactttggtcaagaacagaagataaagctaagtttgttcgaagggttaacaaataagttaataattaaagctgctcacagattagcctaggaaggagtgtcttcgagtagttttactatctggctttctgttgctctaagatttattagtttgattttggctgatgattgtaagcataacaattcaggttaattgaatgcaagtagcattttgaaaaacccataattcttcatttcttcaagtttatgttagatgcatggtatgccaaaaacctgtaaagttttacgttttaaatacacaacacctttccccctaaggacaaggcaattagcaaagacatatttacggtggtttctactaatagtttcgatttgataaggtaatttgattagagaaaccatttagttggtgcgcaaatcaattcatgtctatctgataaggtaatttgatattttccccccagtggtttaagaacatactcctccgtactaaaaaaaaccaatctaagaggagatgtgtctcctcctagaacaataaatctagacaaatgtgactccttctaggacaatgaatctggactaccctcctaggacaatgaatctggataaatggtagtccagattcgttattataggagggggttaagtttttttaggacagagagagtaagatcaggaacagtttgttaaattatgttcaggatgcattcccaaataaaagtgagaaactgaacactattttctttttcggttatagcagtgaaaccggaggaaaatcccccgaccaaatcccagttctcgtggctgattttactgcaaaaacgtagctcatgaatagcagctgccaaatgcataggttctctgttatatttgaacaagctgaatttcgtgcacaattgcgcagagctagactaaagtttaatcatataactcttacgtacttctatagtaatgcccatgtagtaaaaaccacaaacatgttgacccagggtctacatgtcagtggtcgtagctacatgggttgtaccgcagatgatccgtttcctatatgatgaactgaaaatgcctagtatttgtcccataagaaaagcagagttgcaagtacgctactgctagctaatgctgccaataataaagacacatcgtgccaattaagatagcctatacgcgctaatctcgtgacttcatccccacaccctaatagttaccgtcagttttattcatggactaaaattcacaacttggaaaatcaatttccattaaaaagagaggtatatggtaaaccaaaatcaagtctcagatgtttgattactgcatatgcatactctcccccataataaaacaattaatcccctttcacatacatatatatacatgattattataatattgaagtaactagattttatagatttgagattaaaaacaaatgaaaaatatatggacacaaaaacagtgttttgtggttgtataggaaaatagcttcttcattttttttaattaatagcgccatttcagtaataaattaataattcatcttaactatattatactccctccatcccctaatataaggaattttgacattttgcttgtgttgtttgaccattcgtcttattcaaaaaaaatttgaaattagtatttatttttttacttactttattattcaaagaactttaagcacaacttttcgttttttatatttgcacaatttttttttaaataagacgagtggtcaaacgttataaaaaaatagtgaatatctcttatattaggggacggagatagtaattctttcactcctatgtaaagagatgcaggttgcataaacatccacgtattgatgatacataaaagctgaaactttttcacaataaaataaaacttgtgagctggattagattactaccagcaagaatgcaagataggtagcttactgcaccacacaagcttctttaatgctaggagttctgagggaaggggaaatcctatactttaaccacaaaaaatgtttttatatttatgtccataaatgtaaagggtacaatgtgttgaacgttgtgcatgaaacaaaaatacaaagtatctgttccaaaagtaaataacgtaaagtttccagtgctgactaataaggccaagaaaaaagatgtatattgtgccaggatgtgtaggcccaccaactcttgagcacgcctgagtttttccatgtacttctctcgtgatctggttgtttatagaagacccactcagtaaaatcttaatcctcgggtataaatctatatgtaccctcaacctcaattaatccatatgtagggaaataatggttgattattgcataatatcctttgaaactactaatttttgttccaaagtatatatctttactttaaaacttcattgaggttacagatataagtattggttaaagcatagactagaaccaactaagaaagttttgatgacaactattaatgcaataaatccccctaaagaacatcttataagaatccccatagcttgccctcctccccaattcccaatctctattcctatcttgttgctctcttcctcctctagtcccaacacctccacctccccatacaccccatgtctcaagaaggagccgacctctctcaagatgtcgatgaaagcccatatcacaccgccgttgtcaccaccaataatctggtaaggtcgattaaagcagagaaatctaactctagctctagctccggcaagcctgtcgagacagacatcggtttaaaggtagcaagccctactatgtttgggttcaacacaaagatagagggaacgggaaagaacatggccgtcaagagagaggaaggagaaggtggtggtcgtcctggcgtcagcagtggtgtcagcacacgggataccaacggaaaaggcaagaacgctatggacatggagcacgcgttgcatatttggacggagagagagcggaggaagaagatgaagaacatgttcagcaccctacatggcctcctccccaagatcccaggcaaggtcagcatgacatttctattttggggctattaaatcatgattgaaatgtgtgaaatatagtatttttttcctttgttttatgtgatttatctttcgttttgttagtattaatggctagatcattgttttattgcatgggtaaagatatatacctattcttttttatgcaaagagcagttgtgttctctatggtttgagtgtgaattaaaacctatgtaaaaccaatacactgcattggaagaacattatacgtgtagctttgatgttggatggagtttttctagagtaatttggtttatggaaataatgttgtgaatgcatctttgtaggagtagttcatattgttttgtcaaatatacattcataattagaatttgaccttgtattttagcatcatattaataaataccagcaattaaaacgttcaatgctagctgtaatttgagctccaataagaactttttaatgccacattatcttttcgcttttgttgaattttaacctatacgctagcttgttagatgtggtaaaaacatgtcatgaacttttgaatcaatatgatctggttgtctggaggatacacctacaagctattaaacaattctaattttgtacccttccgttttaaatgtatgaagctgttagcttttggtttacgtttgacaattagttttactatattaaaagaaatagtatgtaagtgtcatttattttgttacgatttctttaattttatcagtaaagttaatttaagtgtaacttatactttcacatatttgcactaaattttagaataaaacggatggtcaaaagtcaccaacgttatatatttaaaaatgtagggagtatgtctctttaccttttctatttctaaaaataaaagtaattgttctagaggacatgatagtttagttatgtttctatcaaaacataagaattacaagaaatttggaagaaaacaagaaacaaatataaatatgtaatgttcacatccttttgttataggttgcaaatgcaattgagaagttctatatatccttgatttaccaggatttggtattttccaattgttacaagaaaaaactgacattggatagttcttatctctttttagattacacggcagacgcgcgcgcacacacacccacaaatgggtcacctaacatatgctctaagagacgaaaacctatagcacatccttgatcttactaaatttatgttgaatgcacacctatatgtgcgtaatattcgtggacaacatgatttaaaccctagtgggtggagttttctatgaattaatctaaccaaccaaatttgatgtgtttaaaagcaaaatctgcattacagcatgtacatacatatatgcatatccctacaaaagcaaattaaacttgcggatagaacatggatgcatataacctgatgatcatgttgcagactgacaaggcctccattgttggggaggccattggctacatcaagacgttggaggacgtcgtccagaagctggagaccatcaagacggagcgcgtgcgcgcgcaccagtgggcggcggcggcggcagccgccgtggcagccaacggcggcggcgaggggtcctctcactctcactctcagccgccgcgccacgccaccgccgtcacagtcgccgtcgccgagcctgcgccggtggcggcggcggtgaacgcgcaggcgccgcagaagaaggcggcggcggcggcggcgccgacgctgcagacgtggtcggcgccgaacatcacgctgacgatggccggcgtggacgcgttcatcaacatgtgcctcccgcggcagagggcgtccttcaccacggtggcgttcgtcctggagaagcaccagatcgacgtcgtcacctccaccatctccgccgaccatgacaagagcttgttcagcgtccatgtccgcgtaagtgccattagctcaccgacgataatctcttccaaaatatactccccccgtttcacaatgtaagtcattctagcatttcgcacattcatattgatgttaatgaatttagacatatatatttatctagattcattaacatcgagataaatgtggaaaatattagaatgacttacattgtgaaacggaggaagtagttaacttctggctactttttagacaagcatttgtccagatgcatagtcagaacagaagttgttatagtttaggatggatgcagcatttgttcggatacatagatataataatataagttatatgtaatgtgagtaatttgttcattttgcttgtgtggttaagcagctcaacgaagcatcccttcagagcacagagggtctgacgcctgaagccaaatacaagctcgcagtgtcagagttgatggtcaggctcgccgaatgagacgaatttgatcgtcctgaatttgctgtcccccttgctactctcatcgaggattcgtactctcagcatttggaataactaaaaccagtctttgctttcagtttagtcgttgaacttgttactttttggataattcggttaaagtttccgaacataagtacaccaccaggaggtaaaagtgtaaaatccgttgatgttgtcgtcgtcgttgttggagttatagacatgttacttgaataatatagtgttgtttcttgatacatttttttttgaacgactcgcacgagacggtacgaagttctattgatagagcaggaaaaaattacaagatcacaaccctaaagggtcgtaaccaggaaaaaggaaaaatataccaccacccacacaccgacagctccaacacacaagaccgggagaaggctaacaccggaccggccgccgctaagcttgaccgactgccgctagaccaacaaagaaacatagatgagatcgcccaaaagaacaccctcacaaccaatacaaagccaactcctagagtgtgcttgcaccaatcgatcgagaggcttcggctaggggataccaaaacgacgtattcaagaagagaagcgatggtaaaccaccgccgccatccgtcggggctcaaaggagccaggactgggctttcgcccggcaaccacccttgagggatgagacagcacgacaacaccctcaagagggggaattccatcgttgtcggtccggccatggccaggctgggttttcacccgctgctcaccaccggcgaatccacggctgacgcaccaatgctcccaccacccctcaacctctgccgacatgtgggacccctgcaccggcgccccctactggctagccttcgagcgccgaagaccgcgtcacatccatcagcagctcctcgaaccgaggtcgcctccactgccggccgcgcctctcgcgtcaagccggcctcctccaccggatgcgcctctcgcgccaatccggcctccctccatcggccgcgcctctcgcgccaagccggcctccatctcctccgcccgcgcctctcgcgccgagccggcctccgctgccatcggttgcgcctctctgcgccaagccggtctccaacccctcctccaaacgctgccgcgccggctagatgcaatcgtctcctacaccctcggctagccgtccaaggccgccatacatcctcccacctcagccacggtgatcaccaccatgcctccttccaccgcagccacgttcgccaccgtgcctccacattcacagccgctgcaagccggccgctgtcgccgctgctgtcaccaaccgccaacaccagccgccgccaccgccaacgcggctactgcctcgtcgccctccgtcaccaccgcctctgcagtcctccgctgccgccatcgcggccgtggaccgccgtcgccatcgccgccaccggggctgtggacctccgccgcctgccgtcgccccgggaggaccggaaccggcctcacccctaggccttcgccttcgccacatccgtccacagcagcgcgcatccatcgcctccttccggccgccgtcgccgcgaggctcgccgtcgcttggcccctggatgcggggaggccggatccgccgccaggggaggcggatccacctccggcgtggccggattcgccgcgacgacccctcggcgccgcctcccgcgccgctgaccgccgctcgctgttgctcggccctggacacggaggggccagatccgctgccgggggagacggatccgcctccggcgtggccggatccgccacgccaaccccccggcgccgcctcccgcgccgcggaccgccgctcccgagcagccccggtgtccccgccgctggcttcctcgaggaggggagagggccccgccaccgccgtccttgtggccggtcggctttgccgacgcgccgctcgggcggtggcgaggcaaaggggaggagaagggaggaggcggcggaggaggatgaggcgccgtccgtgccgcccctgggacgggagcgacgcggatgggagcgatggaaaatgatgaggtgtttcttgatacatatgatacatgctcctatcataccattgagctgggggtaaaatttacttgtctatggttagatgttgaaattagtttcttttgcagaaggtaacaaacatagccacaagtaagctagccttcagcttgacactccaagggatcccatagcttcccttgccccacactatccctcttacaaacgggaagaagcacagcaccagccacccacaacacatgaattcgccgatacccggggcacagggcacaccttccgctgtcccgaaagctaccctacatgctccgacagtgaccgcaacgatgtttaacatcgcaagtgccgtcacggggatgaacaccggcaatgagtcgaaggtgaacctcccagggtcagcaccatcggtgttgtcatcgtcatcagacatgcttttgtccttgccggtgacctcaaaaacagtttcggagaggcctaaggacttgaggagcacggtaagaaatgctagtgtccaggcagagaccgagatgatccgttgcatcctatgattgttccaccatgcacgggcggagagcccgcacgccatgtactccatgaagttgtatgtgttataggatatgaatagggctaacgggacgctgaaaccatcttctgatgcctacaggataccaagagtataatagttcatccatatcactctctagccaaccaattgaaaagtacttgaaaaatataaggaatgtattaatgagtggcatgcaaatgattacctttggcaagaaggattggtttgtgagtatgcaataaggtcccaacaatccatagcatagctcaaaaggcgctctcagaggccacccaaggacgatcaggtaggcaagacattgccggaatttgaggcgcttgaacatggttgcgagaattgggttgttccggctgatgattatctcagattggccagttgcccatctcttgaactgagttaggcaggctggtcctccaatcggcgcggagcccatgaatgcgggtggttcggttaccatcaatacggatctccaacccatcgcgtgtatccgctgtccggtcaatatgtcttctgttagtgatccatagacccaaccaacctgattagaatatgagggatgaattgtatgagacttgcagaaaagtgtactgcactgtagcataacctacaaaaatatggcaatggaagttgtctttacctcctgtccccaacatgtgccaatatcatagttgcaagctgaaactgcttttgccacttcaatgcgacttgatatatcaaccattggcttagaggacagatcccaaatgatgtttcttgctgattcgttcaattcctctgagtttccaaacctggtatgaagctccttataagacgatgaacctgaagaattatgccaggtctctcaatttaagggtgtgagatggcatgattgatgtactcctaacaatcacatcagtgtatgcccaatttcacctatggtatcttctctctcggctccattgaagttcggtggcacgccataaactgctttcctacggtgaaagcagccggttccagcataaaaggcaccctgaactccttgaaccccactgataaatctctaaacatgacacaagatcagtttaacttatttggaatattagtggggttaataagcagcatagaacgggatacggattaatgaagaaacattttgtgcatagtaaattcagatttgatcagacaactcattttccatatataagcaaatgtacagccaagcacgacagctactccctccggttctataattcttgacgtttattttaaaaggttgatttcaaacaatcagaacattaaccatcgatagattaatactccaacatacagatgaaggcagaaatactagctactagcattgatcatcagtacactagctatgtaccttgaaaaaacactccatctggttcccaaatggatcgtccttgagggcgtcgtagaatctctgcggcgcctggacgaacccgctgctggcctcgtcgtcgaaccccagcagcaggcacatcgcatggaggacggcctggggattgttcacaaacatgtcgcagtccatgttcagcatgatcggtgcgttggtcatcacagctgacaccctcgtctgcacagagagagagagaaaaaaatgctttgtcactgcagattctacttcggttttcattagcatattttttaaaacggctaaacggtgtgtttcatgcgaaaactttctatatcagaattgctctaaaatatcaggtaagtccattttttaagtttaaaataattaaaactcaattaataatgtagtaatgagtttctcgttttacatgcccatatagcatgtttttaaaactggaaaactttctatatcgaaattgctttaaaatatcagataaatctattttttaagtttaaaatatttaaaactcaattaacaatgtagtaataactttctcatttcgcatgttcatacttaatcttcatcttcaataatttcgaacggggcttagtgagcagagaagttcatgtatcacgatgaggtaaaaaaatgccgaagagctagctattgccatcgaccttgacgatggtggggtgattcctcctctcgacgttcaagaactcggcgaagaactcgccgccgccgtgccggaggagggagcgctcgtcggtgttcttgatgcgccgcactaacttgtcatactcatcctatatatgaaattgatcaaacaagaaaatggccataaacataagatcatcggaacatgacgctgtgttccggattatttagatgacatgtaagaaactcgagaatattgacttttccaagtatagttgattgaccttcatgaatgtccagtcgtccaagaacttgcgatcggccgggccgccggactccggcgaggaggaggaggagaagtaccggaacggggccctgacggcgacgccgtaccggcggcagaagggcacccacgcggcggcgaacccggcggcctcccgcagcgcgtggcacgtcagcggcgagcacccgtcgtcggagacgtagcaggccagccgctcgccggcgcgcgggtagtcgagggcgagcagcgagagcaccgtgttcaccgtcaccagcggcggctccagcgccgggtccgccgtcgtcaccagcatgtccaccgccggcagctcgccgtactccgccgccgtcgtcgacggcgtcctgccctccgccacgaggttctccggccgcgtgacgaaccggacggggctccacttggcgctcacgttgagcgcgcacagcgccgcgaaccacgcctcgcacacgagcgccacgcgccacacgccggcgtcgcccccggcgccgccgtggtggcgaagcagccggagggcgaggagggcgaggaggaggaggaggacggcgaggccggccagccgccacgcccacgccgcgcgccgcccgaggggcaccctctcctgcagcggcggcggcggcggcttcttcctcccggacctcgtcccctcgccgccgccgccgcctgatctggtggtggaaccggtggccgccgccgccgccaccaccgccattgacggatcgatcgagcgacgaagcgatcgagccatgcgtcgagcgagcaacgcacgcggcaaccgcacacgcgcgcccacgccgcggcgcgcgcgtaggcgtagctagcgagcgagtacgtttcttggtttctcccattattatctactatagtattaaaaacgaaaaaaaatcattgtcttctcctcactccacgcacgcatcgcgggggcacgacgagagtatcgttttcttcaacacttctattttccaacatgcatgtgtttattctatcaccagtaaagtgtgtcgtcggtccttaactttgtttgttgagatttccagctactgtttccggtttgcaccgaccgttttagtcagtaacgataatcgacggtggtggaaatagaaacggtaatatcttccggaaatgggatggaggtttttccgaatgttttgtcggtaaccgtatttgtatggtaatttccgtcaaaattctaaaaaaattccgaaagttcctcggtggctcagttagcccaatccatcggatgcctatgaatgacggaagcctaataggcttgcagcccataaaaaaggggaagtgaccagggaaaatgttgttaaccctatgacgtggtatgttgatttcgtgaattttggtctcctcaatttatcgatgttaaagtattgtcgaattttgtttatattgttcgtcaaacttattatcgtatcattaatcatcatataacggtgtcacgtgcagagcgatgatgcaacaataaagttaaaaagtcatcttcgtgcatagttaaatgtgtgctatgccacactctgctaattccgatataattttcgacttccaaccaatatcggtatattccgttctgaattgttccgtttccgatataccgatattactgatatcgttaccgttttcggatctaccgttctgattctgttttcgagaaaaaaatatgaaaaagaaaatggtatagggtttttccaaccatcttcatccctaatatatatttttgaactctgaaaatacattttcagatctacaaatttattaaagcgtgtcatttcggtcctaagttatcatgaccactctagtatcctaagtgacgttgcttcgcatacgagcgccacgtgccacacggtgccggcgtgccacggtgccgcagagatgacttcgccaccaccgtcattgccggatcgatcaagctacatgcggcaaaggcacacgccgcgtgcgtgtagctagtcacatactttgcaccggtggcgtggcacatgcagaagcagctagcgtcgtatagtactggacacggtttttatctatccatgtaaacgtccacccaacctacgggccgttggatggatcataagatttggaatgtggtcctgagatcctaggtaccgatcgaattcattgggggagtacatgtgtacacacgaatcatgtggacatccacctaagtagataaaagactacctcgtatagtactcgaacatacggtgcactatgggggaccaaatcaatgggccaaaaaggaaagagaaatggccagtcttccacacatgtaaaacaaagttgacttattagcacatgattaattaagtattaccctaaaaaatttaaaaatatattaatatcattttccgaaagcaactttactactccctccttcccaaattgatcatcatgtaatagaatttaaaatttctcaaattgataatcatataactgcatggacacgaatttcatcggaatacaattaatataatatgcgagaatgtgtgcatgctacggtgtaattggcatagggttttaattgatgcatgcattgtgagagattgtgtgcatggtgtcttgattgatgtgatttaaatggttcttggtcttggtacataaacttatatgatgatcaatttgggaaggagggagtataggagatggaatagaatttcaaccgaatacacggtcaccaaccaaatactcttatatttctccaggggcacatcaataatacacatagcgggaacaacattttcccctcacaaacaaaacttagcctaatctctaatgccacatcaacattgcaaatcatcatccaatcaatttatacattttcattcacttccctgcatgaaaaaacatgccgaaactgaatatcccacagtcgtggcgggttttcgtcgaattggaatcctcgatgcggcgaattgagaaaaggtcagcagcggtggtggcagtgtcaccgctgtgatatcacggtgagggaaggaatgtatgaggctagaggctatggacccggtggcgacatcgcgcccgcatctccatgatgaaacaaatgaggacggtatagactatagaggcactcatcaagaggtggtggtgacacctcatcgagggacagaaggggttggggattgatgtattctatctagcaattggttagcccaatcgtacccatatgtaaccaaaagttatttagattgatacctgatacctggtggtacgttcttaagaatggaaaagcactcgtatttttataataatgtacttgtaggtattcggaataaagaattactctttgtttggaacttagggtctcatcgtttgccctagaaagaattagttgttaccaaaatttaaattttgaaaattaattgtggggttcattttagggtattttcaatatagttgttttcagcattggcttttaagtcgcaaatgacacatatgaaagcttttacctataaattatattttaatctctaataagttgttttagtatataatcagctcttaaccaaccgatgacgctcttagtggttgaactgctatcttatagaactcagttatgtttaccaacaacaccaccagctgaaagtgaaatactccatatgtttatagttgtcgtcatttgctaaatggaattacaaacatattgctcaaataatacatacatgaaacatgttaagctgactatgcttacatgctgaaactaatttctattggagcagaacaggaacaaggccaccagcaaactagccttcagcttgacactccatgggataccatagcttcccttgcccactagccctctcacaaatggcaataagcacagtagcagccatccacaagacatgaattcacttatacccggaccaccaggcacgtcttctgttgtcccaaaaactgccctccatgtaccaattgtgattgcaacaatgttcaacattgtcagcgccgtaacggggatgaacactggtgatgcgtcaaaggtgaatctctccgggtcaacctcatcgttttggccattgccatccgatgtgctcttctccttacgggtgacctcgaacacagtctcggagaggcctatggtcttgaggagcacagtaaaaaatgctagtagccatgcagaggctgaaatgatccgttgcattctgtggttgttccaccaggcacgtacagagagcccacattccatgtactccacgaagttgtatgtattataggtcaagaatagtgctaatgtgatgttgaaacaattttctgatgcctataggaacaagatattactgcatcacttctctgctcccaaccaattggaagtactaaaagaattgttcatgaatatgtaaaagttctacaaatatttgtactacaaaaactaattaatacttacaattatataagcaatgtaaagataagtatggagagagtacctttgacaagaaggattgatttgtgagtaggcaataaggaaccaacaattcatagcatagctcaacaaatcccctcacagcccacacataaagagtcaggtacgcaaggcattgtcggaattggagatgcttgaatatgctcagaaggagtgggttattctggcttatgagtatctcaaacaaacccgttgcccatctcttgaactgggttaggcaagctggtccacccgttggtgcgcagcccaagaatgctggtggttcggtttccaactttgcagatctccaacctgctgcatggatccgctgcccagtcaaaatgtcttcggtcattgatccataggcccaaccaacctgtagatatatggaatgacttgctatgaagcttgtttaaaagtgtagtgcattgtagcataacctacaaaaatatgacaaatgaaagttgtctatacctccagaccccaatgtgtgccactctcatagttgcaggaagaaacttcttttgcaacctcaatgtgacttgatatatctactattggctcaccggacatatccccagaaatgatgtaccgagctgattccttcaactcctctgaactttcaaacttgaactgaagctccttgtaagatggcgaacctagagaagcaaattgaaaagtctcgcgatttagttctactagaatgataagactaatgttctcctgataagtgataaccatcacatcactgtgtatgctccaacttcacctgcggcgccctctcttcctaccacaatggagtctggttcgatgccgtaaatggcttttctacagtggaagcaacccgttccaccataaaataagccctaaatccctgcaaccccgcctagaagtttctgaacacacgtactgcaaaattagtctagttttttttctatagatagaaatctagcatctatattcagaagtggatatatagtgtagttttaattgttactttcaattgggttacacaaagatgtactttcaaactttcactataagaatggataagtgttatcattaattagtactccctccgtttattcacaatgtaagtcattctagcattttccacattcatatttatgttaatgaatctagacatatatatctatctagattcattaaacatcaatatgaatgtggaaaatgctaaaatgacttacattgtgaaacggaggaagtacttcatatgtttcatatgacaagtcgctttgacttttttagtaaaatatttttaagtttaatcaaatttatagaaaaaatatagtaatactttttaaggcaaacaaacatatttgtaaaatatattcaatgttatatataatgaaatgaatttagtgtaatttgatgttatagatattgttaattttttttctagctataaatttggtcaaaactaaagaagattgatgaggaaaaaaaatcaaagcagtttataatatgaaacggagggaggaatacactggtagatgtattataacggacaaccacttgtgtacgcacgtaccttgtaaataacctccagcttgttcccgaaaggatcgtccttgaggtcgccgtagaaactctgcggcacctgaacgaacccgctggagatctcgtcgtcgaaccccagcagcaggcacatcgcgtggaggacgacctggggatcgttcgcgaacatgtcgcagtccacgttcagcatgatcggtgcgttggtcatcacggctgacaccctcgtctgcacacacaagagagagaaatgtacacatgttttcagtactaacgcacatctctgggctcgatctgaatctgactcccattacatgtcgatcgagctaacagtagatatcagtgcactgatcgagctagtaccagggcgttcatggcgccggccttgtagtgatggtggtgtccggggctcttctcccttgagacgtatatgagatgcgggaaccctccttcttcgcctatcctgttcttgctgttattatcccatataacctgatgatgatctccccgatatgagaagttcatgtcatgagagacaagaaagatttgatgtagttctgacatgatcagtttgaaagctagccatgtggggaatcgaccttgacaatggcgcggtggttcgtcctcttggcgtccatgaactcggcgaactcgccgccgccttgccgcagaagggtggtctcgtcggcgtcctcgatccgacggactagcttgtcgtactcactctagaattatacacaatcaatatgccgttaaagattaaagtgctaaagagattcgataatttaacacgttttaaaatgtgttttgattatttaacattttggacattttcatttactcagatggccccacatgttattctcacaagtatcaattaaaataattgggaaacgaaagaagtgttaaattataaaatttctctgtgtaagctgtggttatttctttttctcctttgtcattttggatgttagcatgttctcactctggtcataatatgtgttgttttcgaattcgtgtagtaatatatgtttaaactttgaccgtcaaattctatttgaacgtttcggttctacttttgaatgttgtatggttaattagatttgtcctgaataaaagtttcaaaatgttatattaacttgtatgtatcttttataagttttatacttagtaatagtaactgataattaatagtcaaactagtgtcccagtgactatgtcgttgtttagcacatcacgttgtgatacgctaaaaaaatagttagcacagttgtgcacctagcataccaacagggacgaatctggaccttggggcctcgcgtagctctattcttgacccataatgttatgggctagctcaattaaacctgatccgcccctaaatttatttagaataaatttcacagaaccccacgttattggggtatctattaacttcagttattgtgatttgttttaagaaatctcatattttagagtaagatatttcaaaaaaaaacctatatttatgtaaatactcatatttcattattacattattgtttttttaataaattcacattgttggctcaaaatacacatttctcttatctagtttaattgttttttcaacttttcaccgcatacaaaactcaccataatcataaccgataataataaatgataaagcagataacgtgtatatatatgtattttaaaaaagatctcaaacatttttatacaattaatatagataaatatattagtcggatagacgatataagcttgtagctgagtttcatgaaacactttgcccctaaaacttgaggtttcatgaaacaaattgtaaaacccgggttttgcattaaggatgccccataaccttcgattctgtgaaatttatttccctctatttcaggttataatacgtcttgactttggtcaaagtcaaagtatttcaagcttaactaagtttatagacaaatataacaatatttataatactaaattagtttaatcaaatcaataattgaatatattttcttaataaatttgttttgggttgaaaatgttagagcaaggataatagtatagctcactttctactattagtccatcttaaagctaatatatataatagattagctataagattagttataattttcttctcctctatctatctctcacttatatatttaatgtatttatcttgaaacttgtgttaagctagctcttgtattagaatcaatactcttgattttttttttgttacctctctcctccacgtaagcttatagtagacttatagctcattattatacttgctcttactattttttttttcaacaaacttggtcaaacttaaagcaatttaattttaactaaagttaaaacgtcttgtaacctaaaaactttggggagtatttacttatccagggatagcataaagccttaccttcatgaatgtccaatcgtctaagaacttccggtcggccgggccgaactccggcgcggaggcgaagtaccggaagggggccctgacggcgacgccgtgccgccggcagaagggcacccacgtcctcgcgaacccggcggcctcccgcagcgcgtagtacgtcaccggcgagcacccgtcgtcagagacgtagcaggccagccttcgccgccgccggcgccgccgccgcccgggtagtagtcgacggcgagcagcgagagcaccttgttcaccgtcaccaccggcggctcgagcgccgggtccgccgtcgtcacgaacatgtcgaccgccggcagctcgtcgatcctgcatcaaagcacactgtctccgcatgagatcgagatggccggagatgcacgacgactttctaggacgatgggcggcgccacaccttccggcgaggttctccgggtaggtgtcgaaccgggcggggctccacttggcgttcatgttgagcagccacacgaacgcgaaccacgcctcgcaggcgaacgccacgcgccacgccgcgccgccgacgccgcgctcctcggcgtcggcggcggtggcgcggcggacgaggagggcgaggaggaggaagagtacgacgaaattggccagcatccacgccgtgcgccggatcggcgccctctcctgcagcttcttctcctcctcctccttctcgccgctcgccgccgccattgttactgctaactagcttcgtcaccactcgagaagtcgagctagaagcagagctgcacgtctctcctctccatatttataccggcgtagctagcaccttcaatcaaatatcaatggcagccatgggtttctctggttgctcttgctcgatcgctggcgtttgtcgcgtctccacgggcgccgtcgatgaaccgccgcgtgacgacgtcgcgtcgagagagaacggccggccggccgagatcaatcatcgatgtcgagtaataattaatttctcttggggcgatctgcacggcctgcatgcatggcgtcacatcgtctggcctagctctaaaacgtagcgatccgatgaccagaaaacgagcagtaattactgagggagatggattagctgcgacatccccttatctcttactcccttcctccgtcatattttaagttatgttctgacgactttctatgtccattgtataattgttcgtcttatttaaaaaatttattaaaagatttagaaaaacaagtcacacataaataatattcatggtttatcacctaataacaataaaaagactaatcttaaaaaattaaaataaaatgaattgtcaaacgttgaacgcaaaaactcgcaactgcacttaagattaggggtggaatcgagccgagccaggcttggctcggcttggctcgtgaaagcttgacaaagaagaggatcggcttggcttggcttgattaatgaaacgagctaaaatagcagctcggcttggctcgtttcaaagctcgagccaactcgagccagcttggttcagatacaggcaatgaggtgatggacggcatcaacgccgtagaggacggaggcggtagaccggcggcgctgggaatggaggcgacaggctggcgacgctgtagatgagggaggccgcggaccggcggcgttggccgctagggatggaggcagtgccataggggagggaggcggcggaccgacagtgtagcggagggaagaggcgccacaggggaggaaggagacggtgcagcgcagcgcctcgatgtcctcatgcggtcgctgcggactcgcggtctcgcgtagtgggaaggggagaagacggctgcctacgcgtggggtgggtgggagactgggagaataggttaggaacttagggtttttgatgggccttgggccacaacagcgacaataatgtgctaggccatttttatgcaaaaagcttgacgagctgaacgagcgggttgcgagctagcttgggctcagctcgatttagaaacgagctgcgtaggcggcttgagcttggctcgtttaggtttcaagccgagccgagcttttgcgagctcgaaccaagcccgagcctgctcacgagcccgagctttttgtccacccctacttaagatgttatagagtgggtatatgccatctaaatagttattatttctttaaaacagattaatgagaaatgtatcactccacaaacatgtaggatcaaattcgacttctacaagttgtaacaaaaataataaattaaattgcgtacattcacggttatatatatttattttttttacgacttatacaagttcaatttgaattcgcatatttatgaaaggttatatttcatattaatttatcttgttaaaaagaatttcaatttttgtaactatttaggtgaaacaaggggatatcttctcgagagatgaaaacacttttccattgttgagtggtcataatgcgaaaccccgtagttcatgcgccgatcgagatgtgatcgtctaatcgagatgtgtggtgttgaaccggtgtgatgcttcttgatgcttcatccatagacaaattgcacgaactgttggaattattacgtggaatatttcaacatttatttttgtagtgtagtcagtttggaagtattgtgtgatagggaataactgatgcacaatgtaacatgagaaaattgttactcgtcgagggtgactgtgtgcacaatgtaacatgagaaattgatactggagatatccagggcgactatgttggaatatagtagatgaattacttgagatacactctactacaataattgtcgtacacatacgtgtttttttccctcgtcacagggtgaaatagatgtgtttgtttacaaaatcggctctattataagctgttgaccaacatgatcatattgaaattaatcttatatacaatatgatcatgatacatgactcacatatgtgtgctagggacttaggtcctgtttgattcagcttagaattattataatatgaattattaagagtaaactgaaacaaacagatagcttattgtgatagtttattataatctataagctagattactgtaatctggtaatccactctaaaggtgcttttttaaattattaggtggctaacagctaacaaacaactaataatccagagaaacaaacaactaacagtttattctatgtaggcttattataatccagcttatagtaatctggcttaataatcttaagctgaaacaaacaggggcttagtcatataactgaactgtctgatcatggttggtgacatggttataagaagtctaatggtctatcgaaaacatttatagtgtatgtatatatgtgtgtgtggaagtggggtccataaatatatcgctaccctctactaacctcataatgtattatgagcggtccacgaaattgatctagaattaaaagcctaacatgaaccaacatcatccaaattttggttgactcaagcaggtaaatatactagctttaggttatgtacaaatcgactcgatggctgagctttttcacgcacctaaaacgagcatagctattactttcttaagaaacttctatatgaaaagtcgaatgaaataaacggtcggtccttaaatttggaccagagcatcacatagatcgtaaatgaggaagtactccagcgcataataagttgtttaattaaaacatagccagtacaggtagccactacaggaatcctggattacatcgggataatagtataatacattagagcatggtgatgtcaggtaaattctaacagtactagcttgtcgggaaatcaaattaggcctggtttagtttaaaaaaaaattattttcgtgatgtgacacccaaaaattttcttttagtgaactaaacaaggtcttagcttggcatggctctgtcataacaaataatcctaacggtgttaaccgtcacaataaatttttccttcatatcatctacaccgtcgggtcgtttattccaatctcaatgacttgtaatacgcatttaatcaatagtctcacgtacggaacttaaattcaaatggatctaatataactatgggaccgtataattatacgttcaaagcgtaaatatctttagaatataatggacgtacgtagcaatacataggatactctccacagaaatttttcctaaaagggaaaaagaaagagtaaattgcatccacggtgcatcaacttggctgatggatgcaatttggtaaaaatgagcgttctagtgcaacaacttgcaatgtaggtgcaatttagtataagaactttataagtgatcgtataaatacaacaacttgcaagataggtacgattttgatacaataaattaaaaagttatgcgacaacttaattattttgagcattttttaataaaaattcaatttgtaagtactaattttgacaatatactagcgcaaatttgtataagtatatttatatttttatcctaataactaaaaactgaaagccaattaaactagatgtagaaattattatatttggttgatatttgagaaggtgaagaaaacaaaaaaaatcttaaaggtaattggatgtaaactgtattactatgtgcagtataattcttaaagattaaattcaatattataaggtaatattcatatgatttttttaaattcaataccttataatattaaattcaatattataaggtaatattataaggtaaaaacattgtgaaaaaaaaactcacctttcatatgcttagcaaagttgatgcaccaaaatactaaattgttaagttcttgtactagaacgcacccacttgtcaagttgttgcactcggacgttcaattctcaagttcatgcactatatcgcacccacctactaaatttgtatcgtgggtgtaatttacttaataaataatgtatagacgtagcaagctgcagcgttggtatccatgtatctctccgagatctctggcgtagcgactacttctgttatcgggcgttcggacatatgcatatatggctgtgtgtacaatcgatcgatcgacagaagcgatcacctcggtgtggacgtctggatgtggtcacgccgcatcttggatggacgtttgtgtttctgtgtgtgtataaaggttttataccgaatgtttctatgtgtacttattttagatgtaaacaaaaatagaaaaaaaatcgaatctgacggaacgtggggctcctcaccgggagaccgcgcaggcccccctttgccggttcggccgggggcgctaagtgagattctttgccctcgatctgtggaatgttcgcgagagagagaatgcacgagacacggacgatgtagacaggttcgggccgctgagaaacgtaataccctactcctgtgttctggtggatctatatatgaaggagttacagagagctggagagcaagagagtttaggctatagaacctctcctcctctttctctcctctagagctcccctatttttgttcttttcttccttccccctttcttttttttcttttctcccttcctctttttttggtgggcaaggtcctccttttatatctcaaggggataccacatgcaccacttctacctactcttctttttggtggggacccaccctatcttgaccaaaatcacagcttgtccttgagtgaggcccagcgccgtcactcgcctgacacaggggatacccctgtcattcctccattaatgggcggagatttgcaatggccgctgtccgaatgaccctccgatgggatgggtcatacctacttccactccgccggaagcagatgcaatgtgggagcacggttgtctgccgatgacgtaaccggcgtcagaccagtcacagaccggtcattcttgtccaccacgcgtcagtttagcatgccgcacgtctgtccttcttcatacaatgacttccttgcaatggttgcgatgaagcctagaatgaatctggctgggactgacgtgccaactccaggagttcccacgccggctccggctagggacgagtgcctggaggctctcattattccgacgggacggggcgaggcgagtgaaaaggccgcctgctgccacctaacccacgatctgaccggtctgtgaccggtcatacgctgcgaccggtcacggaccggataagcgtgcgctgcgctgcattaaatgcagcgtggcgcgctcgtataacccgctataaatgcggttaggtgagcgccgctgtgctcacctaacccacacacgtggcgccaacaccacagggggtcggggcgccccagccctcggggccgaaacgggagcggcccgacccctcggggagacagagggtggggtgtccacgtcaccctcgggcccaacccccctgagggggtcaggccacgtgggtgagggcggctgcccaagcctctagtcacgatactcccggtcccatgtcaccaacagaatctaattcataggagtgatgtgaccatggctaccacggatacaaccattgctcacatcatggatgaacaagaagatatcgagatcaagtactccaagtgctgaaatccgattcggccacctactacactgctgacttcaaacggccaccgaatctgcatacgacctccgttttcggcccgtgagtacttgatggaaagctctcggagccctctttctaacggatccagcctcttctctaaattccatctcgtgtggccggaatcacaggaacaaagtgatgcgtcacctataatgggcctatgggcttgtaacttcttttgggaccccgacccaggtggggcccatgtggggtgcgccccaagctggtggagcacgaccctaggcacccctaggtcatcctcccacccctatatatagctagttacctcttcagggtttctcgggttttgattaattgtaagtttagccattgctacttcgcttgcagcgcgcgtgtcggctagaccgtccgtctgcttgttcggaaccccactttatcgtgtatcaattcatctttgtgtgtcttgtctatctagcaattcagattgcttttatcttgttcttgcttgtttcttcgatttgcttgcaggaataaggttgatttgcaccggcaagatcaacaacccacagagaggtgtatcgatcgctaagacgcaacgcaacgtcttgtacggttgtagtcgggtcgtcaacgtttctcccaaatcgtagttattatcaactcaccgaaagatcaggccaacaacagccgtgagtgtcgagaggaactcagggttcatcaaggagtatcccttccccacctctccttcctctctttcctttttagggcgccggtagcagagaggacgggagagcggcggtcagccagagcaagggagggcaccgatggctcctcacctcttctctccctccctcctctctctctcccatcactggtgctctgagtccagctcgcctatgttggtagcctcgacgagaggctcgtgacggtagatgaggttcgtgtggcccttgcccattgcctccagaccgcgctcgaagtgggtgcgccaaggtcaacaaagccaagaatggtgcggaaggcaggggcttcgctcatcagcggggccatttgaggcaaggagcgcacaaaaggcgatgatcgccgctttttaatacaccattctacacgaggccgggagggcagcgatggcaaagtggggaccgcgccatccagctccttgttatcgtcgctgcctcctcgattgccgtagcatggaggagagtaggtggcgacaaagtagcaacaatagcaaaagctcgacagccaaggaagtcaccatgggaccccgtgtagattggcaactatggtgttgactgaagaatcgattcgggtactgcaagaacccatacctctactatcatgcaaactctgtcctcaatgtatcctcttgcgtgcacggacgggtgaccgagcacgatctcgtgcaggactcatccggctactggtgccactgcttccctttgtactgggataggcagtcgtgcggggcaaagaggcaaccgttttttttatttttagtttcttttgtcacttacatgtgggtcccacatgtacttttaaatttcttcacgactaagttgtcacgtggacatcaaatcagcaaaaaggcaccatcaataccatcaaggaagctattttacacgattttagtagttgaaggagccattatatccggttttacggttgaaggatacgactcatatgatccgacctatatttgagggaatccaattggactttcccaacagaatatacacgctatatcatacatgggctttggaatgggctcggtctaacttggactccgtgcgtgcacatgggctcttacccgttgtgggcctaatatactcatgttcatgggccatctgatcatcaagaagtcatcggaccaggagtccaggataaagggcttctttggcatgcaatcaggtactacgaccattctacaatggctggcccctttacccggtaaattagcatgcatgggcgatccatgggtagagcgacaaaatatgtagtgaaaattaagaaactatgatctgaaaattgttcgtgtcatgaagagtaatggttaaatttgcgagtaaaatttatactcgtgatgacgtagataaatcttagacatattttatttaacgaaagttttcaggttttcattttattcgtgatttgcattacatatttttcccggctagagtagtgcaccatccatgaacgaccgtgccatcatggtccattatccatgtggactagctgaaggctgaagcagtagtgttggagtatcttttttgcctacttgtttgcaggagttattgaaacctacatacgcttccaagatcaatgtccaattattagacatcgaaggacacgaaaagattagtatatgtatggaagcatgcaccgaacatagtgcagatggccccatcgttttggctcattcatcaaataaaccaaacgacatatttacaaataaaaaataatttattaataaaacttttatatacgtgttcttagcgttttaaaaccaaatactgaaaaataaacttcgttgaaaaaaaatcccaaaatcaactgcaaatttatggttaaaatttaaattttggcttatatgcataattataagcgaaaagatgaaaaataaatgaaacaactaaaaataattataattgacttgtttatgctttagaaatctactccatctttcaaaaaaaagtccaaattcatatcattggactttattttacaggaggagtaagtctgaaaaataacctatgaagaaaaaaattcaaaatcaacttaatttaaaattaagttttgaagtttaaattttagctacggtttgtaagccagtactccctccgtaaaaaaaaaccaacctgagaagtcacatgttgtttttttttttactgcagcagccggcggtactcccgcctccaggacgagatcacgcagcacaacaccaagatattagaatcctcgacctccgcgatttcagtttcttattttgcagaaattcaggctctaaaaaatcgaaagccacacatccagagttaaattttcgatcaaaaacctccacgaggtagatctccttgatatcgatcaaacgagtcctgtagtagtaaatttatttgtactttgtattggtgtattttcgttttgcgtctaacatgtaatcgcaaaaatattttatttttattatatatattataatagaaaacatagtgaaagatatattttgaaaaccatgatattattcaaaacgttaacaattatgaaagtgaagaaaataaaggatttacaaatatcacacgatgtacggttattggataactgtaataccgtcataccgtgaggcaacgataacccttatcaagacgacaagggaaaccatgctactaaccacttaaccagcaaccacctgtaaaaaaaaaaagcaaccaaaattttttaggatctctgttctttaaaaaaaggaataatcttgtagatatgatactacacctgttacatgtaatcatgcttgagtccacttgctgtactattgtagctgttgtaatgttaatgtatcaacagtaagcattaactaatcaacatggtccactgaactaggagtagtatagtatatcattaataagccatttgccgatcgcttcaaagaacaggggaatgacgcttgtgatctagcagtgcaaaggtagtactagcaatcagtggcttgtactattgggaccaagccaggtgtttcattcgtcacaacaggcaaaaaaaaatcgaagaaaacgaagtaaaatctccggataaattaagcgcacatctgtccactacctagcttacacgtgtccctttttcaacgtcgctctccagcttgattcttcgagcaagcaacccctccccaggtcgttcctatccggaaaagaaaggaaagacagggaattgctttgcagcaatgtcattagtttttcattcattttcagtcgatttctcgtgtttggatcgacattttcatccataggccggtgatgcttgtatccattgtttcactagagttttatttttatgagaaaccctatgttgggtttaattacttacttcctctgatcataagtactgtattaaacatttaggataaaattcgattagaaattttaaaattttgactaataaattttattacaataattttagcaaatataataaaattatgatgccgtaataatacttttaaagaaaatctatacatataattttttaaaagataactacatactccctccgtcccataatatagcaacccagtactataagatgtctcatccggtactaggttgctatattatgggacggagggagtattcaaaaggctattgatagcttaagttttaaaagtttaaacaaatattattttacattttaaatatttatgatcgaaggtagtatgttaaaagagatgtaagatatatcatatgtgcaatgagccaatgacccatatgtagctaggggtgggcgttcggtctacccaaaaatttcgatctcggtcttcggtttttcggtcacttcggtttttgaaaagtcaggaccgaatttcatccaaaaaatcaggaccgatgaattcggtctcagtctcggtcagaccgaatttggaggagccgaggcggagtatggagacgacgccggcgagatgtggaggcggagggcggaggtggcggcgcggcgcaatggatccggcggccggcggcccgcacgaccggcgaggcggcgtggaggcggagggcggagacgacgccggcgatgtggagacggagggcggaggtggcggtgcggcccgatggatccggcggccggcggcccacgcgaccggcgaggcgacgtggaggctgagggcggaggtggcggcgcggcacgatggacccggtggctggcggcccgcgcgaccggcaaggcggcgtagagacggagacggcgccggcgatgtagagggcggagggcggaggtggtggcgtggtacgatggatccagcggccggcggcccggcgcgaccagcgaggtgcagtggaggcggagggcggagacgggtggagcgatggaggcagcggcagtagtgcggcgcgatggaagggagggtggcgcgatagggatggaatgggaatgcagcctggatggatgagggtggcctctagggtttagtggtgtattaggcttattgggcctcctggacctattgggccacaattcagttttctcgattaattcagttaaccgagcctaataaccgaattacccgaataaatttcggtctttgacatgctgagaccaaattactacacgaatttctcggtctcggtcttttcggtctcggtcttttcggttcggttcttcggttcggtcttattttgcccacccctatatgtagctgaagaaactagtctagagagtagagacgaatggaaggggctggatggccacatgatgtacatgccagaagtacgtggagaaaaggccgtgcgaggtatgtcacacaaggacaggaaaatagaaggagcatggttactgacatccaatgaaatatatggtgtatgtgccaatgtgaaatcagggggcgatcacctaaatatgcatgaaaatgtcaaaaagggagacgataccatagatatgatctataatatgtgcatcgaatttgatatgtcagcctaatattcgacttaaaagtacttttaggataagtgttactttttcttactcttagatatatcttacatttttgcctttaaaaaatgatttttttttccagtgacgactaaacatgaacaccataagctccatggcaaatacacgatatgacatagcaaaaaggttaattcatccgtcccgtaataagtattaagctgcatgcatcgaccagttcaacccgaaagcttaagctgatgaggaaagacagacaattcattttatattccaacactccccctcacgcgaggcgccctcaatccagccaggattcgaactcgagacctttggctctgataccatattaagttgcatgcaccgaccagttgcacctaaaagcctaagctgatgaggaaaggcgggcaattcactttatattccaacaataagttcattttagctcattccgtttattccaaaataagtttatttttagagcaattattacatccgagtttgtgaaattagaaaataattatcttatcaggagtagataaagtgaggaatagttgcattgggatttgataaagtggagtttaatatttttattttgtattgatacgtgtaggataagtgaaagataaacttattttggaacagaggtggtaactaggtgtactacataatttgttgttcaaatttttactgtggagccaagcacaactcccattttatagtcttagtcgccctctcaagaagaaacaatattttgggatcctcttgacaaaatcctaatttgtgatggataaagaggaaagaaggatagtggaagcaccatgaatgctacagttgtttttgatgctggaatttgatgggttgcttttgaccattactcggacaaacttaattcatggtgaaagtgatatagcaaatgtgaaaaaaaaaacagagaggatcagtcctcgatagccatgaagactagcatgtttgtgccaagtcattcatcgacaccacacaagttgctatctctatctcaaaatgttactatctaattaatatatagaatgtaatatcacctagtattataaatataaacagaaaaagattcatccagattcaaatgaacatatatgtatataactcaagtgagtgctcttggctaactttttttttaatataataagttcccaacaattcctacggtggtgcatgcagtccatgtaagaaaaagtttgccttttgatccatttgcaaggcccctaccaaatttctcccctgccacaaaaaaaaccggtgttccacatgggcggctggatatgcactctgccacacgggatccgcgaagattcctgcgcctcgcgggaagccgccactgacaccaaccgccacctctccatgacagcgggtcccacggaatcccgggcccaccgccacgtgaccggggcttagagcaagttcaatattatagcccactactatctctaattcatctatagtcaatctaatagccaattcatataataattgttaactatactattaatatattgtttcacttgtcatacacacattacgtcttatagtccgtgctacagctggctataaatctatagcccg

SEQ ID NO: 79472 - DNA, 13974 bp, Oryza sativa
ttcgttgcgagatgtataaattgaatttgaacttgcatgtttgtggatgatatatcacatgttaatacatcttcttaattttttttacattttttcataactatttgagtgacatacaaacaacgataggatatcccctagagggatcaaaatagtttcccccaatatattattcttgcaataaccatcagttgatcacacaaatcttgagccctgttctggcaccaatgctggcctctagcattatacaacttcagaatacaaatttttgaatgctccttaaggataagtattcataaactgaacaaaaattttctgaatgttcttgcattagtttagtaactgggactagtttcatttgcagagatgcagtcccttcttccaggtcttgttcgcttcatttccgttttgctgtcgtccgaagattgaagcaacaatcaagcctcctaaacaaagttgggcttttttttagcagaatatatatgctctctcttttacgactgcattgtttttctaagctttttttaagaggactgatcgattccaactggtggcagagggggataatggggctaagcccgtgtatttccagcaaatgggcagttcgtttcaaatttctcaaacagactagtttggggtattggtggattgtgtgtttttaagtcagcttgttttttgggcaatttttactggacaaaacacaaacgagcttgatgccaatctgatccacaagactgggcaagagaagcgcgcgtgaggtcagcatgcgcgacacgatgctgacacgtgttttatctgatggccccaaattcggctgaagacacacaagaattcagctggatgatggctagacagtccctagctattatttaacttatataaacttttaaattcaatacatgtgtttagtatttcaagctgtgcacctgttccaagcagggcctaattaaattgtatttaggggaaaagtacatgtacaaaaggtttctatgtttctataatactcttacaaacgacgatgtggaacacaagggtgttgattttctataactccgagcaaactaaaaatcaaacggttataactatgtattttttcatcatgcattgcacagctgattcaattatgttcatagcaaaaggggggaaaaaggtgaatttgtattatatgttatgataaaaagaacacttttacaatgctcctgatatcaatcagtcccacttagatcccaacaagagggaaacaagaaaatgtacacacgcactgactactcttgaccagtacgtaaaacaatcacagtaataactactttatctgttttatatcataaaactttctagcattgtctacatttatatagatattaatgaatctagatatatgtgcatagattcattaacatctatataaatatgaacaatgctataaaattttataatctgaaacggaggtagtaataaacagtggtagcagcagctagctagctaggctaaaagcttaaaattaagctagtagcaagcagctgctggaggtgtcagcggatgcacttgcccggcgtggtccatccgaagcctccccggcgcctcgccgccggcggtgccgccgtgtagttcctccagtcgcggaggacggcggcgaggtcgtgcaccttgttggcgaggccggtgcagcagttggcgtggagcgtgcagaccctggccatgtcgcggctgagctggcagaagccgccgcagtgcgccgtgtcgaggaactgcatccggacgtcggcgcggcggctgagctccgcctgcgcccgctccaggacgtgctgctcgttggtccccggcgggaagcgccgccgcgcgtcgcgccaccgccggtagaagtccaccgtccgcctcgccgcgcgcacgtacaggaagccgccgttgggcctgttccggaggctctccgggtcgccgttgtagtagtcgttggccaccgcgatgtccgacgtgatcgcgatgtgccgcagcgggttccggaaccacatgatgtcaatgtcctgaataattaatgcactactattaatactactttcgagttacatgcatcggccagttcgccgtaaaatttggaatattatgtactatcttttgtagtaaatatttaacgtttaggataatatttgatcaaacttttaaaatttaaaccatcaatattttaccaaatgcttagtttagtttcgagaaatggtatacatcgaaaactactatcataattccacaaattacttttttcttagataatgagaaaatctttataaacttactacttcttccgtttcatattataaatctttctaggattgctcaaattcatatatatgttaataaatctagacagacagacatacatacatacatacgtacgtacgtacgtatacatatatatatgtatgtgtatacatatatatatgtatgtgtatacatatatatatgtatgtgtatacatatatatatatatatatatatatatatatatatatatatatatatatatatattcattagcatctgtatgaatgtggataatgctagaaagtcttataacataaaacggaggaagtagattttataaacgtattctaatatataaaattgattgttgaaaatataaaattttatccgaatctttgtcctaaacatcaaatgtgtttacgaccgaacgatgatttgagttgcatgcgatcgacaaccagtttatgctgtgaagtttgtccaggtaaggtgatcatgattattcataccgtgaagaggaagttgaagccgagctggaggatggtctgctggaagaggttgcgcccccacatcatgtcgaggtagtccttgctcatgaagcgcttctcgtcgctgtagtccacggcgccctccggccgccggaggaggtagcagtgcgggtgcacctggcggcaccgggcgagcgccgcggggtccatggccacgatgaggacgtgcttcagcagcggctccgtgccctcgccgagccggaagctctccaggaagaggtccagcagcgaccccggcgccgcgtacgcccggttgatcgacgtcatgatcaccgtcctgtcgtccatcgacgcgttcctcagcacctcggtcaattctgacaatgctttcatctgcaatcattattattatcttttttcagcctttttccattagatgtttcaaatttgaagatcgatcttgttgttttaagaatctgaactgaaagttagtagcaaatctttccattggatgttgcaaatgtgaagatcttgttgttttgtctaagaatctgaactgaaagttagtagcaagtctttccattggatgttgcaaatgtgaagatctatctcgttgttttgtttaagaatctgaactgaaagttagtagcaagtcgagctgtaaaatttcatagaaagttcactcgaatcatttggctgagttgtaaatgatgtaatatatcctatccccacaaggctgcttggacaacaggttagcatattcgttacctcatcagtagtcagtttcagctttaagcttttgggctctgtggatgtgacaaagctacaggaagcttatctcaggctaatgttggaaaagtagaattggcactttggcttgttgatgattggcttttaaaaaaaaaggaaattctagacttggctaatgctgtggaagatatctgcagcattatattggatatggatttgcttgtcgttgcgtcttagagacttatcagctcactgaatgaagatgtagatagaggaataatctaggacgatagaaagggagaccagtagactacctgaccactaatacccgtctattatgcatagttgcaacttccaactatttgcaacgaaatgaaacagtcccaattaattgcacggccattatctattagaattttgaagcatcttgcaagacaataagaacaagaaaattgaaatgaaaaaaaaggtataaaaaccctttttttattatgtaaaagtataattcggcattactcaaggaaactgcactgaagatgttctcatctcatgttcagaacttcagattgttaagcagaaaacgcagaaagcagcatcggtagatcactgacctcgtcggtgacggccggtggagaatcattgttgttccaggaggccagggcggagagcctccagttgatatccatagtagcaatgacgaacgccgccgtcagcgccgcgccgaggaagaaggagatcaccgggatgagcttgcccatgtcccctctcaccttgcaagccatgttcttggcttcttgctgctgctccctgaacaaggtgatcagaaacaagatggatcatcagagaagagttgtgtggtatgatttatatatgcatgcaacatgtagcttttaccactagtttgttggctcgtttgttacaagaccctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtacaagacctccaaggaagcccacaggttgagccttttctaaagaagagaattttttagccttaatgttgatgattagggggccttgaattggaatctagtacaaaagaattgttctgaaatgttgatattatgcatgataacaaaaaatcaggcatacaacttgcgagagtagtggaacgggaaagaatatgctgcccaaatgtccaagcaaatgagtttgtgcaatgccaatggatgaatcaaatttgcgaagctattctgacgttggaactcaaaaatgaaagatgatgcgtcaatttgaacaaaatctgtattaactgaatgtaatagctaggtagcgaagccattggaaagtcaaaaggagtttttccttgttgtcgctttgcttcgttggtatttgaaaaaaatgaaacgatattaaaaatcttttgcgtactccgtaaaagtgagttgtttgcaagaatttgaagggacataccaattggagaaataaaaagtcagagtcaatgcaattcaaaagacaaaaaatgatgccttcaattcgaaataaaaaccatatgggtttaacatcctattgaaatcctcaatagagaaattcaactccagattcctatgggtgattcgcaaaactgatattgaaacccaaaaggcacagttgatctctgaaaaactgaattcagaaatttaccgtgaagcagttcatccataacctatttatgttaaattctgttggaaacattgtcatgcaagtgtgatattattagtgtgaacaagtttgtatgtacggaatcatgtacgacatgcatgtaggagatgtattacttggtcagctatgatgcatgtgcttgcatgagttagttgagttggttaattagtggctgagccatgtgttcgatgcatggccagcagagttagtgcatgcagagtacgttgtggtcaaggtaattactactaatttagcatttgtatttaaggaggggttcaggaagcttctacagttgaggttgagtcttgaaataaacaggacaaaaaaaatatggtgtttggaaccacagaaaatcagtgtctattcatatttgcgttcatcatgtgtatacatttgaagttgagcgatcaaatcccaacaaaattcagagatttcagtcaaaaataaataaattcagaaatgtcactacacttgtgtaatgtactacttaccggccccaaaaccgtcgttttgtactttgtctgaaactgatgtaaaaacgataaattaaaacgccttccctgaattaattaatcacgacgatcaaacgacctcgtatcataacaaaaataataataaataatcatacggaattgtatgcgattgtgagcaataacatcctaatgatggtgattgaagatctcgaagtcaagagagggaggactcgcggttgatttacctaccgagacgggagttaaccgctcgcggcgggcggcggcggcggcctgcgacggcgagggagtggaggcgacgagagaggtgtgggcgagcagccaccgcggcggcgatgaggagggggtgcggcggcggcggcgtgccggcgtgggagtgcgtgtgttggcgagagacgacgacgccgcggcgccgcctttcgccctctcccccgcgtgcgcggttgggcttgggctggctcgcatgtctctggccgaaacggccgtaattgggccgcgtatcgaaggagttgggccgaattgacgtaaaccgagtacggctccgggccgaaactaccgcgttgctgggattttattgcgaacaaacattattattacctgaaaaatatacatgcataccaatataccatgctccctccaaatctaaaatataaattggacaatatctttctattataatatactctctcggttccaaaatataagtgccaaaataaacatttttaactttgaccgctaatagcaaaaaaataaaaataaaaaaaataaatcatgtaacattgatattactagattttttattaaacaaactttcataatatgcaactctttttatttaaaacataatattgttggtcaaagtatattttggaacagagggagcatccaataaacaaaaaatatatttctatttttattgcagtattttgtaagacaaatctatatatgttgttctagcgcctttaaactaaatatttttaaagttgttataatagttaaagttataaaagtttgatcttaatcttatccaaaacgttaagaattataaaaccgggaggattacgtgcataccaatatatcaatttgaaatatatacatgcataccattttcaaccctcctaaattttaacgttatcgatggtttatttagtttaaaggcctaatttttaccatatcaaaattaattttggcaacttcaatagtatcaattgaatgtttggttggctaccaattttgcacacactagtttaaattctatattgtctcaaaaaaaagtttaaattctattctatgctaaaacttgttaagattttgaaactaataaaattttggtttggcaaaaatttggctccaaacaaaacaagctcaaaatgcacaggcatcaccatgtttgcacatcacatgctaaaacacaactttatgtgcataattatgagcactagaatttacaatattatgtgtctacggactcatatcctctgcagcagcaacgtgcatatgggctcaaataagagtggagtaggacctaaatgtcagtggctttcatatctcgtagagaatttttgttcggcaccccttttctcagcccctctcactcgttttccgcacgtacacttttcaaactactaaacggtatgttttttgcaaaaagtttacatacagaagttgcttaaaaaaccatattgatccatttttgaaaagaaaataacaaatacttaattaatcacgtgctaatatattgcttcattttccgtgcttagtgcacgttgggagccggctgtagcgaacacacccagccaacaatgctgcttccacgatgcgcaaacaattgtcaggaccatatgcatggactttgcagtacatacatatgtaagtttcattagcatgcagttcaatcacaactgaaagtgaaaccacacggcatctgccgcattcaggcccgagaagtgggctctacatgtcacaaatttttcccttttttcacacgccgctgtaactagcgacaggggccttcaaaattcaacacccgaagtttttatcacagcagcaaacactaacacacgaaatcgcacgatttcggtacctccaatggtataccacaaacaaccaaacaccagtatatatctctctcacggtaatgttagctctaatgtgatcttttcacatcgccaaagaagccagtatcaatccctgattagtctgtaccgaagtagcgatcaccatactctcctaaccctgggatcacccggtactcctcgttcaacccagtttcgatctctgaggttacaatcttcagacgagggaatcgcttgcagacacaatggaccccttcaggagcctgttcatcgaaatgccattaccaagtttgcacaaaatgaatcatgtactatatcagtattaaccatgtcaaagagctggagtattttaccgagatgagattgagaaacatgatccgctcctcaggaactccactacttataagaagttctatagcttgatttgccgagttacctgtacagttgaatagttatgataagaaactttagctgtgacttcagtagttctcattccgacaagcaagcaaacatcactatgaaaggagcattggataaattcaacactacctgtaccaagcacaggatccatgagtagaacatgtcgttcagcaatatccaagggaaacttgtggtatatgagctggacaaggggaaaaacaaggtccgttcaaaatttcgcagaaagtgaactatttccatggtattttcaagaaaactacaaagcatttcacctgttgtccattgtccccatcccgatgtattagaattttgcctattttaatccccttacaacaagcacgtaatgcattctccatgctttctccactgcaaaacaacatatataccaagttatttcatgcagtaagtacataaggataaaaataaatcaaagaaatgggtcgtaagtctaactaaactacactgctggtcagcatgggctgagttatgagtaccaaatacatacccctccgtcccaaaaaacagaccaatcctacctacgaacgtggacacatgtgtatccaggttcgtagctaggaattcgtttttttttgggacagagtagtattgaataaagattttcatcactgaacactaaatcaatgtatacacaataatctgcaaaagaacttatatggtatagaaattcactcaggttttattaaccattaaaggaaggttcaacactagaagctgcagataatccaactttttttttgcatttgaagctattagttttcaggaaagcaatggcttaccttcgaataattgacacaccacagagcttcttacaaaagtcaactcccatgtaagtagaccctggacaaaagaacagaatgagtatgacgtcataaatgtgcaaccttccaacatttgtttacattaacataaatggacagtgctacgtgcgtgaaactgtagacaaccagtaattgcagcgctttgctttctctttattaatacaatgccagtgaagctggacctttataaaaaagaataattcatgaagtaattgggtgatcagacaacaatcttttagaagccccagattcaagatttctcttggcaatgaatattgaaccaagatggttagattcatttgattcacagctgcttacattccatatttttccactttgaatggagaagctcctttatcgccataaaattaaaatcagtagtaaaattgtaaaggggttattggagctcttgttgctccttgttatttttcaggacaaaagataataggtaagtgtttgttgaaatttagatgcacaactttatcattttagacctattttattggagcggtgcaaaaacatatttcccattgcttgttgcaaagacacaaaaatggttcttagtaaaaccaccatggattcaaatggctctgggcaaaaccataaacatgcaattggaaatgtcaaatcccacactttcataatggtatatatagcagatccagttttgccaaaactgtccttccatttctacagttcacaaacactattcttagataccatagaaacattgttaagaaaacctccagagcatatactaagttgctaccactaagagataattccaaacatacttaaggtgttactttttctttttctggctggcatatgctaatggatttatatagggcaaattccaagaacaaaaataaataggcgcaaagtataatggaaccagcaaagcacctgttggtgtaacaatctgcttctctgtgaaaggcaaatgccccagtccatgctcaactacctagcaatatatttattttccacatgaataacacatcaataaacagtcagacacattcagtagctatgtagaactagagaagggtacagaggccaaaaagaatgagtgctaccagacgaatcagacgatctgaataaaagacgaaatctggagttgcaatgtcccggtcgcgaataagagtatgcattccacgtatctgttaatcgagtgtttataaccatgggttgggaataaaataacattatgaaacttaggatcgagagaaactattgattgtacctggaaagttgtattaaccacataaacatttgggtagattttgcataagtcatgctgaccaagttttgtacgaatatgttgcacaattaaatctatggcaacatggttatctccccctcgcggtatgatcacatcagcatattttttggaaggaagaacaaaatcatcgaacgcaggcttcacaaacctcccatactacaattcaataaggttcatcaaaagtgtcattacatatgtattacaaacatcagggcatgcagattttgtgacatatttaaatagaaaaagactaaaataacatagacgggtgtttaaattacctgctccagcactgagatgacatctctacctctttcaactgtatcacgccttatacgccgggcaagtctaatatcggcatctaaattgatgcataaaatacaaagggataaaggtgaatgatcacaaacgatattgttaccataatatctattatattatacctaacaaagaggagcaacaaacctgtgtcaacaaaaattttcatatccatcaaatcacgaaccctttgatcatgaaaaactaaaatgccctccaaaatgatgacatctgatgcattaacctaagaaaacaaaatagtcaaaaggtttttaagcctaattaacaatcataattcattaggtttcactaccattaaagaaatccagaaaatagaccaacaacgacactgaacagaaaaagaaataccacccataaattattgccatggcgaaactagggctgggttggttatgaaaaaatttcatgaatcataactgctacataggttgagcaaggtccacagtagcttcttagacatatgatgtactctttatattgcatatccttatatcctttccccgcccacaaaaaaggtcactttatagtatactcttttagcatgtgtagctcatttattaatggagacttcatagtacactacttaactatgtgcctatagattcaatattttggcaccaaatttctagaacagaatgtgaaataaggcacaccagatgccatcaatctacataagacctttgcatacaaagttatcaaccagtaattaatcatagataaaaggtgtaataacaatagataaacaggaattatctttttcacaccaaaggtcaacaacgacattactacctttctaaaactttcagagcatcgacggtggttcttaaaatcatatataggaatatttacagatagcccacttttaagctgtcccatgcactctaaaagttgctctgtatcaaatgcatctgcaaaaaagaaagaacgaaaatatcttagtctcttcccaacgtaaagcagattgaaacctcgagaactcaaaaggcaatcaatttttatcaaatcaagcacctgggtgatcaaagttgtaatcttgcacacggtcagattcttcctcagttaaaccacggtagaatgaatcctgcaaaattgaaactttagctgaagtatatagaataattgcagaaatgatctatcagacatagtcaacaactagtctttgctcttttgatgaagctcttattcaaatgacagcaacttgcaagtacccagatcagcattcacccaactgagcaagaaaccacagccaaccatacaagacacacaactgaatacagatgcgaatatgaaagcaatttcatgcttctagcttgccaatacgcaggcaatgatttaatcaaatgcacattttgttcaagctgctccgaaagaagttcttttcacaacgcatttccccttttgacaacttgcacaaatagcaattctgcctgcttgccttaaagaaaagaaacaagctatgaatggtacagagaagaaaaaatataatactgcacgaaaggccctacatgtttaggcattaggatgcatacaaactgcacatacaagaaagtggagtaccatactcatcctcgaccttgactgttcaaatcatgtcatttttggacctaccgcatcacaatatgttccactccgtaagttattttgtactaacaacaaaccatacactgatcactgcaacaacggattggctgattgaacaaaacgctcgaaacacgaaatctcactactaggcaagcatatgcatatagcaaccaaccaagcagacatgatatgcatcctgacgatgcaacgaggcacaccacacctggttgacgagcacgacgcggtggtcgtgcagctgctggatgatcatgtcgcagaccgtcgtcttccccgacgccgtccctcccgacacaccttcgccaaccacaaccaccaaaattcaaaacaaacaccaccaaggattacgattacgagagagagagagagcgggcggaggagtgcgtaccgatcacgaagggctgcttgctcccctcctccgcggctgcggcggcggaggggggtggcc

SEQ ID NO: 79473 - DNA, 2672 bp, Oryza sativa
agcattgtcattttgccctaaatcatcagccttacttggcgagcgctgttccacttcaacagaatctgcagaatcaagcatatataaggctataatttatctgcatcagcaacaacacacaaccatcaacctccattctctacgatctgaagctgcctttcttcgagaatcaccatacttgattaagtaaaccaaccttctagagcaaaattttatgtatgaagacaaggacttaacaaataaacagtcttccactctaaggtcttaactgctagactacgacaaacaactctgccatgctaacagtgctcaaatatcatacttcttttatgtagccatcctgaaggtttactagatatttcttcagtccatgtgttagtaagtccttacaaatttttctctgtttgactagaattggagctccattccgaaaaaagtgcccgttttctcgttatgatgagaaaaacaatggtggtgtgactacaatactcctctgtttctttcatttattcctcaaaagatgtacatggtctgggaaaccctctatacctgcatatctgttcaaaaatgttctctctccttttatttagaaacacaatgcataaacttaccaccatccaaaggctcagatgttttctctttgtccacatctcccagttctaaactagcgatatgagaaacactgccttcagcaattgctttgacaatttcggtgttactcgtgtcaccctctgggaatagtttgataccagtcttctctcgagacatgcaacttatgtcccttggtggcgatgcaatactttttggcggaggcctctctgatggcagtggaactgagagctcatacattacttcatgggaaactgaattatatgagcaatggctgcaggaaatggtagcagacagttgaacacgaaaaatggaatcaacaactgtaggagatactggaggcaccattgacttctcctccttatccaattcattgagtacaaagcaaagcaattcatggctatcttgcatatcactgcctacaaattgtgcattcaaaacacgaacacgatccaagaacttcgtcgggttcagtgggcgttgtgcattattaacactgtttacctcctgaaagagctcttttagtgcgctacccacgaacccagaaggagcatctgatgctaacatccttgcccgcagtttttcaagcacaaagaggcactgcaataacgcattcacgtagcaagtgttcccaagattcggaatccctctgataacacagccatgcctctttgctaatccagattcttgatcaaatgcctccttgccaaacaccatccccctctcagcattcggtgcacctaggatcaattcgaattcacatttgaagcagtaccccatatatggattactgtaccacaaaccaacccaatggtgttcacacttctgggcatgcagacgggcatgtccatacggttttttcatggcctcagctctagtgcagaaatgcttgttgcatcctgtgcaaaccatgatatgggtattcccagtgatcgtacacccgggatgttggcacgccggaacgttcttggaggcgaagatctctgacacgatcagagtgatttcttcctcatccaatacaaagtgttcgcatcccacttggtcgctgctgctgtcactttctgcctccatgtcactcatctccaagttcagacaacgttcacaaatgaagcagtacagagtatccggtttactgaacaacgcagcaacacaatgcttctccagatgagcgtagaattgggcgtgttcctgggcgtgtccctgcggcttgttcatggtcccgtccccaatgcaaaaaggcaagctgcagtcgatgcacaccatgatactgctcttgtccaccttgctatcgcacatgagacgctgacaactcggggtgaacttggaggccatgagccttgatacgaacattgccatgtcttcctcgaaacgttctaagtgggggcataacccttcctcggtgttgctggtcggcgccgccgccttctccttaggcttgctcacctccggcggagccgtctcgccgcattcgggatcgggcgtggccgcagccagcgggtccaggtccttgcggggggatttgagcggcctccccttgctcgccttgtcgtcgtccatcacgcctggggacgcaagaacaacaagaaagaatcgagttaatccataaaatccccatcgaatcaaacaaagccatacgaaaaaaacagcacaaaccaagcatgaaacaacaaggctaaacggaacaagcaaatcatcaaacaggttggccgccgttaggcgagggacgaccaaaatccaactccaacaacaaaccacgccacgcacgaacccgtactcaggctagggcaaaccacgagagctccacaagcggggaaaccacggaaattccggcgaggaaccacgaacgcggcggattccagcaccaagcaaaaccccaacccgaacccttaccctcactaccaccaccaccaccaccaccaccctaaccacaaccaacaacaacaaaaaacagagcgatcaaccccgcgtcggcgacgaacagggggatttggggggagaaatggaggggaaatctcaccgggaagacgcgaggagggcgccgaatcgatcgggcgcgcgagccg

SEQ ID NO: 79474 - DNA, 756 bp, Oryza sativa
gattattctgcactatctgagtcctcatttatccttgcaatttttgtgcctcagtccctttgggatccccattcaatgtagtgaaagaaaattatcgcaacttcaattgtgttgttgggaattccttttcgctcaaccagcacaggccacaactctaagcattgaatttttcttgttgtttagtacatggattacttcacacatcccatggatttggtacatttgcacataagttgtatttgttggatgttgttgcatggatcatctgcacctatcattggctcattcctgaaagtgtgtcttttagtatttcaatatcttaattttactggcatatttcttcccggagaattgatattaaatgcactgctgcttttaggtcacatctgtttcatttagcaactgtggtacctatttttcggcttctagcacatcaaacaacacactggtttgggacacaagaatagttccattaaaccaaagcagggatgtttcacgaagtaaagacatgcgttttttccggcctttgcattgcctgagccacggcaagcagatgcctactgcagaatatacaagtcaactgcccgggtaatcatcaaatttaagtgtcgaattattgcatctagtgataatttgttgtttaaaacaatgtttatggttatgacctttgcggggctccctatatttattttgagaattagtagcttaaatagcattttattgtctattttgatgaactctttatgaattttgaga

SEQ ID NO: 79475 - DNA, 7961 bp, Oryza sativa
tcctgcagcccggtaggcttttactaaagtgtgtatattttctctgaaatgcattctacttggagtaagttccctctgtggatcttggtttagatattaaattctgttttatatttatgtattgccatatcatccaccaccaaacctggtatactatgtgcattccgatttaggttccttcattaatgataaaaattatgattaactggttactaggaaaatggtttgcggtaaacatgtgaatttcatgtttatttcttctgctatatgtcaatcaatgttgaatatgcaccacgttttttccagggaaaacacaaggagaagaagcacaaaaaggaaagtaaggaaaggagaggacgagaaagaaaagaaaagaatagcgatcgtaggaaagataagcacagcaagaagcacaaaagagagaagcacaaagataagagaaagaacaaggatgatgatagatacacaaatcaaactttggaaaaagcaactctgaggaatgcagatctcgacaatggaaggcttaaagaaaaaatacaacacgaagctgtcaaagatattaaacctgcaaatgagttggttacccaaatcctagatcaagaaggtcatgcaaaccacacaagcagtagtactggcaagttgctccctagtaccaaaagctttggttctgcaggttctaaagggaagaaaagatctttgagcagtgtgattgagaaatccagacaacccacacatctcaatcatgagatgatagagaagaaatatagtgttgcttatgactgtgctagccttgggtctaaacctcgattacagaatgggaggagccttcaagttggatctgccgaaaagcactcgaatacaaatagaaagcacagtcataacagaatggaccgaccacaaagaaatactgaaggtacaagtactattaccacggttgtatcaggtgcagagagggctccaaatggcgtagttacaccaagtccaaattccttgctgagaacagaacaagtgggccaagatccagtggtttcttcccattttccttctagaaatagtgacagcatgagccccagagggctgatggagatcaggaatggaaataatagcgatttccagatcagaatggatcggcaatcagtacgcagtaaagctggagcagttaaaaggaagggaaagactaaagagctgaaaagtaatgatcacaagtatgttgaagacaaagatagggatcggcttgcaaatgaaagaaagactaaagacagaattgaagagaaagaaaaggtgggaaaagttgttgtaagtaagcaggaatgcaaagaacttgattctcttggcgcaagcaagaataagatagatggtttgcagcggcagttgggtcaacttaatgaggagttcacttctgatgatgtcaagaaaaggaaagatgccgaggctaacagttctctacttggtaagatcctcttccttatgagtgcccaaagagcatttcttttcttgttatcgataactgaatcatttgatgtttgacacataatagtatgtttgaatagtccactagatattattttaattccatttactctcacaatatgttggcagtggcagagcatagtatgcgaatgaataagttgccaaggatatctcctactgatcctcgtacaaatggtgaaatattggactattctcaagggagtggacctagttcacctgttgggacgaatacttataaggcagatagatttcaagatagcaaggaatgctacaataacggcgtcactggttctcatcatctcaaggaactgaaaacttcggtttcttcatccaaccatggaagtagccaagtctctccgaaaccgcctcatcctgatgccaagtatctgggccaagtgtactctataccagcaatggatgactggtctaagtgcattgatcaaagctggctattgtccaggggtagtgttgactggaaatcagagatattggaggctgcagaatcaccccgagtctgggctgaagcgcgactgatcgattccgcagacgtagttgccttgccttacgttgttcccctataataatgtggtactcccatcatgatgcacatggcgaaaaacttccagattttgtgatgtgatctggaactcgcctgttcggtttgcttcctgctggctgtacacatgaggtcattcaaaataattctaaattcccatcgcatcgcctaacgaagatcgaagatcagagtgttatacatcaaacaacttctcagctgggagtgttactcctgcattgctctacaatttttgggtcatgtaatttgatctttcacagaatctatagcgaggtaagaaagcgaaaccggcgccgcaaaatatcttgaaactctgcttgttcatatcctgttcttctgattaaagaacagcttagcttgagattgttctgttcacttgcaatttgcaggagtaacaaacgcttatttttgcatttctgtatcttactatcctttctacataaatactgtgattatctgaacaagattccacgatggagtgtctggacttctggagatgtttatcgatgtgatttctgattctgtgatatatgaattgattcatgtgaaactccaataaaatcggaaagcttcgaacaagcattaaaatccagcacacactctattgggccggtctctgcaagcccaaattcaaattagcctgcaaggttacgtgcctgtaattgaatctctcccatatttttttgctaaattttgtttcgttttgaattcaaagcttatctaaaactatctcttcctaaaaatcctcagaccgaagtgatcaacaacctaccaataaaatcataacaacttaacaaaacacggaaaagaaaagaaaaaaaataaattaaaaaaaaaaagcagagatgtcttcttcctccctcgccgccgccgccgccgccgccttcctcctcgccgtcgccatgtcgtgccattgccatggtgatgatcacctcacctcgcgcctcgacgatttcatggcgttgagctaatgcctaatggcttctgttgctttgcattgcagtggcgcgagggtggggcggactcggcgtcaactacggcacggtcgccgacgacctccccacggcggcgcgctccgtcgagctcctccgcgcggcgggcgcgggggcggtgaggatctacgacgcgaacgcggacatcctgcgcgcgctcgccgggacgggcgtgccggtgtccgtcacggtgccgaacgacgccatcccgtcgctcgccgcggcggcgtcgcccgccgccgtggacgagtgggtggcgcgcaacctcgcgccgcacatcccggcggcgcgggtgctgtgcctgctcgtcgggaacgaggtgctctccgaccgcgccaccgcggggaccgcgtggcccagcctcgtgccggcgatggccaacctccgccgcgcgctctccgcgcgcggtctcggccgcgtcaaggtcgggacgacgctcgccatggacgcgctcggtacctcctacccgccgtccgccggcgcgttccgcgacgacatcgccggcgccgtcgtgcggccgctgctcgagttcctgaacgccacgggctcgtactacttcgtcgacgcctacccgtacttcgcctgggcggcgaaccaccgctccatctcgctggactacgccctgttccagggcgaggcgagcacccactacgtcgacccgggcacgggcctcacatacaccaacctgttcgaccaaatgctcgacgcggtcgtcgccgccatggcgaggctcgggtacgggaacgtgaagctggcggtctcggagaccgggtggccgaccgccggcgacgcggacgagctcggcgcgaacgtccacaacgccgccacctacaaccgcaacctcgccgcgcggatggccaagaaccccggcacgccggcgcggccgggagccgagataccggtgttcctcttctccctctacaacgagaaccgcaagccggggccgggcaccgagcggcactggggtctctactacccgaacgcgacgtgggtctacgaggtggacctcgccgggcggcggccggcggcgtcgtacccgccgctggcgcccacgccgccggcgccggaccaggacgggactcccgtgtggtgcgttcttgccggcggcggcggcgaggcggcgaacgagacggcggtggcggccgccgtggagtacgcgtgccggcagcggagcgggacgtgcgccgccatcgaggccggcggcgagtgcaaccagccggacacgctcgccgcgcacgcgagctacgcgttcaatgcgtattggcagctgttcaggaaagctggtggcacctgctacttcaacggccttgcagagaagaccaccatagatccaagtaagttactgctccctccgtttcttgttataaatcgttttgaatttttttagctaaactttttttaagttagatttgtataaaaaaatatagcagcatttcaaacataaagaaaatatattatcattatatattcaatgttacatttaatgatgctaattcggtgttttaaatgttgttaaaattttctataaaattcctcaaacataaagaagtttgactatgaaaaaagtcaaagttattaattatccatttgtgttattcaaaacaagcaaactaatctatagaaattggtgattgctatattgatattgtttgctgtttaagctaatcttcaagttggtgatttgctagttagattggcattactgttttagatttgtgctcattatggttagtcgatgaagtaggttaaattcggtgtttattagtgaggagaaggttttaatgtgttaatgccttctgcaaaacgtaaggaccaattgcagtatcataaaataaaaattatggatcttgaggctaagaaacaaatatagttgagcctccggtgcccatcactcttcactgggatgttggaagctggaatgagcacagctgcatcaatctaacagaatcatataattagtggctgttgctttcaactaatatatagatagctacatgtttattatcatgtactgtatattaatgccgtgccatccactgcttcatttcataaattcttgttggaatgtggccaacttgcaacctgcaaatgtatgcttgtatttttaattttgcaaagggcatgcccaaaaactaactatgatggatttccaattgatcgaaacggccaacagtctatcaattgattttagcattttagtttagttttagtgtgatccaatttgccttgcacattattcttgaaaccctgcctattcctaatttcctgtcagtggaaagtatctgctgcaaagctctgctaattaatgatttcaacgtctttccgccttcaatgagatcaatctaattgctggcgctcatgcattagtgcattagcttgttagataaaagtgaaaaaaaaaacgcgaacgttaggaaaggacctaatatcaaataattagaagaagtgatatcgtctagaccaccatcttatgaagctagctggaaaactcctgaacttttctgtgtctacccaacaacttacaatttatatgcatgtcagcctttgcactcagaagtaaacatgcaaaaccatttgttaacctgcaatgtgatcgcgcagttcctagcttggtggaattcagagtttcagctctaaactgtgctcagaagcaaaatgtatagaaattttatcttcagtctttcactcgtatgctcttatgtcattgtcaactatggtacgactagatctgctatttccatgaacaattttttgtcctctagagaaaagggaaaaaagaccggcaagatatattttttaagataatagaatataatatcccgacaagatatttatcttccgtttacatccttactggttaatgattggttgctaatgtagtaacaagggtgtgttttgcaggccatggatcttgcaagttcattagttctttggattagttatatgcaaaagaagattgacagagcacgatgactggattaggaggaatgaaggtcattgcctatatgacctcagattaattgttctacatgcctctgaagcaagcaaagaatcacctgtgattgatcagcttcaaattgatctcagtttttaaccaagtttttttataactttttttaaccaagttaaattttgtttcctcatctttctcctcaaaaagtaaaagaaaatgttagttcaaaacccaaaatgagtagctttaattatatgtcattcacttggattcaagttctgcttgtttggtagataccaggattacccttagacattgttcggttaatccccaagagaaaaagattagtgtgactgatggaaattaatgtggaattattcctctctaaattttgctcaatcctcttattgatgggattaaacaattctcctcaatcctcttataataagaaaagaggagtaaggttgtgctagtttgtgcctgttgggagcctatccctccggcacgaaaaacgaaatagcttattatcgcataattaattaaatattagctaaaactaacttaaaaaatggattaatataattatttaagcaactttcctataatttatttttgcaaaaaacataccgtttagtagtttgaaaagtgtgctcgcagaaaacgatgtagattagttgagaacaacccaaaagaacacagcttaagtctgctttgcttagcaaagtaaccggacaataaccgtatgtaagggaaacctagttgatacgcaactttgacacaaccaaaataacataaacaaaactacaaaagcgtagcatcaaaaacaaaattgtgggtgaccgttcgttggttggaagagtaggcaaatcaatcgaacaatttttttgtactttacaaacatggccaaacaatctctgaagaaactttgtcgtgagctgttgcaacgtgacaagactcaagctgtccttgccggctccaatggctgtccccatgtttcctccccaatcacatggagagtgatctgatgcacgctttgtagggccccgatccgacggccctcgatcgttggctgtttgatatccaacggcccggatggcgagcagggttcacaaatgcgacgataaccgctcaattattgcacttgcaaatttagaaaccactcgaaccggtcaaatttaaactaaaaggttgacaaattttatccgaagttaaccctttttggtcattaatggttgcgaaagagtaatgtcataatgcacttttaaaagaatctttattaaaatcttggtaaaaaataatttaaccattgaattcaattaatggttggttgaaaatcaagattcagttataatataccacatcagttttttcaaatttttgtatgcgtatgatttccaaatacaaacaatgtgagacgcacttgatagtgaaagtgaggtggcaaacgtgtgactatagggaagcttctagctggagcaatttcttctagaatcagaagctcccttaaacagcccaatttttagtctaaattctaagaaattataatcgtagaatccataaaataaactaaaagtcataagccagaaaacccaggtttttcagattctcagaagctggttatcaaccaattacttctcagaattttaaactccccaaacaggctcataaattcttctaattatttggttgccctattttgtttttagatacgaagaatgcaaaatcacgagacaaaacacaaagcaggacacagtcacacaggctacctcaccaaatcggccggagcaaaggatcctcccttctctctctctctctctctctctctctctctctctctctctctctctcttttggctgcctgtcacgtgggccccaccgtcaccggtgaaagaatcttgacgggttagttacttggttggttggtttgttaccgcctttttgacgcccgcat

SEQ ID NO: 79476 - DNA, 4865 bp, Oryza sativa
tgtacagttgttaacgctcgtgttgaggcagtagtaggtcagcattggtgtacatggtttggtgttaatctgcggcctcgttccgtttagcttgacgtgcatcttctatggaaaatgaagctgagaaataaaatcatgtttatagttttgggtgtatttcatggaaatcattgtgaatgagtttgttggcggcaatgtcgaataaccataatgttttggaaatatcatttggatgagaaactgttggtctttctgcttactgtactatggcataagatttatcaagaacaaagaaaattcacagcatccagataatagagggaaaatatattataataattcgcacgaacagtgctcgtcgatgcttttggcgatgttgtcgccgacgtcgaagctctgcgtctcctggtaatctaggttgaagacgaaactggaggttaacatgttggcaataatcttgcaagcgaccgatatctatatgtaaagtttttaactctcaatccgttttttaatctcttcaataattaacgggaagtcctgcctaagatgaaagtagccattggtgacggccaccttcttgaagttgctctccgccatcaagaagttgaggcacttgctctttagctccgggcaatggtacgtctcggcgtagcctagcgtcgtcgccaccgtctccaccgacacgctctcccacagcttctgtgcacacatcagcttcaacctctccaatgcgtacctgtccgccgccacgagcaagctctcgaaaaaaccggtcgtcgtcgacgacgacgacgacgacgtcgatggcgacggcaaggcgtccgtgtacacgaagtgtagtagagctttgaacgtggccggatcgatgtcgtgcagggtgacgcacggcatggcggcctccgccatggacccgaggagctccgccttgaacaccggcgagcgcgcggcgagcacggcgcggtgcgcgtggaacgtctcgccgcgacggagaacgacacgtcggagcagtcggcgcggtccacgatgccgccgagctggccgccgaggttcgaccgcgggacgggtatagggccgccgtcgtcgtcgtcgccgccgccgccgccggcgtcggcgaagaccacgacaccgcagacgatcgtgaccacgccgtcgacggcgtagagcggctcgaggtcgctccgcctcacgaggtgccggaacgcgccgccgtagccgcgggggtggccggggacactcatcgggaaggccctgtccgagcagatgatcgacggcgcgccgacgccgccgtcgcggcgcatcaggaaggtgtggaagatggccctgacggtgttcgatctcgccggcacgccgatgcgcagggagacgtactcgccattgtcctcctcgcggtagccgcgcgggtagcatctgatgacccacgactgctccccgtcgccgacggcgaagctgttcgtcgtcgtcgtcgtccctgggtactcgagcttcaactcggcgaagctggatgatatcatcatcgtatttttggtgtattattaattaattgcaaaaatatgccgccaaacggacaaattaataaagtttatatatatcgaaaatctcacggacacgctctgcgtatcatgacgtgaactagagtagttcatgacgtgaaccatagtacgttgtaggaatttattttcggcaagataaatgattccttttttatgtacgcatttgagtcatattttgattggtaggagataataagtacttggtgttttatgtttatgctaaactaaacatgtctatctttaactattaatttttaagaaaatgtatggtttaacataataagatgttatgtttttagattcaccatgaaatatatttttgtaatatagatatatttacatgttgtcaaactatatgattttttttattgtttgacttcagatacaacaatgaatttgtcaattttatggattagatatgtcatataattggattcgtaatcaccatagataccacatatatacctaatattatacgataaggtatattgaaatataggaaaatagcagataagaacaacaactcttcgtacttgagggaaggggattgggagtttacacgagggaattgatggtgagattaagataggaatttgatttttcatcccagtctcttgtttggtagaggtaatggaaattgatagggagtttagttggagattagatcattaatgaaaatggatggctgagatttgtttaggcgaagtaaaggagaaatttcctcccaattacctgcccctacccaggtattgaaaatgagggagttcatttctcaattccctatccccatcccactaaaattcccatgtcccccaaccaaacaaaacagttaatagcctcatccctctaaactcccaatcccttctaaaagctccctccaactaaacgggccgctaaggaaatatatataggttgtcaaaatctgacctaaaaagggcaaggtcttatttactcaaagttttaacacgaagtgtagtagagctttgaacgtggccgggtcgatgtcgtgcatcgtgacgcatggcatacggtggtctccaccatcgagccgagggactccgccttgaacaccggtgagcgagtggcgagcacagcccggtgcacgtggaacgtctcgacggaaagcttctggtttttctttcaaggagtaagggcaaaagctctgccgaaggatttcattaagaagggaaaggcctaaggttcacatcatacagattacaaggatcaaaagatcccagacaaaaggcttctggctattttttggtagtcaagtttgtactcgatgaaaccggaggccagcatgttgccggcttgccgccggcgaaggatgaactttctcgagagagaatttttttacccacagcaatgtgaagaagatcgatggtgaggaagcgacggtagttgctgccgataccgctggcggtttaggcggcccatgaagtgcgcagacctagtcaaggcccaagttactccagtctaaagaagtctaaccgcaattcccaagccaaccaaactattcgcaaaataacttttttctttttaaatctagggcctgaacgtttgcttttggagtggttctccagtgctgggaagttatatggttcgttaatcaactaaaatctaatggtccacggagaaaggtatcttccaaaaggtagtaaaaagtgggccaaggtacttaattgatagattgggtggaaggataaataagtaattatcttaattttacagcgataagactactgagagagagtaattcaatcatgagtggcgtgatcgggaattttttttatttttaattttttttattaaaagttttacaaaaataattttccattttgaaaattgacggaagtagtcgcctaccgccctctgggagggtgatttttaaaaatcgtcatcccagagggcagcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggaaggcgatttttgcctcccccctataaagcccagtcccccctctctgaaatttcattatattcactaaaaatccaaaaaaaacgaaaaagagagaggggagggcacagaagggaacggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgcttataaggatgagatgaaggaggcggtgaagcattgggcagtttccttgcagagagagtttagggtggtcaagtcaacaaattatgtgtat

SEQ ID NO: 79477 - DNA, 29048 bp, Oryza sativa
gtggtaattataagtaaggagtacacgatgggtgtctccactcaggtagcggttgttggccaatgcaactaacacaattgcagctgaaatatatggctattgaccggataaagctagtactaataaacaaaattgaaggccgctaaatattactggagagtgaaaaatatcatatattattatggtaaaaagaatgttaatttagtaggaaggaacatatataagagcacattagttgcatagctgatcaggaatacagtcaagtcatatagcaaacatactgaaacaccatcaatattttatatttaaacatctacagatatagtccaattatctacagacattaaaactattatgtaagaatggtagaaaaatttcctgcttagtataagatataggagttgggaaacgaattaccttgcatatataattaagtacacacccttgattaactccttggaggagtgttcgaagctttcagaaaactccaaaaatatttttatatcaccaagctgatttagcgtgacaaaagatattaaaaatatatcttgagtatacatctacatcagaaaagaaaatgaatccgaccgcattttctgcgtagaatctaacatcgttcttgatggggactttgtgaaaaaacacatctatagatgtaccgagatatatataatttcaccagtttaagatcataattaaaatactgaaaaaaaagctccatctgcttagcagcccatatgagtgttacccagctcgatgagttgcattcttcttagatctgatcggtgacaaattaaccaatggatgcatatgatattatttgccacttccttcaaataattcaggacaaagaaggaatatgaatcaactaaatcagtaactaaggacctgaaacctaggaaaacaaaagaggatacagtaataataaaatttgttaagacaatcaaactgagcaaataatgctgctatatactgaatacgtcccataatgcaaaactgaaataaatattcaactcatgctggtacaaatcaaaatggtgtatgaacaaaattagattgatcgaacataaggaaagggaaagttggtgggtagcctgtgtcagatcattggagtgattgaagaggataaccgggtgggagatgcatatcaatctagcaagcagaattgcaagaatagtagtaaaacgccaacagcctggtagaatagtagatcgataaataagtgagatggcaaattggatagagaagcagaacttataaagggataagatctaggagaagaaaagtcattacgccattaatggatttacttgataatagtcatgaagtgttctcctcggtggttgtcgacggtttccgttcgtcacggcacccataactccagaagcattggtgcggaggagaagcgagcgcgggcccgcagcgcagctcccgcgggcacgtgcggtgcggaggaggagcgcaggggtgaaggagaagggaggcgacacgagcgcatctggcggcggcagcggtagcacagatgggtaggtgaaagaagtgggctgggcttcacgcgttaccgagcatccagattagatccaaaggctgagattttacaggtgacgtggcttaaccacaattcagctttgggtcttaactatatagaaagaagggataggggaagtaatcggtgcagtgtatacatgtagttgtgtagatgagatgctagacatcttgtgaaggattttgttcacttgtcaagtgctcatacgcatgacactctaccgaaataggatatggaggcacagggaatttatgtgtcgccgaaagcttttggttcttatccatggctctggagaggaaaatcacttgccaaagaatgctatcagatccggcgctaagctgacctatccttcagacttccagtagcgcctagctagccagcaatctatgttgccgtggaatcggccggcttcgacgacgaccctcacgagccgcattcgatcaagtgctatatggattgcttgcaccacagcctaatcggcgatgaccaaatcatgctaattaaattgatggatgtggttaagacacaaggacaacaataacgaagattggtcgttgttgttttattaactatatgtgttaatgtgtgtgatcttgaagctagattttttatatatacacacacacatacatgtgtgtgtgtctatatatatatatgtatatatgtatatatatatatatatatatatgtatatatatgtatatatatatatatgtatatatatgtatatatatatatgtatatatgtatgtatctatatatgtatgtatgtacgtatgtatgtatgtatgtatgtatgtattagttcatactccatttttatttgcatttagtttccatgtttgtctttgacatggtattgtattcgaaaacgctggcacctgggcgaccggggtgggggtggggagaaaataaggtgatcccccccccccatgcgcatgtgctcccctagggccccaccatgtatctccacaaaaaatgtttcacctagtgtactcacaatgtttcactatgtatagatataatgttgcagtgaattgaaacattcttttacaacaaatcacccacatattttggaaaccctctattaagataattcgtttttttttgttccaccaaaaatgtttcacctagtgtactcacaatgttttactatatatagatctaaggttgtagtgaacagaaacattctttttgctatttgctgaaacattgtttttatataagatgaaacaacgcccgatttaaacgattgaaacattttcgatctacttagtgaaacaattccaatatacttggtggaatatcgtgcaacatttaaaaataattcaataattaataagctaaaaaaatttcgtcggaatatatccatgtgtggtcttgttttaaagatttaattgcaacaaatttaatggtgcaatcggatcatgatttggataaataatttaagagaaaaaatagtttaaagtgatttgcacgaatgcgtcttgctgacgtcagcgcctgatttttcccccctccccatcgggcgcccgattctaagtcgtgtcctattgtatttgatggccgcaattttaatttcccttaactgctccctctatttcatgtaataactggtaatttttgttttggaattgtttggtttgactaccgctataaacatatgttagaatgaaccttttcactagcttgtttacaagactacaagaggtagccaaggacttgcaacatgtcaaattgtccatgttagcttaggaacaagtggactgcatgctaggtgactcttatacatgtggaaatttctctcgcaaactaattaagaatgttagccgaagaaataaaaaagaacctatatgatatatagcatgcatttccattgcgagaatttgtgataatatccaggcgtgggaggtgttgggaacttcgcggcctcatccaatcccaattctcgcaacccgggaaacggggaaagcattctgctactttccctctctgaccaggcaaacccgacagtgttggtggcacatatgactaaacgctcatatgtctatgtaattgcagtgttggtcatgttaactctgtttgccttcaatcgtatgtgttctacaacccgagtgacatccagattaggagggatccaaatgatgatgtgctttttagttttagtttaagcgtttgatctcgtttcattgctttttttaatttgtcagttgcatgcgttgtagcagtgttacgactgcttctacatgcaatggttaatttggttgtaacatgtgttttgcagtggcacatataaacctttgagaaaagtttctttcttttgcaggcataattttacctgaaaaaaaattactacttgatgaaacacaatccaaagtgaacagaaccacggcatttgaatattactcgcaataaatggcgaaaaccatgaattcaaccatattaaaggcggtacaagagtgctatatcgtggaagttgtaaactactccctccagtttcatatttcctatgatgtgaccatggctaccatggatgcaaccattgctcacatcatggatgaacaagaagatatcgagatcaagtactccaagtgctggaatctgattcggccacctactacactgctgacttcaaacggccaccgaatctgcatacgacctccgttttcagcccgtgagtacttgatggaaagctctcggagcctctttccaacggatccagcctcatccccgaattccatctcgtgtggccggaatcacaggcacaaggtgctgcatcacctataatgggcctatgggcttgtaacttcatttgggaccccagctcaggtggggcccatgtggggtgcgccccaaccaggtgaagcacgcccctaggcacccctaggtcatcctcccacccctatatatagctaggtaccccttcagggtttattgggttttgtttagatgaaagtttagccattgctacttccttgcagcgcgcgtgtcggctagaccgtccgtctgcttgtattcgaaaccccaacttatcgtgtgtattcattcctatttgcaattcagattgcttttatcttgttcttgcttgtttcttcgatttacttgtaggaataaggttgatctgcaccggcaagatcaacaacccacggagaggtgtatcgatcgcaaaggcgcaacacaacgtcttgtacggttgtagtcggatcgtcaatgtttctcccaaatcatagttatctcaactcaccgaaagatcgggccaacaacagtcttgagtgccgagtggaactcagggttcatcaggtggtatcagagctttcgttgctcggtgagtcttcatcttcctataaccagaaaatagccatacaaaaaaattcgtatcatttacctaaccatattgtgccattgcattgttcttttcaatttttgctttgttgaattttgtgttgcatcgtcacgtcgtgttgctggtcttagcgtctagttcgtttagagtttcaagttctggtcacgttttgtaccacagtcgtcgctgccaccgtgtctctgttgttgtcgggacctacgaaaatggaatcggctcgctgccacggttctatttttgtagtttctagaagtttctgtcggtcagttttgaagttgcatctagattttgcttgagtttgtagtttggccgtgagtctgtagttctatcgtgcttgtggggaggaatcggttttggaaatatgcaagattgatcaggaaggaaatagtagattggatcgtttaaaaataagtttctgtttttatcctacacaagtccggccttccatatcacagaggactgaaccactctatcttcgccatcctgtgagtccgactccctccctctctcacgtggttcctcggttccgagttgtgttaaacacattggtgaatttttgtttagtgtcggtttcgagatctgtttgcaaaaacagaacctatgggatgagcgcattccatttttgtatagtccaaatttttgggtttgcacttttgcatttgagtccctgtaatttgtatatttatagttgagtccttgtaatcttgcattaaggtccttgagttggtttttgctgaaaaaaaaattaaaaaaaaagaaaaaaaatgcagaaaggtgctaaaaataaagaaaacaaaagccgcaccaaaaaaaaagaaaaaaagaaaagaaagaaagaaaaagatagaaaaagaaagaaagaaaagagaaaaatcagttgtatctttgagtttgctttcacaaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacctagagctccacagatttgattgcagccgtacagcaagtgtttgccaaggcatcgatacatccaacctctattggggtgcttgattgagtcggtgtatgtcaccattccgcttgccttggtaagatcttgtaagagcttagttaaaagcttgagtttgtgtgatttttgagctgccactatctagtagttaataggaacgcgcatatttttgtgtatgtttcttgtttgctactaaccatggcaggattgtgcccgcggaaacgagatggtcatgctcaacgtcaacatcttcaccatcaacgagatatagcgacttcttcacgcatcacatatgaggtacatgataatgatcttacaagggtagaatctaaattgcctggttttgatggtaagtatgattccgccgcttatgttaattgggaactagcagtagaaaaacaatttgatgagtatgatttttctaatgctcaaatgattaaggctgctagtaataagtgtaccggttctgtgtctttttggtggcatactgtgggaaataagcttgaaacttaggatgaatgcaaaatactgatgagaaaaagatttgtgttttcatactatagacgtgctctccttgagaaatttgaacatctaaaataaggtgacaaaactgttagggagtactttcatgattttaaaattggtatcacttatagtgatttacaagaatctaatgagaacacaatgactagatttttcagatgacttaattccaatattcaggctgggcttgttaatgtgacatataatcatataggccaattgttcatgcttgcttgcaatgttgagcgcaaaattttggagaacccaacggagcaacaagctatgcttgtgcctcctatcactgatgttttgcaggaagttcagaacagtccccaaaatgagaagaacgatatgtttgagatgtcacttccttcactcgcgaatgaggagaaggctaatgcacctacattatctgaagagggcataaaaggtaaattaaatggtgcagaaattactcaagatgagtatgcttctgatgaattacatttttccactttccatgctgatctagagcaaactttagtggaacctacttctgaattgcctttgtcacaagttgatttgcattctgttccttgtgataaagaagagttgtgcgatagtacttcacttatatccattccacaactagtgaatgaacatgctacttttaatcttgattctccatgtactgaatttaagtatgttattcacacgtccagcgagaatgatgaacttcaattgcaatcttctttaaatacattgggctatgttatgtttgatgattcttgtgagctcaattgtttgaaggacaaaatatttgctcattctgattagccaagtcctcgtaatgttatatttcacatctttggcgattataatgatcttggaatatattctgtgcatagagtttacatctgctcagatttagaacatcctgtacatgtggataaaacatgcaagctagagaaaatgttattgctaaccaaattgtctcgagtttgccttgttttgattggaagaaacaggttgttgtaaatggactacgcaaagagcactatatggaaaaaccgaggacggttttccgtaaagaaggggaggatgatgtgaccatggctaccacgtatgcaaccattgctcacatcatggatgaacaagaagatatcgagatcaagtactccaagtgctggaatctgattcggccacctactacactgctgacttcaaacggccaccgaatctgcatacgacctccgttttcggcccgtgagtacttgatggaaagctctcagagccctctttccaacggatccagcctcatccccgaattccatctcgtgtggccggaatcacaggcacaaggtgctgcgtcacctataatgggcctatgggcttgtaacttcatttgggaccccggcccaggtggggcccatgtggggtgcgccccaaccaggtggagcacgcccctaggcatccctaggtcgtcctcccacccctatatatagctaggtaccccttcagggtttattgggttttgtttagatgaaagtttagccattgctacttccttgcagcgcgcgtgtcggctagaccatccgtctgcttgtattcgaaaccccaacttatcgtgtgtattcattcctatttgcaattcagattacttttatcttgttcttgcttgtttcttcgatttgcttacaggaataaggttgatctgcaccggcaagatcaacaacccacggagaggtgtatcgatcgcaaaggcgcaacacaacgtcttgtacggttgtagtcggatcgtcaacgtttctcccaaatcgtagttatctcaactcaccgaaagatcgggccaacaatagccttgagtgtcgagtggaactcagagttcatcgtcctatctttgtgaaaataattttatttacctagcaatggttaaaacagcagaagtactagcaaggagatctaaagagagaaaaaaccgccctatggtctaaagagtagaagtactcttcataaagtagaaaatttcagtttcagagaactgaaactcccaaacctgcacatgatgtgatactgaatattagatacatgtcacattcagtaatgcaaatcactagaattacatttttttagataatgagttgggattgtacaaggagtaccaagtaactatgagctagcaatataatgaagaaacatgtcaaactttgttttgggggaaaaccaaaaacagaataatctcagattctttgcatttgagctaaaaatcataatgttattgcatacagtacacaaacttttgttccgtagggtttgagttattgcaagcggccagtatatacacatgcatatgtagagccacagttagtagcttcagctagcttgaagagaactcgaccatgagtgcatcagacagctcgagcgacggcggcaaggaaaggaaatgatcagttacatacggtcaatagttcaatatcctattatcctggcaacaatatatttgcccttacaacacgagatatgtgggattgaaaggtttcaggaatttatctaggtcgacctatctccctgtggcctgtgggaagaaatacaagacgcaaattgagtgaagagataatgcatgattgaacatgaaagttttaatccctatgatagtgttggacggagatcaaaagaaacaaaagttgtatgttatgagcaggagtgtcagaatgctagagggtgaccacacccatgtccttctacttgggttcaacccctctgcatcactatagtaactaccgctgcatgatagacattattaacatttttctatttacgtgctccatgctaggagaaggactgtgttgtaacagaggtgtagagaatataggtacctgatatccatacgacctatacagaaaatgcacacatgtgtatccaaatagatgcacacatacatgttgatacatatctagtttggtctatactctctcctgagcgattgtagcaagtagcatatatatactaccattttgatgagttcatgaacaaaaacattgataaaaatggccttaaaagattggtttatcgaagatcgagcagtatgccagtataagaagctatacatagtgccaaacagtcatagcgaggcaatttcaaagatattttacttgcttccttttcgaaataaaaaaaaaagggttatgccaaattaagtttgagctgcatggagatagtatgccataaacttggtaggtgtcaggaatatataaactactgaacaattgaaaagtggatggcacccaacagaaggatgcagaatcagtgatggttgttgggcttgctttggcagtgtatatatgtgcaatcgaaggcaatctcaagatgtccagggaaatatttgccccctatatatgtcatgcacctcacagtagttctccggccaaagaaaacaactgtgaggtgcatgtacttcaccgattgtagtacttccggcttccgttgagctctgctagcctaggagaaagctgcaggttccatagcatttgcggacgatttctgatcagccttttattttcttgctgatcctactcctttttttcatattataagtcgtttgattttttttaagttaaaattctttaagtttgactaagtttatagaaaaaaattagcaaaagaattcattaggatttttgacttcatgctctgccaccagcccgtttgatcatttagcaccaaatcggataggaacatgaacgtacgtaaaaaagaacaagttctatgacattcataatgtatcttgaatccatttacagctttccagtttccagccctatattacagccaatgcagaatgcatgcctgcactttgacttcagatctcactacaccatgacaccaaagtatgtaccaacaggcatatgttggtaaaatttttttaaaaaaaaacatcactgatgaactatatgccagtaaaggttattggcgtactatatttcagcaattctgtatagtaggatacactatgtgtcggcaattctatgttgctttggagctacactatatgtcggaaatttgtgttgccaagacaacagaggcaaactaaaatgtgccaaaagagccttcgatcaattggattaaaactgcattactccatagaattattgctcaaccctatcaagtaggaaataaaatggattacttctatataattcacggacatactagttcagtgtaacatggcaacgacggatgcatgtaagaaaacctccacgctgtgcacacattgatgtcatcgtgtggcaagaggggtactattgatcgatattgttataaaacttccgccaatagcacatcgagatctgaacacaaaaaaaaagttatagaatatgcaaatttgatgacaacactaaggcaaggcaagatatttgttaacgaggtttagccgaagcctatatctcaagacactaattattggtgttcctccccaatctaatataattataggttgtgtttgatacatgagattggtaacccatctcctccgcacggaaaatagagcggtccattagcgcgtgattaattaagtattagctattttaaaaaaaaatattaatttgattttttaagcaactttcgtatagatattttttgcaaaaaaaaacacaccatttagcagtttgaaaagtgcgtgcgtggaaaacgagggacaggggttgggaacacccttaaacgaacgcagccatagtgtattagtgtattcacgatcattgaccagctaagtcgtcagccagtcaaccctctcctatgctattgttgtcatgcatttacaacggatgtatctctacatatatttaagagagagagagtcggactctgactctaactataactatatcataacacatattacaactctaactaaaaaatggtaaccaactttgtatatatattcgatacaaactctaacagataccacctaatgttatttctagtgcatctggtatgttaccctaccatacatcatgaggaccatacattaataataccccctttgactagggctcctgtcccccctcctttctggaaaaacaatatcatgtgaaaccattatatatcaaaataacccatgttttataaatcaaggataacattaaccatgtatttatttgtggctcaaataaatatggtttctacctacatataccatacctgatcgaacagctagacgatgtttgtcgagacccaacaatgtaatgtcatgattgtcaacagtacttgcaacaattttcgtaggtatgtgagtcattaggaattagctttgcacgagttgtgctttgtatgggaactacacacgggcttactgagctttttgggctcaatttgtttcgatcatgtaaagtttttcttctgtaacatagtatagaattcctttagttttcccatccaaacttgtgtgaaccaaagtatcactgtccgctcattgcccactggctgttcgaaaactggcagtaatggttatgagccaggcagtgattctgtaccctgtactagtgaactatacgtcaggacatgggagtataggttactcatgcacgtatataactacattgcagttaaattgcatgcaacatgtgtgtagcttcatctgtatctttactacttaaaaaattcgtagtgatggtggtgagtcctgaacgatcgaagggttaacattcatcgaaggatcctctcacaggcatcagcggatgagattttctcccacgatccacccgtcgcaccccttctcatctccccgatccgcatcgcgctccctgtctctccgatccgtaattccgcatcgcactccccagccccccatccttcctcctcggcgcgccgcctcctcaccccaccgacgcgccgccttcccatcccgcccaacccgcgccttcttctccagttgtcctccctccgtattgtgccgtccctcgctccgcccgctcctctctctctccatcgcgccaccgcccccctccataaaccatgacctccctcaaatcccgatcatctgggcagccgtcgttatcgtcggactgagctcttcgatcatcaccctccgttgctgccgctgcttcggagccattggaatggaggatgggaatgcggacctcagtatggttgaggggttggacgagatgatggcggtggttgcaggcgcgcccaccaccacgctctctggagtgtggagaggcgcgcgcccgctgctgcaagtcaccggcggtgtcgtcggcatcatcattagctagctctgcatattaaaaacatatgagttgtcaagtaaagttagtgcaatgtaataagatgtttttaatttacctatgagaatcactattagtatttcctcttgcatcaatttagtggaagatatcaataaacaacagaagatattaaaaaaggaactatttggatggaaatatgcatatattgatggattatcaacacctggaagctaatggtaaatagttaaatacaatttatttttctcgatagcctagcaacataatttcattaggataaaacctttattcgtacctaatatatttccctcttgctaagatttagctcagggtactcttcattcaatggcctagtgtagcgcccgttccgtcgtggcgcctagcgggaaatttatctcttaaaaaccctaattgcgaaatttgtttctttgcttgttctctagtgtccgtgccatctcagatctcaaatccccgatctatcgccgagttcaatcccgaatccaaatccttcccaaatcaattcctccgcaaaagtctaatttgcctcccccgggttcgatgggccgaatttctctcggcccatctccccctccctccccggcgctctctctctctctctctctctctccctccctcccccgctctgcccgcgcgccgcgcgcgcgtgcgcgtgagccgcgccgagccgagccctccccctcctccctcactccgcccgcgcgtgcgcgagagccgcgtggtcgccgcccgtgccgcgcctgcgccgtctgcgccgcccggccccgctgccctgccgcgcagccgctcggccccgtgagccagcgcgcgtgcccgagccgcgccgctcaaaccaccgcgccgcccattgtttctcgcgcgcgcgtgccgtggtggccgaccgcctggtcgccgccgccgtcagcctctgccgcgcctgcccgcgcctgccgcccgtgtcgtcgccccgctccaaaccgccccgccatcatcgctgtcgtcatcgcctggcccccgccactccacgcgctagcctccaagggacggaggcagagctcctcctccctctgccgcgtcgcccccgctcccctcctccttttcccaaagaggcaagggacaagccccctttctctccccccttttctccctttttccctctcgccggcgtcacctcctgtcgccgttttggccgctagccggagcaccagctcgtcggcttgaccgtccaatgtcggttcccctctcccaaaccgacattgctgctcctataaacccaagctcctccccctccaaatctccctcgttttcgtctctcgccgccactgtcgccctgttcgctgtcgccgttcgtcgttgcgcgtgtcggaagagccgacacgagcaaggacgcggaaggggacttcggccgcgccctcttcctcctcttcctcggcccgaggccgagacgatcacgtttcgcgccgtcggctctcgtcactgcgcccgcccgcacggtagtgcctccctccgttcttcctcctcgttccatctcctccccttagactcgggtagtagcacgagtagcctccccgtagctagccggcgccgccccgaccgttgccgccgctcgccacgtgctcgccgccgtcgccgcccgagctcgaaagcgcctctcgtcgctggcctccctcgatgcgtttcctcctaatccgacgctagggacggattcccgtagccgcgtagatgctctcgctgccgggaatcggcccctcgtgacctcgtcgccgtttcccccttcttccgccaccggttgccgccgccgcaattcaccgccgtcaagcttcctccggcgaatccgagccgttggctcgtctcccctcgtctcgtgcaaccacccggtgtgctcgctttcgcctgttccggccggcatcgtcgtctacctcccgccggcccgcgtggcagccacgtaggcgccacgtcggcgccagctcggccaagaccgggtcgagccgaccccggtcagccactccctccggccccgctcgcgggcgcgatccaccgcgagccgtgaggctgcgcgtgggcccgccgcatccgcgtcctccgcgaaccgcgcgcgtgcaccgcgtctcttccccaaaccctagcgcacgccgcatactccctccgcatggtgagccgagccgctgacaagcgggtcccacccgggaccacgcgaggtgagcccggtccaccggctccctctctcctcccctcccacgcgcgctctgggccgccttttgggccggccggcccattaagctcggccgagccgccccttttctctcgggccgcgccctagccacccgagggaagtctaatttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcatgcttagaggtcattaatagggctttattttcgccgtttgttgagttgtcccgttttgcgtatagtttcggagcccgaagaccagcagtgcgaggatttcaaggatcaagctccagatctcgagcaaggcaagccacctttgaacatcttgagcctatatttgaatttaattatgttgcttgaaaaatattatgcattgataggatcgcacttaatctgttgtcccgtctgcaaggcagattggcagacctacctaattcgttgcatttgatccttcctttgttaattgttatatcatgtccccttgtaaccatctagttgcgtctcgatattcgtgcaccctgtgcgagtatcgacggacgccttcaaacttaaaatctgaaaaacaacttgggtaaaacttgggttttacaaaagacttggaaaacccgacacctgggtcggtgcttgcgaactaaatgaatttccaaaaccgcggaccggggaacgtaccgggtgtacggtttccctctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacttgttgttggtctgggacccctctcgtcggcatatggtaaacctgtgtcggctttcgaaatgccttgtcatgaaagcttggaggtctcccaacgtggccgatccccacgggctgggtgatccgggttagtaatgtcgtgtgggtaaagtgtaccccttctgcagaggttaactaactgttcgaacagccgtgcccacggtcatgggcggatgtgaggtgattcctagcgtagttttgtttgcctactgtttgtgaaattgctgtggtggaaaggagatcgatgtttggaaaatctgcagctgatgggatcagctaggcccgggtggccgtttgaaagttgttggcccgggtggccgtttgaaagctgttggccgggtgccaatcttgatctattttaaagattgatacattgcacatactccgaccggacgagacgcactgtctcatccgtgtcgtttgagaagcactcacttagttgtttttagaaaagagttcaaataaaatcaattgcaaaaacaacaacctttccttgaagcctgcattaaacacttatttcccatggcttgttgagtactcccgtactcacccttgctctatataaataatccccccagttgctgaagaagatgaagcggaacccgctgataaggagttcttccaggagcaagccggctacgatgagttttagggtttcggcttagttcccaagtcgcgcctgtgttgattggtccaagtcctggcttccgtttcccttttgtaatgcagttgtgagctcgggatctgtccgcagcccaacatgactgtacctctactctataataaagagacctctgttgctgtgacattctatctccctatgataccaacactgtttcctgggactggtatcgattaacaggttaatttggagcgtcacgggctatttccggtcgggattagttcggggcgtgacacctagccagatccatgttgcatgttaattatgacatgggttgtgctatttcttggtggagaagatcgttaagtatctcctggcatgcatgccgctgccatcaacattctttcttgatggctgtgagcatgtcatattttatctggtgttatcccggctgatgagcatcccgttcgatttttttttctttgtttacattggttaagcttgatgtatttttcagatttgcttccatggatcagtttggtcaggtagtcttgttgcaatgcagagttttagatatgaacggttcatatacttcatatcatagttgtacacagtggtttcttctaatcattcccatctgattcttgggagtagccaaattagtacatggtcagatattaggaaggaagagcagtataatatctatgtgcagtttagttctaatttaccggctattctcacacgttggctttttttattgactgagatatcattttcactacagtccaaatgtgttggtcaattcataatcgatcagcaggcctggaatttgtctcaaggtatatacatggaatagtgttccaatatgagtagtgactaaagcagattaatttgaattgtgaacagagactctgtcaaataatcaggtcagtactaaaattctattgatcactataaaattacaatctcatttgatgttgcctttttcctggtgatcataggagtgaccccttttttcatgcttcaaaggcatatggttttgtataaaattccatttctcagtatagaagttaaaactctcatttttgtctgaactaataaactatattgttcttctccaagatttgttcactaagttgcaattgatagcaacttagatatcatttttcttctgttttcactgcagtccaaatgtgctagtcaattcataatcgatcagcaggcctggaatttgtctcaaggtatatacatggaatagtgttccaatatgagtagtgactaaagcagattaatttgaattgtgaacagagactctgtcaaataatcagactctgtcaaataatcaggtcagtactaaaattctattgatcactataaaattacaatctcatttgatgttgcctttttcctggtgatcataggagtgaccccttttttcatgcttcaaaggcatatggttttgtataaaattccatttctcagtatagaagttaaaactctcatttttgtctgaactaataaactatattgttcttctccaagatttgttcactaagttgcaattgatagcacatttctacattttcttggcgcgtccatttgtgcctccacagttgcctaatatgctaccactgacatttcttattattcattcctgtttcttagagaattgtatttatctatgcaaaattgcaactcgatgtactgaggattctataagcttttaaagattactatgaacacacagtgtactgtccagagaattactcagattcatttatgtctttaatggattagattccatgtaaattcagttgtaatcctttaagatgattttcagttttgtatatatatatagtttgttcaaggcatataacttgaaatttagcatgtaccagaagattattatcagcagaccccaaaaaggtcacactccaattttgatttatcaagtgcatgacccttgataaatttactcatgtgtgtgatgtccgtgactgcttcccgaagcaccaaccaattttgttttgaggaaaacatcaactaactatgtatcacctgagagggtaatattcagaacttgtgatcttagaaaatgaaaccgtattcttctgtgccaatgcctaatggttagagaaattcttttcaagtatacctgatagtctgatacattaaccatattcctttgtttagaggaacattagccacattctatcctcttcatttgccagtcataataggcgagatgctttaatgcatatatttttcgccgttgcaacgcacgggcacccaactagtatataacatatactgagtgagcaactgagaacaacacatcaaggggaggcagtggtttcacaactcactgccgtggcgagggtagcatagggatgggaggcgtggggaaatcagttgaaacaattgctcaaactatttcttaatgctcaaatattggaagacacaaaactcctccaccgtctgaaacatcctcagactcttccggtaaaacacttccatcttccggcaaaacacttccaactgttctactttctatgcttccgggtgctacggaagcagtgttgtcttcagacacatcccgccctcaattggaaatgccctcagaaggtgaccggaagaagctaacctatgggttgttagactgaagaatagtgaaagatgtattgtagatgtctgaaaatcaatatctaccctgatgtaatctcagtgtaaacctaatcttactttgaaacgaaattcacgtggggtccccccccctccccttccctgggcagtgatttggtaaaaaaaaataattgctcagcttcagtagtagacactgcagtgcagtgtgataacccttactgtgataatctatcaccagggttttacttttacaagtggctcattaaaagtccatttgtactaatggctaagagctccggagcgggtttagaccacagttggtttgttagtcaacttttgatatagtaattaggtgccacgtgtaaaaaacaaaaataaaacagtgggcccaacatgtcagcccacctctcccatctcatatgcacttctctttctcccgatctgtttggccacgcacggcgacaactagacacctgagcaggcttccggacaattggtttgcaagacgagctcgctggccccaacctgctcatggtcatgaaattgtgagagacgacgtgagagaagcaggagaaagaatagggaggagcctatgacatgtgggccctactctttctttttaatgttttttatctgagtgtgtccatgtagaaaaaaaaaccttggtttggatgaggggtgtgatttgaatggtttcgatatatagttcgtggtgttggatattcggttttgaagttgaggttacagtacataatggttaaagagagagtataataatggttaaacagtttagataaacataatggttaaagagggtataatagatttatccccctttattaatttgccactctttagatgcgagattattttatgatttaccaatgtgactgacatatcatagcacacaaagggtcctgcgtgttattgtcatgatgaacggtgaacacagaagtactatatatgaataattttgacaagtgctttatcactgattaacgtcataatttgcacgcattacgaactgtcagaaactgaataattggattattctgcagatggaatgtgcacgtgcatgtgggggtgaaattgattctgaaacaaaaatatctatttatcgtcctgcgtagttatgactggtgagtagactagttgcatttggataagtttatattgacacaagtatcaacagcaatggccttaaaaagacagacaggccgaagattgagcagtaatctacactacatagtgtcaaactgtcttgatgaagcactgtttgtgtacatatattggctgtatggaagaacacatattacccttttttgcaaaccccagaattaatatataaaagaaactatacatgggtttgaggtccaagaagtgtgtgaagcaagatattgggtatttcttttttattttattttaaatctttctattctgaattcagttatatggcataagcttgagaggcatgaggaatatagaagccaccatcgttgtgctggtcagattgtggaggacctgtgattgtttgcccatggctgagagccgaaccagcggcatgcagaacgctcattcggtttaatctggtgtaagccgttagtttcccgtgatcacgaggttgacctccaagtctccaaccccaagtctggtttgatttcgttctgtagtaccaaatttggtacgaccgagttgctacgatatgctttaatcaaaataattgcttcttgggcacaatttggcactaaacctgatggcatgaggcaccgagaaggatcttgtctcaaaaacactacatacaaattatgagcaagcgcattctacatactaattaagggtcatagctagggattgaaaacctcggtgcgaaataaataacaggacagtaatatttttaaatacacgctatagaacatgtactagcaaagacagcggtagcgtgtgacttggagtttgctcgtgccctagcgacatccgacatcataaataaaaggaagagacaaaaaagacaacaaccaatacaaacaaagcaattacatgggcttcaccgaccatgggcccgcatgtcagcgaccatgtcagggggcagtttgcatcagaggatctgcttccctaccatctagcttcaccactgcacaacttgcttccattgagagaccaatacaggattgaaagacatggggaaccaaaccaaaccgacgaagtgatcttcggaacaggtttacacacgagattgctcatcagctttaacataagattccaaagtttaatttggtacagattggtttaatacttatacaagagtagcaatccaagagtgttctgacgatgattggtttaatacttcatgacgtgttgttccctgctcaagaaatggtcatcactattttgatgctcttctcaaaccattttgacattttgctgtcttgataaatgttcattaattatgtcacgttgccgtagtaggtatatactctgattaagaaacccaattaatatgcttttgttcaatcgactgagccagtatagcaagagaaggggaaataagaacaatctctagcatcttttgtggaacttttactacaaaacagcatgcttgtaactcactagctagtacataaccggcaatcactaccaggcaccagctcatcagtagtgatttggattgaactggcaatcaatgagtatttgtaccagttcataccgtataggaagttttcccatccaaacttgtgtgaaccagagtatcactgtccgttcattgcccactggctgttcgaaaactggcagtacgtaatgctggttatgagccagcactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatatgtgacggcttgcacttgtaacccgtcacagatcgtctgtgacggatcacaaccatggctcgtcacaaatgacatgtcatctgtgacgggtgtagtattatgaaccatcacaaaagagaccactcatctctaacgggtctttaactaacacacgtcacagataacgttatctctgacgggtggtagttatgacccgtcagtgatgagtgaaaattcaaatttttaaattttgcaaaaaaacctcggattgaaacatgtcttatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgtttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgtgttgagtaggtgagttggtaagggaactctatatggaggttgaggtcttgagttcgaatctcacttgtagcatccaagttatattgcgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgagttatataccactcacagatgggttctatgcgacggttgttacatccgtcacaggtgattttgtcatcagtgaccactaatcactgaccaagaccaaacccatcaaaagtgagggttcgggcccgtcagagatgacctggtccggcgtagtgcaggcagtgattctgtactttgtactagaaaactacacgtcaggacatgggagtataggttactcatgcacatatataactacattgcagttaaattgcatgcaacatgtgtgtagcttcatctgtatatataacatatactgagagagtaactgagaactcatcagggaggcagtggttcacttcattaggtggtttcaaagttcattgccgttggtatgctagattgttgctggtagcgcagtagcatagggatgggatgcatagggaaatcagtcgaaacagtagggtcaaactgtcttgatgaagcactgtttgtatacatatattggctgtatggaggaacatatattaccctttttgcaaaccccggcccaaaatatataaaagaaactacacatcggtcatgaggtccaaggagtaagtctatatggcataagcttgagaggcatcaggaacatagaagccaccgtcgtgtcctggtcagattgtggaggacctgtgattgtttgcccatggctgagagccggagcagcggcagacagaacgctcattcagtttagtctggtgtaagccgttagtttcctgtgatcacgaggttgagctccaaccccaagtctggtttgatttcgtgctgtactaccaaatttggtacgactgagttgcttcgagagatatgcttaattaaaataattgcttcgcgggcacaatttgacactaaacctcatggcaggaggcaccgagaagtattttgtctcaaaaatactacatacaaattacgagcaagcgcattctgcgtactaagagtcatagctagaaactgaagacctcggtgcaaaataaataacaggataataatatttttaaatacactatagaacatgtactagaaaagataacagtagcccgtaacttggagtttgctcgtgccccagcgacgtccgacatcataaataaaagaaaaagcaaaaaagacaacaaccaatacaaacaaagcaaagtgttttttttttcttccctgtgtagtagtttctttttccttgttaatttgcttacttaattgttagtactaacatatctgctagagtttagtctgcaacagactgcaagcccatgtgtggttcagtgacagctagttgcattattgcacagaacaaaagaacatatccacacctggattggaatcacctgcagtagctatatctaattcaacttaagcagtcctacagctaccattggatcagaaattaacatcttagatatttcctaaatactgttcacaggagaccgtacaaagttgtattgtaacagttactgtttaaatcactgtagcatatgtttggaccgttgactgcctttatccaatgatggaaagcgatcccaactgccaaacttgcaatccctagtatgacagcaccggatccttatccatccacaactatatatgacatcgaaaaggggttgagagggtgaagttcatgtcgtcataatttagcctgacaaaaaattaccaaatgtactaattaataggcgtataggagaatgctatgtataactgcagttatattatccattaataactcttaagaaaaaatattatgaaaatctagatggtgctgcgcagttgaggcctaagttagcacactccattctcaagaactacggcattaatagtgactttatattcatctgcaatttcgaacacatacttcaaagaagagtgcaaacttatgagttgaagctaagcacctatcatctacttcagtatagctctgccagttagaacttactcccttcgtccaaaaaaaaaggttttttttggacggagggagtagaaattaaacaccatatgaacaagtagccagtacagaaaaggcagagatcggtaacaagaaatcactcgtagatacaatacaacatgtactatgtaatatcataaagggtctttcccaccccaaaaactaaccaatgggatgaagggctcctccacttatacataacctctcttgtgccctcccgcaatcaatgtgagactattcaatactctccccccttcacaagttggtgtccctcagccgttcaccgttccttcaccgcccacggtcactcaggtatataggccccgcatgcacgcacagtccatcaagcattcacacattttgtctctcgggttagagttgttcaactagttagcctctgataccaattgtataatcgtaaagggtctttcccactctaaaaacgagccaatgaggtaaggggttctcccacttatatattaggtttattgtccttccacaactaatatggtattattcaacatactagacctccatttcgcatgatctatcgccgctttatcttctctgagaagataaaatgtgtacactcctttctcaacgagacgccaactaaccctacataccacacatcacatgtttgcattcgaattgcgtgcgttattacagcatgtaaggtttggttgtctgtgttgatcacaaaaggggagagggaacagcatgcattgtatgctcatgcatgctaggttgctaggtagacctaggggtgtaagtggctaacccgcgaaacccacttataggctaaaataagccgcgagcccgcttattttaacctataagtgggttcgcagctgacccacttacacccctaggtagaccgctagagcttggtagtcatggtttggtctcaagttgtctacgtgattgtcagttgatctgtggacttgggaggcataggaaatttgtcagcaccaggattagtctcctcatcatgaataagagagcagcggtggatccagcgtagaaaagtgggaggggttgaactgaacaccaacgttaactcaattatctcgcatacaagacaaacgtggctgtaatttgaagtggtttcatatgaaaacattgagagagaaaaaaaggcaaaatacatcacacgacaattcaatattcacttgatctctaatctcaaatggatactaacaattggttcagcattcctagatcaataataatatccgagcaataaacttcactcttgccatttcaggttgtctagcttgtattcttattgttatctacagtaggagtactactgctgcagcttgaataataattcaaaaatatccttttcgaccttttgcaaacttgcaattctaggagcagccgagcagagatgatagattgctagctgagaaacaaaatttaactatgctaaatttccaatgctgagttgggctgatggcttgggagattttggatttctgctagttgggttaatggctgagtcgaaagcctaattagtgatcaactgcacgtgcacctagccacctggcctaatatattgacgttgtgttgatacatacttttctttaatttgtaaagaaaaaaaaaagcaagcgatgttttcagcatacactggtatggatgatcgtcagagtacgtttagagtccacatggccataggtcatggctgtgaattatcaggcttcagtaaagtccatgcgattgctttcacctagatattacacaatatatatatagtactatatggcctttaaaagaggttgctaaggaggtcaagtgtgtgcaatggaagacaatgtctaacgttactgcaagctgaagtagccaggtagggaatagcaaaacaattggtagatatgccaggcatgggttgcttttggcttggaaggtatcaggtgttagtaatcttggttacttagatccatggctcgatagaaatcagataaatttacaattccaccattctttcttactaaggagaaggaacaaatttgattggactttgcactttggcagtatgtgaccaggcgccccagcggtacaccaacagcgcgcgcaatgaggtgtggatatgcaaggttttcaatttcgatttcttccaaaattttggccattttggttctactgtaattcctaaaaattcaggattttttggcattttttgaccggttttttttttaaaatcttaacatattttaactgaatttgactatattttgatcaaatccgtaaaaaaatgagaaaaaccaaaaaaaattggccgagataatctcttgccgtggggggagaggggtgccgaaatttcgggattaggaggtatcggaaattcagcggtctccacggaccacggtcaagtatccatgtcttgaaatctaaggaacaaatgacttgccatcggagtccatctcattggtaatggagtaagatggcccagttcgtgatgtcgtctctacccagcatgccataaagctaatagttgttgaacaagctagaatgtgatggcacgttaaaaaacttcagttgattatatataagcccgcatgtgtttatatttcgtgtcaacaataatgatggttttgtttgcgcaggtttatttatcaaattagataatatatgaaaataaatactatcgcatccgttacaactacaattgttatccattacgctaagagcaatcttatgaaaatctagatgatgtacaggcacgattgggagctgagctagcaacgtaagaccacagcccacaagtacaatttatgatcaagaacttaatggcattattatggcttgaaattaagcacttattaagcaggagaaacaattaccaactcatatacttcaacgctaactcatactacttcaaagaagagtatatgaacttatggtttcatgaaattaagcacttaccatttgcttcagtataactccgccagttagaacgtataatagtgcttacttcgtcggcgccgttgtgtggctacatatatagccagtaaaacatcgtctctgcatcttctctgagaagataaatataggcacccaattttcaccgagacaccaatcatccattaaaccatccgcattagattaattaattgatgcccatatatatcttgcctccagagctgagaccaggaaggatatggtgtgtgagtgacaacgttcctggtgatcacaaaacaggagcagctgcagcctgcagcctgtatctgtgtatcgctagctagattagtactgctcgaactgtggacatgatcgtcactgatctttgtggacttgggaggcataggaaattcaggactaacatgtttagtctcttcagcatgaacaagaggatgaaacgctgcatcttcgacgagcttcgtgtgaaaaacagagcgaactaggagacactggacacttcacagcactgatatccctgttcctttctaagctaaaaactagctatttttgcatacatatgtcacattatgcatccaagaaaatcattgtaagctttctttctggaattgggcatttggtatgacatgcattgtttaattctgcctatattatccattaacgaaacggctaaccttctttcgacagaaattccatccccaaatcttgcaaatttcgggactccggatgagcttcgagattcgtgctccaggttctcttccaactccgatgacctcctcttctttttcggcgccggcgacaccctagactttggcgaaggatcctacgagttagggtcccggggtagagtggggtggggtgggggtgggaggggg

SEQ ID NO: 79478 - DNA, 59924 bp, Oryza sativa
  unsure (1)..(59924): unsure at all n locations
gtcccatctgatcctaagttattatattttgggactgagggaataacagagaaaggtcactgctaagtaaaaccatccaattacagaagttaccacatataacttcctgggacattgaatagacaatattttattcagcagattggataggtaagtacaagcacaatcctacctgtcatcatcatcttcccacaggtatgtagcctcctaaaacatggcaaaaatgtagcattcattacataagcgatgggcattctaaaaggaatgtaaaaatgaaaataaacactgaaaatgtaaccaatttgtaactactcctatataaattaaccatttatgaagcgactgtgcatgtaacctgtacttcagcactcatggtaagagagaaatgcagaagaattatgccagcacatgtgcaagggaaagatcctacttataaaatggtgcttttcagggtacaagacatatcacacaacaactttttacctggaaaccacgtgatttagccccaagaaatccagaacagctgcagctccacaaaggcacctcaccattgcaccaccaaaccactcaaagttgtagtcataggatagttccgttccgattggaatatcttgtttcgcaaaaattcccactcttacttccccaagaacattccatttccttgtctcacagtttggttggctgcatgcttcaataacaagctatcagatttaatcattaaatgctagtaaatggaaaaaaactcgataatcaattatcaaataatgcatatgaaagaaacataatataggcagacatatatttgctacaagacataccacgaatggttgatgaatcttgccaggctccccttctttgttgcgtcgatagactcatcagcattcagatagataatataggcatccgttaaacctaacagggcacaaaaaacaaatgttatagctagccaaaattagggatggcaatggggacccgaaccccgatacccgataggtaaaaactctattagggtatgtaaacaggctaaattcatcacccatggggctgttatcggctagaaactgtcaccgttgggtgatgcggggacggggatgttccataggcacccggccccgaatccccgtgggtgactcgagtagtgtaggcatatgtacagtccataaaagttaaaagcccacttagtgcccaatttagaggtgctggtatataaagcaaaagaaaccctacactagaccagtcctcccttgtccccttctcagatccatcagcagccgccagtcgaggtcggcaagggcgccagccatcgcacctcctccaggccacagcagcgatatagcaccccgccgccgcataaggtgaccatgccgcgcgagctgttgttctgcctccaagtcgcttgctcatgcgggaaagcaagaggacgggcacttgctgcatccgaatgccggtatatactttgcttgttattttctgctctgtcctgtttgtcgctgtttatttttctcattttgatggaagttggagctgattcttggcaacagaatcatgcaagtctggcaccatggtcatgttcataatctgagaaaatgatagatgtatgtcctcgtgctatttttgccgatctgttctacttctaccttcctactagagaaccttcttgttgatttatgcccacgagtttatcgggtgtgcgaccccgtgggtgccccgtgcacccggcgaggcttggggacgggagaaatacagccccgacaccggggacgggggcgggtgatttctaactgcacggggacggggacggggacgggggaccacaccccgccggggatggcccggttgccatccctagccaaaatgtaccaccatgctaacattgagggaagataaaatcaacagaccctggttttcatatgcttgagatctcctcttggcttccttccatgatattacttctccacaatattccataacaaattgtccagcctaaaaaccattaagaaaacaatgactcactaaagcatactcacttgaatatatttaacaacattagcagaccataaaatcaaggtaaattcagtcaccataatattctcatcagccaaaaggccccatccacgcccttcagtttttaccagccttgtcgcagcatattggcttttttgaaatcgctgccaacagagaaattgattaaaatacaaacataactaccagtgaaactgtaaagcactccagatgacattcggcctccctagcaaattggtaaaactatatattgaaaatgatagtgttcggtatctatagaaaattagtaaaactatatattagaaataatggtacatcatgtataagaaaccagattatattcaatctcacttgaaaaaaaatccttacagctaagagccagcacgactatattgaaaattgctgtacatctataataaactggattatattcaatcaagaagacaagaaagcaaaataaccgtgttacaccatttttttcccctcctgcctagtaactaggctcgagtgaactaaagtaatcatgtaagaacaaatgtatggatattcattcaatcaagatttggaacggttgcgctactacttgaacaagagaaacaccaacctggttcttgcagtatacaccgcagaggcagtatccaggcgtacactccgtgctagtcaagacgttcaagcaccgatccccgcacgcgctgtccggatccagcagattatactggcactcacacacagctatgtcctcctctttctgcctcttgtgcctagcatcgcgcaccaaagtataaagattcgcattacatccaaaagcacaggacgcagccgttgtcccacatcgccgtgaaactcactcacctcctgtgcaagaaatcgttggtctcgatgtggatgtacggcggcggcggcggcggctccatgcgctcttcctcctgcaaaaccgaacagcccggggagctcaatcatacagaatcaggaatctctacgagcgagcgagcgagctcacagagaagttaccatcagagacgctagctcttggacggcggcgaggtatccggcgagaggggtagggaaatcgcggctgatagcctgggacaggagcccgcgcggcgcgtgagtggttcgaggagcggcggaggcggcgactggggaagtggtcgccggaggaaaggcgtcctccccggggctaccgaggggggcgtcgccggcgccggaggaggtgagctccgcggcggaggacttcgccggctggccggtggtcggaggaggaggaggaggaggagaggaaagacggattcggctgggtcggatcggcggcgctagcgcttggaagcgtagcgggctgcacacgtggacggccaggatgggagggagagatcaccgggtcctcgtgccgccgtcgtgttgggccgggccggaagcaacctggctggattgcctcttccgttttgcaaacggagcaaataatctcatctataaatggcaaaaggaaaaagtataccaaaggtccctcaacttgtcatcgaattacaaaatcgtccttcaactgtaaaaccggatgacgcatctccaaacttacaaaaccagtgcaaattagatctctcggcggttctaggcggttttgactcggttttatcctatgtggcagctgactcagcgtgggacccacgtgggcccccacgcgtcagcctcttcttccttcctctctccacctctcttcctctctcctcttttctccaatttccgggcggcgcgcgggggagcagctgcacgtgacgggcggcggccggcgggcgcaggcggcgtgggtagaggccgcgcgcaggcggcgagcggccgaggaggagctgggcggaggtgcacgagctcctcgccggactaacgctagaccggctccgccatgtccgccgcgaggaggtggcgcgcctcgtcggctcgctcagctggagtgccaccgacgccgagcacgtcgacgtcgacgccgcgctgatgggtgtcaccagcaacatcgtccctcgcatggtgatgggccggcggtggaccggcgacgacaacgacatggaggagatgcggagcgtggtcgccgagacggcggagctcaccggcgatctcgtgtaccaggacatcttcgcggcggggacgacaggcggagctcgacgcggtggtcggtgacctgcaggccgtggcgaaggagacgttgcggctgcacccgacgccggccgcgccccgctgctcccccgttggctgccgcccgccgcccacgtccgcccgcgcgccgctccatcgcccgccgcacgcgcgcggctcctccccacgccgccttcgcccgcctggagttaagtcaaccattaactttgtaccagttcaaatcagtggcaatcaccaaaccaaacagtgcgagcatgtgagctcgatcttaacaacaagcaagcagaactgtagcaggaaccaccagctgctgaggatccaaagcaaatggggatcatcagatcgattgctcatcggcgtactactggagatgatgggctccagggcaaccttgtcggcggttgccttgcaggatggatggattaaacgaaaaagtacaccgaaggtcgcccgccgcctgtgcccgcctgcgcgccgctccgccgcccgcgcgcggttcctccccacgccgcctgcgcccgccggccgccgcacgtcacgtgcagttgctcccccgcgcgccgcccggagattggagaaaagagaagagaggaagagaggtggagggagaggagggaagaagaggctgacggatggggcccacgtgggtctcacgctgagtcagctgccacataagataaaatcggagtcaaaatcaccgagggacctagtttgcactgttttgtaagttggggaatacgttatatctggttttgtagttgaaggacgattttgtaacatccatgacaagttgagggaccttcggtgtactttttccatggcaaaaggataatggaataagtctatttttggtccctcatctcttgctcgtgattaagttgcctccctcaaccgtaaaactgggtataatgtctcccccatcttaaaaaaaaaaggtgccaatcgactctttcggtggtttggaggttggtttgttgacgtggcatgatgaccacgattgatttgccgagtcagcatgtaaggcccacgtgtcatgactcctctattcccctacctcttctcttctctctcctctattttcattggcgaccgcgccacgcccgagatggagctctgacgagggttcaagatgctcgcagtgtcgcggcccaacccgtccgtggcggcctgtgagacctacctcaaccaccccgtccagctcaatgacctcagcccagaagccttctcagagatcccccatgccatggcgctcctcaacttcctccgcactgtgcgcaccgtcatgctctccgttgtcggcattgacctcagctcttgcaggaaccccacctggtcctctccctgtcgggcagcgccgatgacgaccccctgcccacaaccgaggtgctccaccgtgccatcctggagatgttggcatcagtcacggccatcgagcgatgcagaacgccggtgatcgcggcaatgaatggtgcttgcgttggcggcgaagggacgatggatgcgctggtggcacaatctatcgcaggagggctctggggagcgttgcccaagcgtgctcccatcgacagcaccgtgtttgtttttgcctaacatagatagacctggctctctctctcccatctccaatgtctccacctccctgaccagcacctcccctagatggccaccctccttcttgtcagcgcccccgcgacactcttcctccttcacccacccatcgtcaccgacaccaccatcaacccatgtagcctatccatgctctaggacttgcgccgctcgctgaccaatggcaatgccctcgccttagagtgggacctcaacatcgccgagccctacgccgcctgtccgcacatctcatgcgaccacaccagccgcatcaacaacatcgaccttcccgccgacaccaccgccatgcaatagctttagagccttagcctcaacgactgcaacctcaccggcgccatcacatacttcgtgcagaactcacggactggctggtgttggcgctcctaccattgagtgacgtcgtctggctccggctgagaacaaagagagatagagagagagggtaaaggggagaaaaggaatgactaacttgtaaggctactgtttatttttttctcactgatatgtgggtcccatgagcatcacgtaggacgaaaccgccattcaaacagcgaaggactcgatttacgccggtttaagggagcaagattggagatatgtaaactagactaattaaaaaaatgttaaccacaccgaaaaaaataagcatgtgttggagctcctaccgcggagtgacgccatttggcactggcttggcgagaacaaagagagagggtagagagcgatggtaaaggggagaaaggaatgactgccatgtgaggccgttttgtcttattttctctcactgacatgtggatcccatgagcatcacataggatgaaaacgccatccaaacagtcgactgacttgatttacgctggtttaaggaaggtgaaaaattgaccgggtgattcagagttcagaaatataaaattgattcattaaaaaaaatggtcgcgtaaacaaaaaaaaaggaggacatatgacatgtggatcccatgagcatcacgtaggatgaaaacgccatccaaatagtcgactgacttgatttacgccggtttaaggaaggtgaaaaattgaccgggtgattcagagttcagaaatataaaattgattcattaaaaaaaatggtcgcgtaaacaaaaaaaaaaaggaggacatatgctaggcgtatgtgtcatgcgtcttttgcccttgggcggtgacaatgattatttcctttgaccaatgtgaatattgcgagccgtgcactcagcacgtgcagccaccggactcggggtgtgcccgtcagcacgcttggttcggctgtcgcctgccatatgaggaggactaaacgttgttagctctccggtgtggtactaaacaacgtgcaccacctaagcacctttgtgtttagaaacccgcggagcggaataaattcctcgtggaaagacgagcgcacgtactgtattcacgtacgctttcggtgaacgtaccagttccgtcataatctcagcccatctccttcgtcacacaacgtatgactagtagaggttgtttggttgctagccaaaatttggttaatttaccataagtatggcaagtaggtttgatcaagttagtgtagtgtttggttctaatcataagttagttatgccaaactttcctttaacttgaccctacatttaatagacacaataatgtgtggcaaggaggctaagatgtggcttcatttttcttggccacaactttagcaacttagccacaaatgtctggctagcttaggcagttttacacaaccaaccaaacagccacatctgccgaacaaatggcagctaaactggtataggaattgtccaacaaagtcaacaactcgttgattttacaatttttttaagaaaatttaagaagtaccattgataagtgtctggttccaaaaaaaatgccatagacaaatacgagtttcatgaattactattgtacaagcaactttgtcccataaatgctaatgttgttataattccgttagcatctccccgttggcgttgggtagacggaagaataacgacaatgatatttctaggacaaaatcacttgtacgatggtattttataaaactcatatttatcgatggtatttcttagatttatgtgtatgtcaatggttggattttctcttccttttaccatcagcgacgctagctgtggacgtaggggtgggcagaaaaagaccgaaccaaaataaccaagactgaaaaattcggtcttatttactagatgaccgaatttttttcgatcaattcggtcatcacccttagttaaccgaatttcattgaaagcccatatcagcccaagaaagcaagctcaacactagtaaaaccctagctccctctctattgccttctcctcatccacccagctagcagccgccacgctctcccacccaactaggagagagcgcttatttcttttctttttcacctgagcgctcctttctttttctctcgcacatcgacgtcgtgttttgtcgtcggcgcctctgcaccgtcccagcgtctcctccttctcacaagtcacaccacgacgacctactcttgttgcgccaccttcagtcgacacccatgctgccggagcccggaggcctcaaacccccaactgccaagcccaagccgcgatcctccgtggctccaccccgggggcacatctgatggtgcctcctctaccccgccagcgacgagaggtgccgaagccgatctgggatgagtatatgataatgaagaaagccgatctgggatttttatgaattttcttcatgtgtatgtttttttatttgaaatttattgtggatttgtgcgattcttctgaatatttctgaaatttcggtctaaccaagaccgagaccaaatagttctatctttaatatttttcaagtccgaacggtcttgcgctttaaatgaccgaacataaaacagattgaaaaccgagatcgaattttcggtattactgaatgctcacccctagttggacgtggatagcgctgcgatttagcatgccgaggcaggtggaagacgagaaaaatccaacgtgcggtagcataattgtggctgatagatacgaattattttctttttttaaattttttaaaaatatttacagaaataatctatcgtcggaaaaatttataaaaatagatcctgctgccctagtgcagggcggcaagctgacgtggcagacaacggctcgacgggcggtgacggccgattggaaaagttgaactttttgtattaacacccttgccacccattgccagggcggcaatgggcctccatgaaaaagccagcccgagaagggccattatcaacaaaggtggaaagaagcatttggccggttttttttcatctctgccttctttccagctgggcaaataagggcggtaaggaccaaagcgcaaaatgcgcacacggcgccgttgagccgccgtctgtcacgtcagcttgccaccttccactagggcggcagtgtctatttttgtaaatttttctgacgatagattatttctgtaaatattttaaaaaaatgaaaaatgaaaaaaattctgatagatacagacatacggccgtgttgagccgggccggaagtactgataggttttgcttgattgggcttccaagacaacgagctgatgggcctggacaagctccgtgtgggctgggactcgccggaagggagttcccaatggagtgtgttttcgctaggcaacctcaggaagggcttcgactctttcgtttccgggttacaaagcagctagctttggttggaaacgaaattctcgtgcctctgatagtgtttttttgccagatcggcacagtggtgaacatgatctagatagaggcggaaccttcttctctaggagatctttttagcacttaggttttttttcagctaaattcggaccctattctccccatcataacccgccatgattgttctaacgttaaagttgtattcaaacatttttcttctactataataacgtgcaaagctttttttaaaaaataatagaataaaacatcccggcctttgatcatcagagctatagccaattattacaaaagtaacacccaaacactgagtgtagttcaaatgaattaaacatacccaacaaaataaaatatcaaactaagataaggagagcacatttattcaagtctatttatgaatctccatctatagtttgcaaggagttgcatgaccgttgtctcaagcttacgacatgcaaccttcataagctctcgatcatcttcacacatttgcagctgtgcccaaaatcggagcaaatatgttgccctgaaaattacctgtatatatgagatagatagtgatttgtcaaaaaccatatcattcctagtcaaccacagagcccaacatatggcagaagctcctacaagtatgagtttactcttcttcttatctaccctcaaaagccaaccatcaaacatattagatatggtagtaggaaggtataaaccaagagagaactgtactgctctccaaacaaattttgcataatgacactctataaaaagatgttgaatagtctcatttttcataaaaaacaacattttaaactgtcattccaatttcgtcttgccaagttatccttggttagcacaacccctttaagcaagtaccacataaaaatcttaatcttaagtggcatcttaagctttcaaataatcttgtttctttcactataaccattattaattaaagctagatacatcgacctaacagaaaatattccattctgatgataattccatctaaagctatcagaggattgattcaattgaatatgtacaatagaagcacacaattcatacaaatatgtaagattctgaccaactaatgatctcctaaaggaaacatcattaaaaaaaaatcatctttcttctagaaaaacagcgtactacattttctctttctccaaaaatgaaaaagaaatagcgtcgattttacatgcatcaacttggaaaactttgtcttttcttataaaacaaatcttggccatgcagcagaggttttcagctaagctcaagacccacggtatgggccactgcatcccgtcgcgtgttccgcgtcaccgtacacggcgcctgcacacgcctgcacgaccaaagcgaaaacggaagcgaacaccaaagaccagttctccaaaaaaaaaaaatctcaagaaaaaaaactaaagaccggcaaatcgtgcctcgacacgtcacgtgctcatcaaataatcacaggtactgaggtacgggaaaaatactaatcgccacgtggcggaatgaccccgtttatttagtgttattttacatgtaatgtaataataatgttattatcatccatcaatcaccttatgaccattttccaccgttcccaatttccctgctcgatcgacttgctttgccttcgtctcctccactctgacttcctttctagatggtcaaactgcagccatcacaaaatctatatctctttttgtctcctacttgattcagagatgagaacaatccaagaatcgccataaacacacacggacaaaatttgcttttgtttttgtcttttttagctttggctcctgggtttcttgcagcagtggaccaagagtcgaagcaaacgtttagagtcagcgcagagccaccacggatcatccaatccttcgtggccaaggatcgagggactgtcttcttatgatccactgatcttctcctaattcggtttcgcttcgtcctcattcgctctaatcaaaccatttgtttttgctaatttcgatgttgcttaatccaagttggcttccgcaaaccgtgttttcgatttgtttgttttgatcatggcgatggatggggaagtgtccggtgtttggagtttcttggctttctttaagctcgagtggttgaggaagaggagcatataaatttggggggtgttcttgcatgaggtcaaacgagcgtagctactgcgtcggcgatggcgttgtcggagccggacctcgcggcggagacggaggcgatcgtgtcggcgctcacgcacgtcgtcgcgtacggcggcggcggcccgccgccgagcgaggagaccgccgcgtcgcggtgacaaggacagcgccgtggcgcgcggacggcgcgcggcagggggcggtgccggcggcgaggaagtacaggggggtgaggcggcggccgtgggggaagtgggcggcggagatcagggacccgcacagggcggcgcgggtgtggctcgggacgttcgccaccgccgaggacgcggcgcgcgcctacgacgccgcggcgctccgcttccgcggggggcgcgccaggctcaacttccccgaggacgccgccgcggccgacgagcgacgcgccacggacgccgcggccgccgcggcggcggcgtcgtcggcgcccgccgcgctgctggagtcgcagccgggcgacgtcgcggactgcctcgactactccaggatcctggcgggggcgccggagcggccgacgagctccaccgtcccggacgggttcttcggcggcggcgggaacggccgcttcttgcactcgtggagcattggcacgtcgccgtcgccgtcgggctcgggctcgggcggagccggcggtggcggtggcggtggcggtggcggcgcccctgttcgtcctctgtttcatggcggtaacggctgggagcaacgcggtgacagtgcatacaacggtttctagacgcctcgggaatcgggattagcgatatttgaagaagaaaagcaaaggattcgagaattagcatattcttttatcatggtactgagaattaggctatttttttaggtactcatagtatattcgagaattagcctattcttttatggtactccgtagtgtagtagtagtggagtagtagtaattagcagtagtagcagaataactttgttagattgtttcccgaaaaatcattgtatgttccaaaaactcatttaaagtaaggcaagcgattatttatgtagatagatacatgatgtaaactcaaagcaattttggttgtagtgatttgcgatacaaggagcccccgaatggggggcagagcaaaaataaaaaaaattgctagcgtatgtgtcatgcgctgttttttgctcaattgttgagcgaagagccgaggacaagcaacacagcaatgtccacaagtcggccttcataatccatgggttttgtttgatatgcttacgtgtgacatacgcacactaccatcagcatacacgtccgtgtgtgcgaggtgtgccttcgatcgagcacgtcaacagcgtagcaggatagatatgtaagaagaggtgaaatcctttcgatctccggtgtgggactaaaaaaaattgacggcgctaaagtaaacaacgtgcacctctgtgtctagtgttagaataattgggctagacttaatttatcctattaaatctcagacccataataagtgttaaggataataataccacctcaggatttaagcaagaaatatcttaacctaaatagggagttattggaggctcccagttgactggttgaggtgggggtcggaaagccacgcgcgcgcgccgggtcgggcgagggcgtgacgggcgtgcgtcacgtcgctattcttttgcgtccacgatcccacgttcccacgactgcctctgcaatggcgcgtccacgatcccacgttcccaggaggccgctagataaggaggccgcaagtccgatcagattcctcctccgcaacggcgcgtccacgatcccacgttcctaggaggccgctagataaggaggccgcgagtccgatcagattcctcctcctccgggcctatgctgctctcgcgttctgatccgcttgcttctttcccgggtgttagttcctcctcccaaccacaccttcgcctgagatctgcaccgggtaggcgggtgatcaggtttttggagatgcttcccgcacgactgctcgtcctcgcccaccatgtctgcgcctggagccggtgccgctactgctgctggaggagatggcggaggtggtgcgccaccaggagctggagctggagctggaggtggtgcgccaggagctagagccggtgccgcgaacaacaacaccaacggaggcaattctgcctcacaatccagcggagggccattctcaaggtatatccttctcctgttcctgttcccgttgttagcgctttactgctatattcctgttcctgatattcatgatgcctctagcatgctactgcgttactgctatgttcttgttcctgatattcataatgcgcatgatgcctttagtatgctactgcctttagtatgctactggttatgttacatgttgtcattagatcaccctacactgtttatgccatgattattgtcttaacattttggattaaaatatgccgatttatgaccatattttcaactatccaaaaacctgataggtcattttcggtagttggctttgctgctacattgaaaccacatgcttttgatggttctaactataagagatggaaagcacgtgcactattgtggttgacagcgatgcaatgcttctatgtttcacggggcaaacgaagtgaaccacctctttctcctgaggaagaggctaagttcgaggcttcggattgtctgttccgtggagcattgatcagtgtactcgctgacaacatagtggacgtgtacatgcacatgccttctgggaaggacatgtgggatgcacttgaggccaagttcggagtttctgacgctggcagtgcgctgtatgtcatggagcagttctatgactataagatggtcgatgaccgttctgtagtagaagctcatgagattcagatgctggctaaggaacttgagaacaacaactgcgagttgccggacaagtttgtggtgggtggcattattgccaaattgccaccttcttggtcggacttcgccacttctctaaagcacaagagacaagagttcagtgtttctgatttcattggttctttgggtgttgaggagaaggcgagggcaaaggacgtccggggcaaaaaggttgagggaggttctagtgccaatatggtacagaagaagaaccctcatgtatcccacaacaacaagaaagtcaagcctgatgtcaaatccaaggctgcaaccaactttaagaagaaaggcaagagaaaggcaaagggagactgctttgtgtgtggcaagtctgggcattgggctaaggactgtcctgagcgcaaagacaggaagtctgcgaacatggtcattagcgagggcggaggaacatcggggtacggtaaaatattacctacagttctctctgtttttcactcacctgattggtgggtggatactggtgctaatattcatgtatatgctgacatttctctattttcttcttatcaggtcggaagaggttcctccttgttgatgggaaacgggtcgcttgcggctgttcatggtgttggtacggttgatctgaagtttacttcgggaaagaccatgcagctgaagaacgtgcagcatgtctcttcaataaagaagaatctagttagcggctctctattgtgtagagaaggttttagacttgtgtttgagtgcaataaatgtgtcgtatctaaatatgggacttttgttggaaaatgttatgacaacggaggtttgttccgcttttctttgaatgacatgtgtaataatcataatgttgtgaaccatattagcgagaatgatgagtctaatgtgtggcattcgcgactctgtcatgtgaatttcggttgtatgacgcgcttagctaacatgagtttaattccaaaattcactttggtcaaaggttccaagtgccatacttgcgttcaatcgaaataacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgttgtgtgtatctattgaaaacaaaggatgaagcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagaggacgcctccctattcaccccaatcaaatggggtggnccgaaagaaaagaaccgtactctaactgagatggtaatgccatgttagacactgcggggctttccaaggaatggtggggtgaggcagttttgactgcgtgtcatgtcctgaataaaattcgaatgaagcataaggaagtaacaccattcaaggaatgggaaaggaagaaattaaatctctcatacctacgaacatggggctgtttggccaaggtnnaaatggtacccnttnattnnanaacnnncaaaaagncgngnanaacttggaccaaatattgttgattgtgtgttcctttgttatgctattcacagtgtgggttatagattcttaatagtaaactctggagtacccgacatgcatgttggtacaatttttgagtccagagatgctacattctttgagaatgaatttcccatgaaacatacacctagcacttctagtcaagaaactgtcatgccccatgagcactttgcaccgatagaacacaatgatcaaacgcctgaggaaaatcctgaggaggacaacattgtagatactcgcaagagtaagagacaaagggttacaaaatcctttggagatgactacattgtatacctcgtggatgacaccccaagaaccatagaagaggcatattcatctcctgacgctgactactggaaggaagcagtacgcagtgagatggactcgattatgtctaatggtacttgggaagtcgttgagcgtccatatgggtgcaagcccgtaggatgcaaatgagttttcaagaaaaagcttaggcctgatggtataattgaaaagtacaaggcaaggcttgtggccaagggttatacccaaaaggaaggcaatgacttttttgacacatactcaccagttgctcgcttgaccacgattcgagtactacttgctctggtagcctctcatggtcttctcgtccatcagatggacgttaagacaactttcctaaacggagagctagaggaggagatctatatggatcaaccagacgggtatgtactagaagatcagaagggaatggtgtgtaaactgttgaaatccttgtatggcctcaagcaagcacctaagcaatggcatgagaagtttgacaccacgcttacatctgcaggcttcgttgtgaacgaagctgacaaatgtgtgtactatcgctatgatgggggagaaggagtgatcttgtgcttatatgtcgatgacatattgatctttgggaccagcctcaatgtgattgaggaggtcaaggactatctgtccaagagttttgaaatgaaggatttgggagaggctgatgttattcttaacatcaaactacaaagaggagatgagggtgggattgcacttgtgcaatcccactatgtggacaaggtgttgagtcgctttggatatagtgactgcaagctagctcctattccttatgatcccagcgtgctattaaggaaaaaccgaagaatagcaagggatcaactgtgatactctcaaatcattggttcattgatgtacttggctagtgcaacgaggcctgacatatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaagccagtgtcagctatcctaatgaactgtgataatcaaacagtgattattaaagtgaacagttcaaaggacaacacgaagtcatctaggcatatcaagagaagactgaaatctgtcagaaagcagaaaaactccggagtgatagcattggactatgtccaaacggctagaaatctggcagatcagtttaccaaggggctaccacgtaatgtgatagacagtgcatcaaggaaaatgggcttgatacccacctaaggttgcacaatagtggaaacctgtccattgtgatcggagatcccgtgaatttggatggcgaaacaaactattgtgtgactgagagaagagacccttgtaaagggctcattttcatgatgtacttctcttctttcctgcatggtaggatggctcatgccttaatgtgatccgagtggcttttccaagcagagatgttgacctgcagaacatctcaaaaggaacacacctatatgagttcgactgctagtcacagtctatgaggtttgggcgatctctagatactcatgaaaggcctggagtttgacttatatgctccaaacagaggggatgggaacggcagcctagtaccagtcaagggtctgagtgaaacctgatcacacaaaactgacaattgaaggcatagtccattgttcagttgtggtctgatgtagctcatttcctaggtggaagttcaacttaacagtctccaccaaaaccctggtatatcaaacaggcacaaccttgagaacatttcttatgagccttgaaatttggtggggattgttagaataattgggctaggcccaatttatcctattaaatctcaaaggcccataataagtgttaaggataataatatcacctcaggatttaagcgaggaatatctcaacctaaatagggagttattggaggctccttgttgactggttgaggtgggggtcggaaagccacacgcgcgcgcgcgccgggccgggccgaggccgaggccgaggccgagggcatgggcgtggtgggtgtgcgtgcgtcacgtcactactcttttgcgtccacgatcccacgttcccacgactgcctccgcaacggcgcgtccacgatcccacgttcccacgactgcctctctcctgatagataaggaggccgcgagtccgatcagaacgatccgcctgcttctttcccgggtgttagttcctcctcctccgggcctgtgctgctctcgcctcctcgcttctgatcgcttgcgcacacgagagatcggaaggagcagggcctccggaaccacaccttcgcctgagatctgcaccgggtaggcgggtgatcaggtttttggggagtgcttcccgcacgactgctcgtcctcgcccaccatgccggcgccgctgctgctgctggaggagatggcggaggtggtgcgccaccaggagctggagctggaggtggtgcgccaggagctggagccggtgccgcgaacaacaacaccaacggaggcaattctgcctcacaatccagcggagggccattctcggggtatatccttctcctgttcttgttcccgttgttagcgctttactgctatgttcctgttcctgatattcatgatgcctctagcatgctactgcgttactactatgttcttgttcctgatattcataatgcgcacgatgcctttagtatgttactggttatgttacatgttgtcactagatcaccctacactgtttatgccatgattattgtcttaatattttggattaaaatatgccgatttatgaccatatttctaacatctagaaattagaaccccgcttcttgggctccctggagcattcggacgtcgccgtcatcgtggggctcaggagtcgtatcgctcggcgccgccgcctctggtctcctctttttgatggtggtaacggctgggagcagaggcagacgcaggattaaaaataaaatggtgcgaagatgtttattttataataccaacaaaacacaataaataccatatttatatcataatcacataaaaatatagtctaattaataaattaagacaaacaaaaccattttaaatcaaagtaatatttaaaacactataggctctccgatgtggtactaaaaacaatgtgcactttccttgtgtttagaaccagctgaacatatatatctctcatggaacagcgggtgcaccacgtacaagcctaatcatgattctcgtcaacaactcgtcgtttatacattttttttgttaggaccattttacacactaataaaaaaagtttttgcaagcggtcaaaaatatttttccaagcagggaaaaggaccacctgtacgcaaaggttttcataggcggcctaacggtcttgatagtctaggataaaattcgatacattacgattcatcactttatcatagactggttcatctagagttagactggcgctcgacttacaatgcctttgtcactacgcatcactccttcccatttgtggatcttttgtggcacggcgctggcacgtccaagtacaagctatttctttggctaacatccaacgttgatgctagatggcggacctaatgtttcagtggggatggacaaccatgtcatgtgccccttctacacgcaggagccgaagacatcaaaccacattctaatggaatgtgctgttgctagacaggtgtggcacaagctgctcatcgaggtaggcctatcaagcctctctcccaatcggtagtctaacctccatctttggtgggaggagtcatatggctgaatgcacaagcaccttcaattcttccgtcctcctgcttacctggtagctttggctagaacaaaattcttgcgtcttcactggtgatgtttcccaggtagatacggtggtggacacgagcatgcaagaggggcggctctagctgaaggtagaacctttttctctttgagatatttttggcacttggctgtttttctatagccaacaccaccccctgcaccttttatttggagcatattccggtttagttagcccacttttagtttggattctccccctcataacccctccatgatcattacaacatatatgtaaacatttttttttctaatatagcgacgtgcgaagcttttgtgcctttgcgaaaaaaaaacatcattcttcttctaacatagtgacatgcaaaggtcaaagctttttcatatttgtgccaaaagttgtatttaaacattcttcttctaatatagcgatgtgcaaagattttgcgcctttaagaaaaaacataattcttcttctaacatactgacatgcatagctttttcccgtttgcgaaaaaaagattatatgtccatcagattagtctaaatatagtagcaatatatttattttccaaaaaaattgcctagaagcacatatgtaatgtgcttgggagctagtggcgggaatttggttacaaacactcaaagtttggttttagggattactatgtaggcatatcgcccacaaattacgccgccactagcacgcttcgtcaccctcagcgtgtgcttcctcttttgcacgcccagatgccacgcggacggtatttgaggggcagcacaccccctttgctccgtggtatgggactaaaccagagagtgcatcgacgtgtgcagagccaaaggccctgtgggctgtgggcactctgctggagcgtgtgggccactagcggcccaccaaaccaattgggattcaacttgcctgtataatggatctaattgtcgttgacgagctgatgatattggtgggcctaatttgtgccaaagcagagcgtgtgcaggcatggcgtacatcactgcatgtaaaaaaaaaaccctttactaaactctagtaaccattgggttttaattggatctataccattataatttttatggttttaaaatttcactgcaattgatgtattaggaatcatgctactagaatacttttaaaatctgatctatatcatgtgtacatacatttcaactctctttttcttggctatttataattttatatggatcaaaatgcctctccctcctgtgtcagacaccgtgggttcctctgcccccaatcgtctctaccctacattcctccaaccaactgagcgagcaggggacaacagagcaagtgccatcggttcgcgacatggcgtcgacagcgaaacaagcagccgggggtggcgctgaccgtgtcgacggtggagcaagcggcaatggtggcaaggtcaggactgtgcggagcatatctcataatcccaccctctctttcttcactccgttcgttgaggaccttgtagatccagtggttaagcatatctggcgatggtgacgagactcagagatagcgggtttagtagtggctcagcgtgacgcaagcagatgtagggcggccactggtgggttctaggtttagctggtgctcgtggtcggcaactcctctacgccaactcctccatcaccattcttttgcccgagtgattttgattcaaaatgttgtggatttgatctgacgcaaagcattaattaaattatactccctccgtcccttaatataaggatttttaatattttacttacattgtttgatcattcgtcttattcaaaaaaaatttggaattattatttttttacttactttattatttaaagtactttaagcacaactttttattttttatatttgcataaatttttttaataagacgagtggttaaatagtgcaagcaaaatgtcaaaatctcttatattatgggacggagggacggagggagtagtagacaaatagacaatgcataagtcataggatatctgatctgacacgaagcattaaattgtagcatcataggagatcatataacgtggagcattaaattgtagtagacaaatagacaatgcttgggcaacaggaggcatgcctattttggtatatgggaaaatacgattcaaaacgtgtatcagacctacaacatggcatggattagattttcaaggtgttacagtggcatagatcctagtaacatggcatggatccgatatgattttcaaggtgttacagtggaactgaatatccattttttcaaaaaaaaaatcacctagattttttctacctttagatttatatctaacgaactacaaaagaaaataacaaatgcatatttacttacacattatttttatcaaaattatagtgcacttacatgtcatatcaactgaatttacatatataatttagttatataggactgtaattttatattatgatgtaaatattgttttatatatacaaccaaattctcctccatactcaaatggccaagcgctgcacatggtaagtggtaagctgccttagttttttggatgttgttagcacgaatctcaccataaatttaagggttgaaaaaagagtgatttgcaacgaaaaatctgtcgacaaagatttagcagaatcggttatgaaaacctacgactcaatcacaaggtgacacatgagtcatattcatttatacaatgcagagttatcttcatttatacaatgtaaagaagaaacaaaaatgcatcattttcatcatctaataagtaaagaggaagaaacaaaaatgtacatgagtcatcttcatttatacaatgcagagtcatcttcatttatacaatgtaaagaagaaacaaaaatgtattattttcatcatctaataagtaaagaggaagaaacaaaaatgtatcaatttcatttatttaataagtaaagagaagaagaaataaaaaaagtttgctaagcgcatgtgtcatgcgcctggctagtggcggatcctcttgtggaggaagttttttgcaacatcaagtttggggatcgctacgtgcacataccgtgcacactgtgccgccactaggtcacggggatccacgggctcctcgtgtgcctccattttggcacgcccagcagccgccaaggccaccatttgagggggctgcgcacctgcttgattccccggtatgggactaaactcaccaagtaaccaggatgcatcgacctgtgcactctcttatctcgcagtcgcaggctcgcaggcccctgtgggctgtgtgcatgggcagggccttcctagcccagttccttcgtcgcggcactagcaaaccaattggggatccaactttgcctgtgaataaatgtgtctcttgatttggcctaattgtcgtcgacaattaaccagctggtgtcaaagcaaaagcgtcgagttgcaacttgcaacattggtcagtaaatattgcagggataccaccggttgttgtttcatcctcccgtgttaatgttgtcatcaacgctgctgccatctttgggcaccatagttaggacaggagtaatataggagtacgctttgtgcggttccttgtcatcgctaatcaaagctgtggaggaaccacgcatggtactactccagcagtagccagtaggagtactgatttcgagcgagatcaggattttctgcaggttctgcttgaattcgctttcaaaaatgcatgggaaagtgtactcatctctcgttatgtacatcctatctaaatagttacagaaaatttaaaataaatttaaaataaagattaatatcaaatatatcactccataatatgcaagttaaaatttaacttttaaaagttgtagaaaaataacaacgaatgtatgataactattttcacagtttagtttgtttctttgttgtaacttatagaagtcgaatttagtcttgcatgtttgtaaaatgatatattttatattaatctatattatcaaaactttttaaaattttttataactattttggtgatgatatgcaagcaacgagaaaacattcactcgaggatgaaaatccgatatcaccgatgtgcatcagtggtagggaccggagttttacagccatcaatctgttcctatcgtttgattcgtttctccctcagtcttgtattgtatgcgtaaatagatcaggagttttggtgcaatcttttaccttaattgggaggctagctttggtttttgaaacaaactgggggtggggggtcgttactgtagctgttttaggctttaatcagtataatataacaagattatataggatgataaatgtaagaattaagaaaccacgcggtcgtactggactcgagctcgtactatactttcggttagtataagtactcctattattaacggtttggtattcttccgaattcgaactgtaatcttagcagctatacagtctacggagtacggacatgacacgagacaatattacccctcccgtctaattgtatccgaaacagtaatctaattatctaatctgaactccgggtagttcagtactattcaaaacaattttgctaacgtatttgtctacacaaattttatattgtagttgcatgtaatattgtatatttatcaaagtcccattcaaaatctgaagggaaatctgaatctggacatggcaaaggcgttgacctcaccacagaccagccccccatcgacgcgacgaccgcccgatcggaaaccgacagtccagatccaacccgtgcccgcccgcctcgacatgcgcgtccgatttatcccctttttttttttcaattttccccaactcgatcgacgcggaccggaccggaccagataccccaaccccgacgcggacagacacgaccaaccaacgcaccccacccaacccaacccgagagacggtccgaccgaccgtacgacgtgccgggcccgggctcccaaaccgggtccctgtcgggctcgctccgaaccctatccacctccggcttccccccacctatatccttccctccccctcgcggcgtcgagcaaagccaaaaactactactcctctcgaggcgacgacgaagaggagaggagaaatctagcggcggaagcagcagctgcgagaggcggatttttcgattcggttcgaggcgaggcggagcggaggaggaggattcgaggcgatggatcggtaccagagggtggagaagccgcgggaggaggcggccatcggcgccaacgagatccgcatcaccgcgcagggccgcacccgcaactacatcacctacgccctcgccctgctccaggtccgccttcctcctcctccgccttcgatttgttttgttttttgttttttttttgggtggggagagctagggtttagtgcgggttcagtaatctcgccgccgttggcggaagcgaatctggggcgcgtctcgatgtttccggccgattttctggtgacctagggctctactattgcgttggtagatgctgctgctgctgctctaggtgttggttggttacgttttatttttgctaattgctactagtattatatcccatagaatatacaaattgttttaggaagtgaactcttttctggtctggtgtagcaggcggtttatcgttgctgttgatgattgataggtggggcttgttcactgtgtgtcttaggatagtactttcaccctgtactatccttaaaataaaataggaaatagatttagtagggtaaaggtggtattgtgttgtgaatgatactaattattagtaattgttttctatatgtgtggagatttgatttgtccactgtctggtatggcacagtaatcatgagggaatctgactgtagtggctttgttaaatctgtccatctctttatgtttgggactgctattttgggggaatatccatgttttctaattagtcactaataattgcttttgctttctcgttcctcatagcaggacaacgcgacagatgaaatcgttatcaaagctatgggaagggcgatcaacaagaccgtcgcaattgtggagcttctcaaggtaaatttgcaattccataatgtaatcagataatattggatatccctcactgttacgatatgccatgtgctgatctacgccctccctgagcagagaaggattgttggtctccatcagaatacctctattgaatcaatcgacataactgacacttgggaaccattggaagaagggcttaacacgtgaggatcacacaatcttttttccatgtacctgtatctattttggaaagggcttatgtgtttgatatgattgtttgtctttatgatagccttgagactacccgccatgtttccttgattaccattacattgtcaaagaaggagctggatacgtcatctcctgggtaagtagaattctgcactttcttcctcccctttcgattttttgtaaaaaaaatctaagagagctctagttggatatgattattgtcagtagttcaagataagatagaattctttccaggaatggctcatttaaaattcatcgtgtcgcatatcttaactttttgctagactgtctcagtatactactgctgctacttattatatttgctagaaaattcaaaccatagagttattgtaggcaatatttgctccaaatatatccctattatctggcggtctatttcttttcaacatactcatgcaatatttatctcttcaaaacatatgtgatgtgactttgctttgtgtagttaccaaccaccgataccggctgatcaggtcaggccgccaactgactttgatcaggaggcagaggccgtgcccagtggtcgtggaagaggacgtggtcgccgtggaaggggcaggggaagaggtaaatatctgcctactgatgattgtaaagtttatatccctgcaaattatgattggtcttggtgttgatctgatgcctctatgaatgcaattcagggttcaacaatgaagattatgatgatgagcatggagatgcagaggtcccacagcctcagggatatcgtggcaggggaagaggaaggggcaggcgtggatcctttggacctggcaggggttatggtggagatggttttgcaatggaagaagctggtggatatgatgatggggagcctaatgcacctcctatgcaagggcatggttagttatgcttaaactttattacctagaaatagcattataaattatagttccttcagttcgattgtatttttcttacctattggtttgtactgaaatatactatctgctatcatttatcacacatttaatggatgttggctgaacgttgtccgagagccacttgattttttatggtttatgttgatataaatttaagattattttgtcagatgtgtaaaataagttacaaaagtaatatttaaccttaaatttacaactactatgactgttttgccttggatttttttttgaagtgttacaaatttgcatacgtaactttgcatttgttccttactttgccttgcatcttttgtgaactacagaaggtggcagaggaaggggccgtggtcgaggccgaggctgtggacgtggtcgtggtggaggccgtggccgtggacctcctcctcctcctcaagagtagagattggctggctcgtcaactatccaatgcagtgactcgtcttcattagattagtgttatcttctgctgtaacttaatctgtttaggtttttatgttcaaaagtttgacatagtgacttcagtgtgggggatgcggctagttatgattttgtagctaggttattcttccatttgctttttcctcagttctattaccattccaactgtgcattgtagcatctttttagtgtgttgtcctcaaatctagctcagaagatccatttgttatggtgttggaagatcgcacagcattttctatgaatgtgcaaatcgtatcgaactcgcttttgaattggatatggtgacgttgcatatgtttttgctcgactttcctgtgcatgtttcgcgtaattctaactgggcagctgtttgacattcggattagctgattgcctgattccactaattgttagtgattgtgaaacaacatgcttctgttcctgcagtttaatgttacgatgattgatttatatataaatatctgtccatctggcatggaggcactccaatcctccaactgcaaaagtcccagaatgtctgtaatttacaggattttcaaacaatttaatttaatttctcataaacagcttccaaaatttatccattacaaataggcctttagtcaggaggagattaagcctatatgaatgtagttcatcaagtggatacttcctaaggccctttgtaccaagaaccaccttaccatactatcgcaaaacaataattataatttttatagggtgtatgagaaaagcacaaattttgatctaaatttatgacagtattacaattttacccaaacttacattaaactacagacttaagagggtgtatcacaatagcatcaaatttaccacaatactacaggtctaatgcataatattgtagatctacaaatttgaacactaattttatcacacaatcatagcatgtagctcaacccaaatataaactcttgaaactagtagttttataataatattgatgttaaaattgtaattttgtgatatacataaatttgtagttacgaatagttctgtgcaatttactcatttcgtaacagtttttattcaactcattcaaactaccatcaaatagtatttaatttgtttcgaatcaactcattcaaataaaaccgtgatgttgttgctatcaatgttgatgctgcaacttttcagtaaacacgtcgaatgggagtgggcatggtaataaaaaactacacctgtgatttattggcttgcaatgagcgcacaaaagaggttaccatagtatagcttgctgaagcattggctctacgccgcgttgttgctctcacttgcgaagaaggttttcaaaacgctagtaattctgaatgcagtcatacggagagttaactcattatccatggaccaatcttcaaatggcatagtgattgcagacatcaaggtcatagcagtgggtttctcctctattagttttaatcatgtttatctatgttgaatgccgcgactcatttattagctcgtttctgtgaacattctagtgatgttatgcaccgtaacgtaaccttggagtgtattcgggagatactttgtagtaatgatttaccataaccaataaaacaccgctctctctaaatagacaaaaccaaccagtagtagtattcaatctacttccaaatttgaatcaaatagtagtcaaatttgcagcatgttggggaagcactagtgggtggtgatggagtcgtgggtgcatggctccatccactagggtttaaatcctaataagataatagatgtttcaccgatctccatctcttagagtctgccatgttatctcataaagaaatcaaatctaggtgaacttttagcagggttttagtaacataaaagatgtttggctgatttccgtctcttagagtctgccatgtaatctcaaaaagaaaaaaaaactgcagtatatgttggagaaagaaacaaccctatccctcgcgggccagcctgggccggacatgtcagatgggccagagagatacacgattacacgtgggttttttcttccccccgtttatttcctttcctgaaatttctccaaatctgccccaaattccgaattttactcgaactccaaaaacccttcccctcttctcccctcgcctcggcccgccggcggccggccaccaccgccacctcctcctccgatggatctcgccgccgtccacgccgccctcgccggcaagtcctactcctccgtcgccccgctctgcgacgacctcttcctccaggtaccaatccctcccctccccacccctctcccgcctcccgcgacgcgaggagggttagcgtagcgctcctgactcggtgttcctcgcgcaggccgcgtcccggggcgccgccaccgacggctggccctacgccgtgcacctcctcgcccacctctacctcaacgacctgtaacgccccgcgatctgctcccccacctctctcccatggaatttttctgggctagggcttccgggattaatgttgtttttgtgtttctgggtgggtgcgtgtgtgagcaggaacagcgcgaggtttctgtggaagtcgacgccgcaggaggcgaaggacgcgcggccggagctcgccgccgtctggaggatcgggcagtgcctctggaaccgcgattacgcgggcgtctacgcggccgcgcaggggttcgagtggagccctgaaatcgccgacttcgtggccgccttcctaggtactggttgttgctttactgttcatgatggaaacgtgcaacagttgaattattctgtgtctttgtgcaaagttgtattgcttactagaatgaattgcatactgtggtagtattgtgttggaggtcaccactttgtggtgtgggttgggaagtcgggagattcagatgtgcatacatatacttcatggagtaattgtggaaacgatttatctgcacaatcaggctgaatcagcttccttaatgaatacgcaaagttactattagtagagtgcccgttagtagagttttgtgctgcgtagtgtaatggttaaagtgtttatcttggaaatacttgcttcctaagatagccttgttcagtgggtttatactatctccttaataaggactagtgatttgattattttcaggctgctcataagagtttggttcccaagaagttcagttttgttcctatttttacttctaattgacaacatgatgcaacaattctagatgcacagaggatgttcattaactcatgcttcaatcaaaataaacactttgtagttatcatttatgagtgaaactgttgaatgtattaatgtaatagcattataattaaacatttgcacttttttataaggtgattgttaacattttaccagcagtcattgtgacacagtagtggaactagagaagttaagttctttccatgaagtgcttactatgacatataccataataatacgtcaatcaggataataagttaataacatcatgattgtttcccttttgcttgtttaaccaactaatcttctagtattatttttatattaggaaataagtataaagcctgctgttttatattttttttagtatttataattggttaacttgaatatccaatattgttttctgattacacagaaagctacagaaagaggattttccagttgttgacttctgcatattccacaatcagcgttgctgatgtggctcacttcatggggatgaatgaggaggatgctactaactgtacattttctgaaactatcttgttgctgtactatgttttttaatgttaagtacaatgttctgactatcttcatgttaatcaacagtatagatcatagaagttctgacatggttaatatggtgtttttagtcatctttatctgtagaaatcatccaaagtcccaattttaggatacactgcatccttttcaacttccatagcatttcttcatagattataatctttcgtccaatatgtgtttttgcaagttccttgaattttggaaggtaaatgtttctccctatgtctcaaaatataacaacttttaaccctcaggatttgtcccaaaatataacaacttctccaccaacattctctttccaaccaatcacaaccctccaccattcacttttcccacctacctccactactcatccaattacaaccctccaccattcacttctatctactttcttaataaccgtgtccaactctaaaactctaaaacaatgatggtgcccctatggacttcttttgggtagcacttctattgtactgactggattataacactgcatattacattactttcctttcacaatagaaaatagaaacctctccttcatacaatacttgaattccattttgtgccatcagtgttgtccacatttctcctggattgagcattgtacattctaggtttgaataaagtgtcagatattttgttgtctttgagactcggttgtgtcaaaattaaacatacttttgtgtgcatgaattttagtttgttttgatcattgtgataatgctggcccattgattttgatgttcacaatgaggtatatccacaatttcacatctaattggctatctctgttggcttgagtactgttgtggagtataaaattagtagaaattttggcacaacccactcaaaaagagttgtcttcattttaccatttcaatatagtgaatgcattcttcttccttctaattaccaaaatttttcgtaggtcattcatgtaacatattgaaaattattttttttttgtggtcaatgcatcaaggctcgtgtatccctctttctatggctataactaaaacttgctatatttgaaacatattgaaaaacatattgaatatttttggaataagcatccctctgtatttgaagcatttttagttctgcaaattttattatgctattgtgtttgactttctgcatgatatttgcctgcttcagaagctgatgacaatagttgtcttaataatcattacagatgccatgcaaaacggttggagcttggatgcggcagccaggatgcttactgtcgtaaaaccaaaggttaagactaaccagaagctcgatgcaagcaaacttcagcgattaactgaatgcgtcttccacctggagcactaaagtccagcattacgggcatcccgcatgactcttaagaaacctatttatcatatgatgccaagccgagattgccttttctccggaaatcagagttagttcagtgttgaatttccatctgcaattgatttctggttagcgaccttagcctttctctgtaatggttgcttgttgatatggttggtggtggttcttgccagacttacactgaagtaaatgacactgcttagtgtcaactcgtaagttaacgttgttttttgaagtatgagttgaaaattgtttcccgttttacagaaagtcactgttagtgttgttcttgattagttgtggcctttatgcttgtgcttcattagctgcatagctgccaattgggcatctattgtctggattttaatgagattgttatcctagacaaaacctgtagttgtaatgcgtacattactgtacgccgtatgcttgttagtatatttttgataatggattttctttgattagtattatcctgctatattacgctgagggagctcttctacggctttagctttttctaactttgtaatctgcaaagcacggaaacgttcttatggcatatattagttattattgttctctctaaatttactgataattgaaatcgttgtagtnagagagaactcgacgttctccgcttcttgtgcgaactcaggagtgtacaaacttaggagagaactcgaagttcttcgcttctcgtgcgaacttagaacagaagaacaaagaaattaaattaaaccattatgttttctatctccaaattgtactaccgcccttccatggtgagctgaaatccggggcctccatgcattggtcaaattgcttcgtggccagaagatttttcctggacacggctgacttcctggtgcctcctagtcccattcccaagcatacacaccacaaccccgttgcctagcaaacaacaccgattcatctacgatatgaccctgaactctcaatcctctttcaggtcatatattatcacatatatatagatagttgtggatttgttctccggcctgtaccgtgcagtgatgcaactgtggcagctatttgtcgctgtcgtggtggtgtttgaatctcgtgaagatgaagatgaagattaagtgtttcacgcaaaatgaggtggtagtaatgtgtgattagttgagttttaattattataaacttgaaaaatggattaatatgatactttagaacaactttcatatagaaagttttcatacgaaacgtaccgtttagcagtttaaaaaacgtgccactttaatccaaaatttaatccactctttccaatggattcgaacgtcatgaatcgcacatggacatgctgaatcatataaaatcttggccaatgatttattgcaataagagcacatatggtgaagtatgtgtacgatggtctatttctttgacaatttttagtgcggtcttctggtggtaggaatgatgtaatctagatctttcaccatgttctaacatcttggaatgaagaaaaagaagtcagaatagtttgtatttttttaagtaaactagacattacgcttcaatgaacggaaaagttccttttctcgcatgcattttagtttactcaaattctctcacattggaagtaaacgagggcatataaatacagcaacgaatgaaacaaaacatagtttaatctagaacctacagatgcttttgaggagagatgtcattgctgtttgcacttcctcaccaattcgatcataatctcttcttcaagcaaagtagtaggaaattgttctcaaatgccttccagttcggggtcgtggggaagatgccatcttcagctgcatttgccatacgatggatatcgatggcacgacaatttttcccgctgttgaatgaagaggagattgctgaatttcggatgcttcctagtcctagcataacactcctatagtcccatttgacgcttatcatggacatcaatgatatgcgaggagatagctgaattttggatgcttcctagtcctagcataacactcctatagtcccatttgacgaattttccccgctgttcgatgaataggagattgctgaatttcggatgcttcctagtcctagcataacacttatatatagtcccatttgacgcttatcatggacatcaatgatatgtggggttgcgaattgtgatggttgtgctggaaaaaaggtggctacaaccgattaaatgccgcatctcggttgcatatcatcagttgtaagtcatcaatttatccttatacatctataccatactattattatgtttgtacctatttgtaagtgagagctaataataagtaaaaaagaacaacttaagtggtgatttcaatatatgtctaatgtctatgtcaagtgatcaaactcatccaacttatataacaattagataaaaataactatgcaaaaccaccttaggtggttatataaatggtattgtaaaattgaggggattgaatatccggtttcaaagtttagggtgctagataaactttaatttaaagtttttttttggggggggggatctggaccttttcctttaactatttcctacaccccaaatacatgcaaaagtctaacaagttggatctgttctagtttaagccagaggagtccagtatgattctgcacggtggtgacattcgcctcgatcttctttttcgtggcttggagagagtagtccacaccgctaaaaatttccgatgtctcctagttccaaggttaccaatatgatgtagagtattccattgtattggtatgccattccctaggcagagacaacatcaacaatatgaccttaccatcctgatcccattgtatgttcatctatatatatagatagatatataatgaaagtataactcctggtccccggcgtctgcattaactagaatacataataatttgtgatacaactacagcagaatcatagacaggacttgcagaccaaactctggtggacaaaaagatatatataaggggagatatcatttatgtttttgggtacactgtttggaaggctgttcacctatcttatagagggaggaagaaaaaggtcttacagttacagagtgatttgtttttagagtaattctcagttagtacgtcatataatgtcaaattctagaattagagaaagagataacatgaatcctttttttttcatgaatgatgtgaataccttagtgctttgtgaaatgcacgaaaggagaatttgtatggactcccaagtgtgtagttcttttgcatcttgcatggaagaacatcattttctgctgttaatcctgattcacgagcagcaatcacataattggctgcacttgccactctggtccgtggccaggagactgttcctaaacagactgaatttccggtgtctcctagtcccactcccaactccgaagcatactttctccgtctcattcgtttttttggatggatggagtatatcagtatactgtatatcacaaatccccattgcctagtaaatagcaacattgagtcatctacgaatgtttgaccttgaactctcattgatcttctttcggggtcatattatcatacatagttgcatgcatgtcttctgttccgtgttgtgatgcaactgtgggcctgtggcagctatttatcactgaatcgtacatggacttttccaaaccatataactttggcagatacatattactaatgacaataatttatagctggagaagagcacataaatggtgatgtaagcatacaatggtctatttctaagacaatttttatggagagtttattggtagtacaagtaataatattcggaaagtttcggaaactgactctaactgtgttatgtcgagtgcgaattagaccccaagcacgtgctttcgtattagccacccccacctgaccatacagtgcgaaaattcattgaatagagcatgagaaaacttacagaactagagtcctaggaggcaatagccaagaaagagaaaaaaaataatcaccaccacacagtccaagagaagaccagcactgtaccggttactgctaagtgtgactggcagccgctaggccaacaaagaaactacaaccgagatcgtccatgatcttctgctgatggtttcccaattcttcctaatttcaggaggttggaagctatgccatcttttgctgcattagccatatgcatgacggcaaccagacgacatttggcccccgtgtttcatggcggtagcattacctctacacactatcgaattttcgatgcatcctagtccccaattaatatatcactatcccataatcccatttcatacctatcatgctcatcgacgatatatacatggagctgcaatggttgtgtttggaggagcaatggctacacagctcggctacatgtacatgaggttgaatgccatatcctgggctccaatgaggctgtggcaatattaagacctgactatggggcatttttctgtctgtatttgtgttccttgtagatcaattcttatgatatgtgatgcttcgtaattgcaaagagataaaactgatagatccagtacaactggcattaatttttagctgttatataatccgaggtccgaacgtggtaaattgtgccaaattgtttcatactgatagagatggactactggttgagctgctatttttatgtcaggagtagatgaaatttactttgtaaacacttcagggatgcactaatgcacctttatcattctagctggattttctcatctcatattataagagaacctctccttataaagtagatatattagaaaactttccttctcatcacacttttaatcgattaatcccatcttagccttctaatgccatcgatgttctcagtttgttttttcaaaagatgttataactatttggatgatatgtaaaaaaccatttgaatgacatgtaaaaaattgggggatattcccttaggacaaaaacatgtgcgttgaagtgtgagtatgaaattgtttttattggaaaaaaagtcactgttaatgtcatttcttaatcagaataacacaactatatatgcctatatcatattctaatagggataatttgaaccatgccacacaaatttaaatcacagaatccatcaaccgggggaaacatagcagagaaaccgaacatagaaatcacagatctgacaatcgggtgcgggcatagtggggggtggggagcttagctgacggcggcgaatcggcagcgactgtgatatgtgaggcttgcaagttgcagcggcgccggtggccgctaggagggaaggagcagcgcgcgggaggtcgggagtatggaaatggcgttagacctagggtatgggaacaccgctggctttggaggcggcggcgcggaggagtcggagtgaggaggcgccggaaggaggagatgcggtccgacgattggcttccaaggggaggaggcagccacgtggcggcgctcgaccacgcccgtcgccgctgccaccgccggagctcgcttgctccgccgcccacccgcgccgtcgctgcccgggaaggagagacagagagagagaggaaagggaagaagagagagaagggagagggaagaagagaggagtgaggctaacatgtggggtccacgtgggccccaccattttaaaattatttttgtgtgcagctgacatgtggggccatattttttttttatttttccgagatatagttgccatgtaggtgccacgtcaatgccacgtgggacaaagacctagtcaaacaagccacataagcgccacgtcagccaaaaccgccttcaaaaccaccgagggacctcgtttgcccgattttggtaagttgggggacgggtagtatccggttttacggtgaagggacgaaaatcgaactgggtgacaaatagaaggacccaatgtgaacttattcgatatgaatatagcccacatagttgagggacgaaaaatagacttattctataaagaagcacgataggttgtcgtgccttcaagctggcccggcatggcccgagtcatattaggccgtgtatgcagcccgtaggctggtacggcatggcccagcgtgtcggtcggggcgtgccgggccgactaaccttggcccaggcatcacgccccgactaaccccgactaaccttgcctaggcggtccatttggcaactatacttagaaccgacccggaaaaaaagaaataggaaaccggaaccaacaaaataagaaatactccctccgttttataatgtaagtcattctagcatttgtccatattcatatggatgttaatgtatctatacatatatatatctagattcattaacatccatataaatataggcaatgctaaaatgacttgcattatgaaacggaggaagtagaaaatagaaagggttaattagatacatggcattaaaaatttgccggttttgaaatatgccattactatttgcatatttggaacgatgccattgctattagtttgtaatctcagtagtgccactaagatatgtattttgcatgtatgacgaaaatgccctcatcttctacctctctccctcttctcttatcttctagctctctctccccgctgcttctgctccggcgccgtcaccaccgctgctgctgccgctgccgcgccattgctgctcaacgccgctgccgctcacgctgctgctgccgttgctgcttgccgccgctccgcacactaccgctcgccgctcactgctgttgccgctccgccgccgccgctcactccgacgctgccgctgctaccgctcgctccgctcgctgccgccgccgtgggagaggcgcttgaacacgagcttgaagagacgggacgacgtgtcgagcgccgggtcaaagagtatcccggccaggaacggccgcaggaattgctccacgatggatggcgagaacccaagcttctccaggtgcatcgccgtggtcgtctccagcgacaagatgatgacctcgtccgggggtggacgctgcccggagccgggcgaggccgacgaggagcttgtcagcgagtgttccgacgggggagaagatggcggagagggaacgcagaggaagtcggaacgggtcagacaacaggtagaatggctcgccggcgccaaggaagacgagcgttccaggataaaacggccagagccgcaacgccagaaagtcaaggagacgccggcactccgggtagacgagtgctccgacgctgccgctcgctgctaccgccgccccctgttctctgagctgtggaaggaaggagaggggagaaaaagaaggaaagaagggtaatttgatctaaattttttttttgtaaatggtaggtagtgacatatcttgaatctgtgtaaaattgtaatagcattgtttcaaatacgtgaatactgatggcatattttaaaaccggcaaatttttaatggcatatatctaagtaacccttctttgattctcattcccagatctggtttctgcagatgcttctctaaatcgatggcattttttgttttttttccgtcttcaccgattgatgtgtgcatgtcatgccatagtcggtattcatcctagttctcgattcgtacgactcccttccttttccctttaggcctcctccaacaaggatgagtcagctagctcataaatctccatatcagtttttgtatgatgtggaagagagagaagataaggagagagaatgcactatctcttcttcaagagctaagttcctaaagaaaatgtgagaggaattgtgaaacccaaagcattttaaacaatgtgctatgagacaatctattggagagaggtagactttttgctatctcttatatgagatggacaagcatgaagcatgagctagtgcaccattaaaggaggccttactagagcagattagcagatgacgagaatcgagacaaggtgtctgcagcgtgctcgatccaagtcggggagcgcgatagcatgatgactccgtatagaggaatctctgatgcaagatacgtcagttttgcgaggtctccttctcgcgcgacaaccacgaccagctctacgtctccttctccttcttcgatttctcagctttgatacaaatccgattttctccttttcgtttttttttcttgatgcagattagggtgtacatggcgttccttgctgcaattgtcgtcgtaggccgccgccgctccttccccgccccactccggccgccggcactcctccccgccgctctgccgccatcaccgctccacccgccgcttcggctggagagaggaggaagatggagtagagagagaattggtagtgaggatgacaggtggggtccacgtgggccccaccatttttttattatagtgtgcgtgaaacttacatgtgggtcctatagaggttttattatttttcggatcgaattgctacgtaagcgccacgtcaatgtcatgtcagatgatcaccgggtcaaattagccatgtaggcgccacctaagctaaaactggagtcaaatactgccgagggaccttacttgaacggttttgtaagttgggggacttatcatacccggttttgcgatcaaggacgaaagtcaggctaggcgacaaatagagggatccaaagtgaacttattcctattcatatggttggaaaaatgggtctattttgtatctcttctttttgggccttgccctatatggttatttaagtatattttgcatccctatactatttttcttcgatcgtgctgagccgggccggccagacgtgccgagggtgcagcccaagtacggcacggctgtagggccaggccagcacgggtacgacccctgtcaggccatgctgtgcttgggctgggccacgggccgcaggcaatatggccatctatagtttggggagggagagggattataagcgatattggaatggagcgatctggcgagagagcgacaagttacaagttacattataattttttatttcctattcctattttcagtctgaggttctacaaagtaaaagtttttggaaaaaaggttgttaggtctggggagggagcgatgtcaagacccgagctcagaaatgggtaatcaactctctctctgacgtgctcaacaaatctggttggtcgccgaaaggataaactagggttctaattagcctactcctaaagacaataaggaaatttagttctttcttatcttcttcatctggccaaatgccaacttaaatagtctcttacatcaggaatcatcttacagctgtaaagagagtaaagcaacgataatgacaaaaacttgaagtctgcagtggtccttcatccgcagctccgttggatgtaaagagcgaaccgttatccatcgatctcagccattcattactcccttctcttcagtcttcagaatgttcagaaatgctttcagtcttttcatttctatctttcaggttctgtcaagcgatctgtttctgatttctatttcctatttcttattttcccggtcggttatagggagggagaaggattcagaagccatatggggagggaccgatctggcaagagagcgaaaagttacaagttacattatctactaatataaaaagcacgagttgtatagtgcaattaacatcacgattgcaattagcgtcggattaacatgcgattagcgcttctcggtcccttccttcgacaaatcgaaagaaaaaacgtcgccagaccacctgcgcctcctccttccccaccttctgccgccgcgcgtcctcccccgcattccgccgccgcgcctcctcctcctccgccttccactgccccgcctcatccccgccttccgccgccccgcctcctcccatgccttccgccacccaaatctagaaaaaatcgctcctgatggtgcgccacgccctacctctccggtctccgcctcccgtcgtcgccggtcaccgccgtttgattgtgtttatatgtttaccatgatatatagtgctggaacgtgccttgcacgtgcactattactagtagattaaaatgcatcaacggtccttaaacttgtcagtaggtttcacttaggtccacgaacttgcaaagtgtacatcgagatccctaaacttggtttattgtatcatcccagtccaaagccgtgtttaaccgtggtcctgcctacgtggcacgccacgtgaaggctgacatggaatttttttatcctttcttccttcttctttcaccactgcgacaacccttcccctcgtgccgcctctcaccaccgagaaaaaagaaggaaggaagagaaaaaagaaggaagaagggagaaaaaaaataaaaaaaaatccatgttattgtccacgtggcgtgccacgtaggcaagatcacagtcaaacgcggctttggactgggataatacaataaaccaagtttagggacctcgatgtgcactttacaagttcgtggacctaagtgaaacctcctgacaagtttaaggaccgatggtgtattttactctacattatattttagaaaaagtacgaattaccccctcccccgcgcgaactatcacggttaaacgaattgctcccctaagcttaaataccagacattttacaccttaaactatttataccggactaagaacccctgacactgttctgagcggttttgacttgatttagcacacatggcagaccagtcagcagaaaaaagggtaaaaaacccttgggcccacctatctccccccccccccccccccgagaatttagactatttaccatcaaattcgcttgtctcaatttttttaccacccaattcacgtgccttctataatatgtcattaggattgctaattagtctatttggtaccactttctctatttttattgtatttctattttcttaatttcatctatttttattgtatttctcttttcttaatttcatttgtatactttttcaaggtttgtggacgtttttgcccatggacccacctgtcagataaaaagagaaatatctctctggttctggatcgataccagacaccagcgacgccgagcgccaccagacactagcaactaccactgcgccgccgagcggctccgccccaccaccgcgccgacgagcggccgccgcccgggtgcgtcgccccaccaccccgccgtcgagcagcgccgctagcactgtgcgccgccaccccaggtcgacgcccccgttctgcctccaccgcctccgacgccgagtatggtggcaactggatgagctccatcggcacctagctcttatttacagatgatcgcttatagtgccgagcatgatggcaactggatgactgcttactgaatgttgtaggatcttaattagttctcatttacatatttcctgggtgcttgaggacattgagtctgtaacagacatgcatattgtagccaaaaagtttcaggtatattgcaatattgcaaacctctaatggcgctgatggctggggcggctggaggtggtgccgcacagtgccggccgggtggtggtgaactgtggcggcgggggcgtcggtggtggcgctcggcggcggctgagtggtggcacttgggcggcggggatggtggggctgcgggtcggtgctggcgctagggcggtgggtcggacggtcggtagtggcacctggcggcggggcgacgccgaagtagcgcgtgtggggcggcggtggcgctacgcttggagggatcaatcgatccagaaccagacatatatttctctctttgatctgacaggtgggcccatgggcaaaaacgtccacaaactttgaaaaatatacaaatagaactaagaaaagagaaatacagaaaacatagaaaaattggtaccaaatagactaattagcagtcctaatgatatatcatagaggcatgtgaattgggtgttaaaaaagttgaagcacgcgaatttgagggtccccggctaatgacatattatagagggcatgtgaattgggtgttaaaaaagttgaatcacgcgaatttgagggccccccccagcgcactctggcggccaatggcggaggtgggcggagcgagctcgcgtggctgggggcggaggcggaggtgagccggttccccaaatccggccgccgccgccaccctcatctcccagagcaggaggcagccggagctcgctcggggaggcgtgtcgaggcgggcggatggtcggcgctgacgggcggcgcgggaacaggcggtgggcggcggtggtgagggggcgcggggacaggcggatggtcagcacggacaggcggtgtgcgggagcgcggggacaggtggtgggcggcggcacggggacgagcgatggcgacggcgcgaggcgagcggtgggcagcggcgcggggacaggcggtgggcggcggtgcggggacaggcgatgggcgggcggacgattggcgtggacgggtggtgtgcggtggcgcggggaagacgaggtgcctctgcctccagtcgccgcctgcctctccatcacggcttgcctcccgcgcggcttcaccgcgctccacgccgtcgacctcccggcgtgcgcgcccccgtctccgggtgctcgcctacttcgggctcgcaccgagctagctcacgccgagcgcgtggcgcctcctcgccagcttcaccgtgctatgccgtcgcaccggtgttgcgccgccgccgctgactgtgctccagcacttcttcacggcgcttgggtgcccgcccagggcttggttcttccgcgccgccctgtgagagagagtgtgtggagagagagagagagaggaagggaagaaaattatgtaagaccgaagtcttaccctcatccgaaggactttgttgctctgcacgacacctgttccgcacgaatcacagcgcatgcttactccctcaatccccctcgtctcgcttcggttcctcattctttcgctcctggtgactggtgaggagtcgagctcgggcccgtccgacagcccacgcggcggcgccccgcagcatcgagctcatgagggcagccaggaattagaatcaaggcatcaagctcgtgcttccggcctgcttgtacaagatatctcaagatttggaagaaggtgtgtcatcgattcgaatctgctccttgaactgcaaagagttgcctcacgatgaaattattcaacgattagattttgcttgccgttgagtttagtctgtatggtgcattgcactgattatcattgagccttcaaagatttctttgtatttgagcctttcaggattataatatgttgatgtcttgacgattcttcccgagcagcgactcatgcgagcatggatgctgctgagtttctctgccacatcacgaatcccgctcgatgcccgcgacagcgacagccgcgagctcgacgcctcgccgaggagagcaaagagaatgaggaaccggaggcagaaggatgaggggagtaagcctgtcttgtgattcgtgcggggacaggtgtcgtacagaggaattaagtctttcggatgagggtacataattttcttccaggggaagaggggaaggggagatacgacggtgggtcccataactttttaaaaaagaaaatactgactagattgccatgtgtacgccatgtagaactatactactctggattagatcgaggggggtaattcgtccagtattgaaaattcagagcgaacaatgtctgtttttcaggtttagagaggtaattcggtcgaccgcgatagttcaaggggagaatttgtagtttttccttatattttgatttcctattcctatttcagggtagatatgttaggtgggacgacaaaaccactataattttttttaagtaagccaagacaaaaataaagataaagataaaataaagatttagttgagaataacaaatgaacatttctaaagggaactaacgaagaacatcattacttttgagtcatgtgaatggagctgctgaatttcatacgcctccaagtgcacacaaaccagtgacgaattgtcgataactcgagacaaaaccataacttaccatgcatgctctagcggagcaaagcaaccaactttcacaaggtcagctgctccaccaggcaccagccaaccttcaaatctaaaatacgtcgtgtgtacattgattggtggtgagaattgggtggatacatttatcttctcggttgaatttgcttgatccagtgttgaaattgcacgatttccggttagcaatctctgacttttctgtaccggctggttgcttgttgatatggtggttttccaagttctaaatggcagtgttattatatttgagcaaaagacaataataagtgcttaatttcaactcaagctcatgctcttctttcaaggatctcgcactctcgtataactgcaaacctctcacgtaagctttgagtacgatgcaatagtttagcactacttttgtgcttctgtgtccaatacccatcgtaacaaacaattgttcactgtagacaggtcaatgagcaggtcatacaaatatctaacattaccatataaatggtaacagaacgtggtacttgtgccgactccagactaataggaaacctcacccaaaaaatgaggaaaattgaaatgctttttggttaagtatgtaaccaatcacagagcatataaaaaaaccatcgcagttgggaggcaattcataaagaaataataccatcccgattatagaagggcaaaattaaggtatcttacaagctatatcattgcaggagatgatatcacacatcaatagacaacacacggagacacacatcagtaaagcacgccatctagtctcttactacttgtaacgctccgcttttcgtgagtcgttaaaaactaactcggcaaaatcctaattgcgaaaattttcgttctttgtgtgagagtctaagttgtgccaaggatctcaatttaatcccgttgttccctctcatcgaaatcgaaatcctccacctcgaaaaattccttttccgattcaagtctctgaaatcaaattctgaaattcaaatccttcctttgaatcctcgccaaatacttctacgaatctagaattattcaaatctcgcctcgaatccttcccttgacttcaccttatgttcctaaagtcaaagtatcaaggttaaattccaaaaatccttctcaaattctctccaattgaaacccccccaccaaatcagttctctcgaaaaaagtctaaattgcgtccttcttggctatgggccgtttctcccttgctcggcccatttctcctcagctccctccacctccacgtgcgctgcacgcgccgagagagagagaggcatcgcctctcttcttcctctctctttcctcgctctctctctctgcttcctttctctctctcccacgccagcgctgccgccatcgccgcttcccgccgtcgccgcccaaaacccgccaccgccttcgctctttcccgcgctcgtgcgtggccgaccggccggtcgttgccgccgtcagccctgccgcgccctcgcgtccgcgtgcacgcgctcgcgcgtgggtcgccgccgcaccagccccgctgccctgccgcgctgcaccacgcagccgcacggccccgcgcgcgtgctcgagccgctccacgcgcgtcctgccaaaacccggaggccgagctctccctctccctcctactcccttcccgaatcggcttggagcgagcctctctttttccccttctttttccctttcccgaccaccatcggcgtcaccgcctgccaccgcctggaccacgggcgcgaccgccagcccgcgctcacgacccgaaattcggccgtccgatccaccgccttcgccgcccaaagcatccacgccgtcgccgcttttgcatcgcccacgaaaccgccgctgccgccagccgagcgcttgaccgccaaggtcggttctcccctcccaaaccgacatcgcctcaccccgcgcctataaaacccgagcccttcccatcgaatcctcctctcgtttcacttccatcactgccgcgctattgttgttgctcactccactctcgccgtcgccgttcgtcgccaagcactggggaggccggtgcgtgcgaggacgcgtgacgcgggactccgagcacccccccttcttccccttccccggcctgagaacggagaactcactcccgcaccgtcggccactcgtcacggtgccgtcccgactcggtagtgactccctccattctccttcctcgttctccctcgccctctctagcttgcgtggtagctctactagcccctcgaaagcgcgtagacaccgccccgagctccgccgccgctcggcatggcctcgccgccattgccgcccgcttccggaggccgccgccgtcgctagccctcctcggtgctcctccgccccatccgatgccggaaacggatttcttgaaccccggacatgcccccaccgccttgaattgaatccccgtcacccctccgccgtttcccccttttcccgccaccggcgtgcgccgccgcgattcgtcgtcgtcggcccctcctcgaaggatccgagccgttggctcaacccctctcgtgctcccctttgtaccggtgaactccctctcgatcgaatcgctgcgtcgtgctccggtgaaaccccgccgtcggccaccgttggttggagctcctgttcttcttcctcctctcgcccggcccgcgtggctgccacgtcggcgccacctcgacgcgaccgggtcaaagctgacctcggtcagccgcctccctccgtcccccaccctcgcgcgcggtccacggagagccgacatgctgcgcgtgggcccgccgcacaccgcgtccacccgcgcgccgcgcgtggaccgcttccccccccgaaccctagcgccgccctcgcgtgcgcccatcccaccgtgggccgtatcaccgacaagcgggccccacccgggaccccgcgcggtggaatcggtccaccgggccgtctctctcacccccgcgccccctctgttgggccgcctccccgtggccgcgcccggcccaatggctcggccgagcctccttcaaccctttgggccgcaccaatgccacccgagacaagtccaaatcacatccctcatccctttaattttccaagggatttaataaatccttttcctttgtttcataaataaaattctttattccaaaattccatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttccaataattccgtaaattgagatctatttaatggcactactaattagtctaaataggatctttctttttgtcttttgtttaggttttcgattgtttgcgtatagttgcagttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattataatcacacacttaacttgcttggcctcggtttgcgtgccaaatcgacggacctacctagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaacttgcgatgcgggggttgtgcctatgtggcactgtcccgtattcgcatataaggaccgattcctatgggaaactcatcgaacataatcaaagtgcaaccacaaggtggaatgggacaccctggctaagtaactagtcggttcagggaaacctcgcatgccaatagttgggaacgttggggcggggtcggttggagccaaaccgggttcctggtaatgcaagaacgagaagcttgctgaattaccgatcgaggtggttggagtttgatttgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcttgtgggtaaagtgtacccctttgcagaggttaaccaactgttcgaacagccgtgcccacggtcatgggcagatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagccgattattcaagtggaatggctctgggagccgagaagtaatgatctgacccgggaggtcggtacatttccatttgagctgttgaaaagcatctcttaagtcgatttgagacgtaagtctcttttcgacccaaacttagaaagaaataattcacttagtgatttcaaaatatcttcaaataaaagatttgcaaaacaaccttgcctctcttccaagcttgcattaaacacctaagttcccgtgacttgctgagtacgaaagtactcacccttgctccatataaatatatatagttcctccgccctgaagagaagacaaagtgaagtgaagattagggtttcgtcctggttcccagccgtcgcctgtggtgttgggtgttagaccgttggttccgctgccgctgttgttgttggtgttcgcctcgtccgtgttgtcggttgtattctcgggctgtctgagctgcaacctaagttaaggtaaataagtcctctatttatttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacactactagacttcatccagagattgtagggttactaatagatagtaggatgcacaatggataaaacaaaagtccaaacttgtgacattaataatacaagcatacctcttatagtctattaagatactaatgaaaagtggactaagggaatcttcttggaagcaaagcaagtctcaaaatatattagaacactgactcaatgaaagtgccgtcagtagtggtgtgacatttcgacttgtgcttgatcattcggagtttctttttgccaccattgccgttgccattgccattaccatggccattgcaactgttgcttgcactgccattgcaattgctgcttgcaattctgttgtctttgccaccgttggcactgccattcccattgccctggtaggtacgtggcaccacctccacaccggttatgatagcaaatgtctggtcaatgaaatcatcgccgtagtagctaattctcgtagtattgaagaaccttgcaatgcagaacttgcccgagcctatgttgacaagctgaggcccctgcagtagatcccagtcctccagcgggtcaaactccttccaagtgccaactagctgtggtttggagtccaggttggagagatcagcagcagataggtggttcttgtcagagaatccaaaccagagattgagttccggcacatactcaatcttgccatacaagggtagcatccacttgccaaccgggctccaagtgtgggtcgcaatgtccatgcagtaggtgccaacgtcctccattgatatcaagatttaggtgccaccaccgaccactgcgtaggacatgatctcggagcggaccttcatctgcatggggtcacgtaggtaaggcggcggcggcagcagttggcacttccagtacttgaaggatgtcttcttgtgctgctggccataggtgtacgcctcaaactggtcactcgtctggtctttgtagcgcagctccatattgggactgctctccatgacaaagagggtgccaacatagtcttcatcatactcctcctcgtccatgttttgactgactgcgctcgggatgaagagggagaggggtttttccttgggtttgtggaggctgggcatggtcaccacgtggtgcgtctcggcgtcgaagaggaaggtgcgcccagactggtccgcgcagagcatcttgctctccgtgagtgggaggtattggatgctcctcctctggtcgtcgtccttgggtgaagctcggaacgtgatgatcgggtcgggaagatgaatcctcggcatctttgacgcctcacagtcggcattggccaccgatccttttccgtttagtggtggtcctgggttaaagaatttctggcgcgctaggtcgatgcggcgcagcgacctcaacccaaggatgcggctgtccataatcacattcagaaagcgtcgcgagaggctcatcgtcgatccacaaacttcaaaggaaaaaaaaatcatcagaaaatatagtgaagattcagtaagaacgagagggaaaaaaaaaaagaaagaacagacaatctccgtgatttgggtacggtactagctagcaagattagattgcggggaagaaagagtagaagcacggagcaacaaaccgattcgatctgctttgcagtcaatccagggagcgtccggcctgctctgctgcaggataagatggtatcacaagttctgcaaatatcaaagataaaacaacgagaaaatgaaaaaaaattggctttccaaccgagaggataaagataaaacagatgtagaagtagaagcagcggacctggggcactcggttggaaggggcagggcgtaggcgtagctccccagtggccggccggaggacgaaggcgagcaagatggcggcggaagggcgagagaaggcgatggggatggatttctttctaggtctggacgcctcgggacaatatagtaaacgaacctacacgtctctccatgggagaagacagttattcaaagcttctccagatttcatctcaaatttaatgtacttctttttaaaaaaatcacgacgaagttctttaatgttattagtaccttcataaaaattattcaaagcaacccaaatctcatgagcagtttgaagatgagcaatacgatcataatccgaacgagaaatcccactcaaaagaatattgcgagctttgcaatttagttcaaaagtagttttttcagcagcaatattaatagtttcaagaatcacataagaaagagaaacttttctccaaatattataattctcagccataatgtaagattgcatcctactacaccaatgagaaaaatctgttccatcgaaaatatgaggcttagttgtaaacttattagaagtagccatggaaaaaactcaagatcggtaaagatcaaaaagagcaaatgtggctctgataccacttgtaggatcgaatcacaagaactagtccaaccagaggggggtgaatagttggtatatccaaaaaccaaaaacttttagtggaaataaaagttaccctcgaaatcaatggatcgcggtctgaccgaagtagtagcgccggtctgactgcctgaatatcgtcggtctgaccaaggttgtaacaccagtcgaaccgccgagatcaatcgccagctcctgtcgccgccgccggtctgaccgccctagtaccgccagtcggaccgccgcgatgccgccggtctgaccgctggtgagatgccggttagaccgccgaaacccggtgaaacataaatcgaagaactctcaaagtagatgaaaactttattgcttctctctgtgtttacaaagtgcaccaacagcactccttacaaaaatctcgactaaactcgaaaccctaactaaactagcaactcaattgctctcaaaagcgataccgggaagcctcacgctctctctctatttatacatgaggtaggcagcctaaagccacgaaccaaactcatactaagagtcctaaacaccttaggaaaccctctagtacaagaaataaactccacataaccaatcgtaccaaatttggactccttccaaattcgactccgcatcccatacgcacacaatacctccatcgtatgccatatagaatctccatcaaccacgtacatcaactctagccttagtatcccgcatgatatctgaccaccacggacatcgtcttaccaccaagccgactcccggtccatcaccgcaaatactctcccgaggcatcgagtcacctacacatgaaacaaacaaagaaaccatatttcgagaccaagctatctccaactcgactcattgttagcaaagaacagtattacatacgtatagtatccatctagaagccataaccatgaaacaatcatggatatccaaataaacaacacgaaaccgaaaccgacacagcgtcggccagtcagaccgcgggcaagccggtctgaccgctcacatagcgccggtctgaccggcaaccaccgcccgatctgaccggtcccgacaaaccagtaaaccctgttcatctcctggaaattgattatctccaaaaccacttcgacgataatctccaaatatcaaaaccgataatcacaggtaccaattgttcatcacagaattagaatcaaaacacacgttgatcttacagctacaaccgattaaatgccgtatctcgcatgtatatcatcagttgtaagtcatcaatttatccttatacatcgataccatactattattatgtttgtaccgcgctattagtaagtgaaagttaataataggtaaaaaataacaatttaagtagtgatttaatatatatgtctaatgtctatgtcaagtggtcagactcatccaacttatataacaattagataaaaataactatgcaaaaccaccttaggtggttctataaatggtattgtcaaattgaggggattgaatattcggtttcaaagtttagggtgctagataaactttaatttaaagttttttttttttgggggggggggaatctggacctttcctttaactatttcctacaccccaaatacatgcaaaagtctaacaagttggatctgttctagtttaagccagaggagtccagtatgattctgcacggtggtgacatttgcctcgatcttcttttttttctggcttggagagagtagtccacaccgctgaaaatttccgatgtctctagttccaagattaccaatatgatgtagagtattccattgtattggtatgccattccctaggcagagacaacatcaacaattgttgatatgaccttaccatcatgatcccattgtatgttcatctatatatatagatagatatataatgaaagtataactccctggtccccggcgtctgcattaactagaatacataataatttatgatacaactgcagcagaatcatagacaggacttgcagaccaaactctggtggacaaaaagatataggttgtgtttagttggatccaaagtttgaattttggttgaaattggagatgatgtgactgaaaagttgggtgtgtatgacaggttgatgtgatggaaaaggactgaagtttggatccaaactttggatctaaacacatccatatataagggaaaatatcatttatgtatatgacggtctgtttttgggtacactgtttggaaggctgttcacctatcttatagagggaggaagaaaaaggtcttacagttacagagtgatttgtttttagagtaattctcagttagtacgtcatataatgtcaaattctagaattagagagagataacatggatcttttttttttcacgaatgttgtgaattccttagtgctttgtgaaatgcacgaaaggagaatttgtatggactcccaagtgtacagttcttttgcatcttgcatggaagaacatcattttctgctgttaatcctgattcacgagcagcaaccacataattggctgcacttgccactctggtccgtggccaggagactgttcctaaacagactgaatttccggtgtctcctagtcccactcccaactccgaagcatactttctccgtctcattcgttttttttgacggagaaagtatatcagtaaatagcaacattgagtcatctacgactgcgtttgaccttgaactctcatcgatcctctttcggggtcatattatcatacatagttgcatgcatgtcttctgttccgtgttgtgatgcaactatgggcctgtggcagctatttatcactgaatcgtacatggacttttccgaaccatataactctggcagaaacatattactaatgacaataaattattgctggagaagagcacataaatgatgatgtaagcatacgatggtctatttctaagacaatttgtatggagggtttattggtagtacaagtaataatattcggaaagtttcggaaactgactctaactgtgttatgtcgagtgtgaattagaccccaagcacgtgctttcgtattagccacccccacctgaccatacagtgcaaaaattcattgaatagagcaggagaaaacttacaagactagagtcctaggaggcaatagctaggaaagaaaaaaaaataatcaccaccacatagtccaagagaaggccagcactgtaccggttactgctaagtgtgactggcagccgctaggctaacaaagaaactatagccgagatcgtccatgatcttctgctgatggtttcccaattcttcctaatttcacgaggttggaagctatgccatctttcgctgcattagccatatgcatgacggcaaccagacgacatttggcccccgtgtttcatggcggtagcattacctctagacactatcgaatttccgatgcatcctagtccccaattaatatatcactatcccataatcccatttcatgcctatgatgctcatcgacgatatatacgtggagctgcaatggttgtgtttggaggagcaatggctacagctcggctacatgtacatgaggttgaatgccatatcctgggctccaatgaggctgtggcaatattaagacctgactatggggcatttttctgtctatatttgtgttcttgtagatcaattcttatgatatgtgatgcttcataattgcaaagagatcaaactgatagatccagtacaactggcattaatttttagctgttatataatccgaggtccgaatgtggtaaagtgtgccaaattgtttcatactgatagagatggactactggttgagctgctatttttatgtcaggagtagatgaaatttactttgtaaacactccggggatgcactaatgcacctttatcattctagctgaattttctcatctcatattataagagaacctctcctttataaagtagatatattagaaaactttccttctcatcacacttttaatcgattaatcccatctttgccttctaatgccatcgatgttctcagtttgttttttcaaaagatattataactatttgaatgacatgtaaaaaaccatttgaatgacatgttaaaaaatgggggatattcccttaggacaaaaacatgcgcgttgaagtgtgagtatgaaattgtttctattggacaaaaaaaaaagtcactgttaactaatgtcttctcttaatcagaatagcacaactatatatgcctatattataaatatataatatcacaactaatgcgcggtgcactgtcttctgaactcgttgctgtgggcttttgtatcaagaatcatttatttgaatgcagctgggaaagagttggacaaatggatgtgtgaaaaaagtagccaatataatgtgacagtaaagcacaacacaacgttcaggtatctttttttttgttaatagggactgtctgtatatctcttgatagaaaatctcaccttccatctttcaaattttagactatcggatatgctttaagattcgtgcagaaacattaaccctagctcttttccttccgttcccctcgcatcgctcgttccgccgcgcccatcgtgcttttgttcgctccgcctgatcccccgccgccaccgccctactgtgtcgccgcccgcctcgccggctggccggagggtgtcaacggcgccggcgagacgcccggggcagccgtcgggcggtggcg

SEQ ID NO: 79479 - DNA, 8658 bp, Oryza sativa
ccccccccccccgccaccaaattgagcagctgaaacaggatgctcacatcatggttcttggaccgtgtccatgcacatctcacattacagcaaaaggcttctttcaccttgatttcctctggattctgtcatctcgctttcggttgcccatgagtccgggataaataaacgaactgaatcttgacaaaatggttgatcaagatgttgtctccactaatcttgatcgccatactaagtcttccctggttggaaatcaagcagcaggcgccgaccaacattaaagcgcaattaaggttgcctccaagagcaaggcaaaataatttcttcactcgaaaagcatcactcgcttcctttgcaagcagagtctcacatggccatgtaagtaccaagtccttgcgtttgcatcatgagcagatcgagcactaggcagtgagcgagtgagtggccagtcgttgcgagcgcactagtgcgtactaggcgtcagctttcctttttcttcttcttcagtcgccatcgccgtgatcaaaattttcagatcactcgatgtctcatcgctcttgacagtgtcagtgaagaacattgtttagaagtttttttttgtcacatcggatgtttgaccggatgtagtaaggggttttcggacatgaatgaaaaaactaatttcatatctcgcctgggaaccgcgagacgaatcttttgagcctaattaatatatcattagtatatgtgggttactttagcacttatgactaatcatagactaattaggcttaaaagattcgtcaagctattcctcctccaactctgcaattagttttttttaaaaaaatctatatttaaagttttatgtatgtatccaaagattcgatgtgatgtttttggaaaaaaaaatttaggaactaaaccaggccatagtagatgtgttcagcttctggcctttgagctggctacctgtgaagactgagtatgacgttgcggtgatatgagggtgatgctgcaagcacgattgatcgatgatggcccctgccaattattgagcgatgattaattcgtacagtgcactaagtgtcagtcagtctgaataattttcgtctgttctagtgaggctccaaaacgtgttattttggtcgattcagacgcgtcggacaggcagagtgggtgagcatgataattcactacttctagtgcttgacaagacactgaatgctgattcgtttcggtttggataagcaaccatttttgcattctttccgtgccaaaagaacaccgaaaaaagaggatagaacagttggagcagaagcaagttcagcagcaacaaacagtcttacagcaagccgggatcgagccaacgcatttgataacgagattaattgagtttgcttatcaacgaatgaacggcccgaccgaactctgaagaactcaatccagtttaggacagccaaacactctactgaaccagctgtctgagctagctaggtaggccaaaagcaaagatgaacatcactatggcctttgtttagtttggaaaatgaaaatttttaggtattacatcggatgtttgattagatgttggaaggggttttcggacacgaatgaaaaaactattttcataactcatctggaaatcgcgagacgaattttttgagcaaaattaatccgttattagtacatgtgggttactgcagtacttatggctaatcatggactaattaggctcaaaagattcgtctcacgatttttatacaaactgtgtaattagttttttattttatatatatttaatgctctatgcatgtgtctaaagattcgatgtgatgttctgtgaaaaaaattttagaaactaaagaatgcctatattagcaaagagaaaagagattttacaactactaacctaccctattgacgcagatcatagggccgggttacagcaattctagcattctggaaccagcccaactgtaatcctaatcttttagaccaccagatgtgagccagagctactcatcgcctcatgtgtcatgtcatgcgccacggcaacgcagcggggtggtcgctgtcgcgcgcggcggcggccggcggccggcggacggcgacggcggcggagaagaaggcgatggcggcggctagatcgcgagatgggcgggcggaggtaggtggagcggtttcccaaccaccagggccacctggcgcagcgtgggccccacctctcaacggctttgacctatctcgcgcgccgctgacgtggcgacgcctcattggtcacagcgatccacgtgtacacaaaccttttcgttgcatgcgaaaaatcgagaggtgtttttagctgcagcgtgcaggtgcagtattagttgaccacggcagtgtaaacactgtgcaagactatatctacgtgcactcaacgtaggagtactacgtgtgctcccgatctcgcaaaatcgctcgtgctaattactactttgatctggtcgatcaagtcaaatcgacacagtatcctggctaattgatgcagtatcctggctatggcttgatcggaagaggcaattcgtgatctcctgtacgtttcgtgtcgatctggacttgccagaagaatcagttcatctggtaattaatcaagcaattaattaattaactattaaggtcactgacgtttgatgacattggcaccgatcgaggataaacaaattgtgtggctaatcttcagggctcagggcgctgatcaggtggattataaaatcgtattgtccaatcgatggcaaggtcctgtgattggattggatcgtgtttatgcttaattttaaattggaaaagtctatacgtacgaaactttttattacgaaacatgtacgaagagcacatgcagcctgtcttttcggcttgtatgctctataatcatcttgcaagtacctaagcccgtaacaaatacaggcccacgtatggtgcaaacgaaaaagcaagagttatatctctacttgtctgtaaaaccatgtgctacgaaaatctatacacaggctgcagatgttcaaactataaacaagtaaatcgtgttcaaatcatattgaggaattactactgcatgctcatatcactatcgactaccacacaactaatatatattgtcctttgcagcatcgaagtgatcagctagcatatcaaacaagtacatcggtgcatcaatgtatgatttattattagtgtgggcatggtagatcctacctactatgcaggaagcaacccaatatttactgctcgtattgtggcggcagctgaggcggtgaggcctaggcatatagccgccacctagctcatatgcttgattgaattgaatttttttagaactgattaaatttattttatccttgctttctgcatctccactcaagcgaagctctgaagtttgaatgagtagcatgatattgaacctatcaatttgatatgggcttttcttattgaataatctagagtgttgtaggcctgtgatcttgtgtgggcttctagtgttctagccatggaaatcacgtaagcaggtagttttcgtacgaatttcgtacagatttcttcgtgtgtatagcagggtgtcggtgacatgggaccgggagtatcatgactagaggcttgaggcagacacaatcgcccacgtggcctggcaccctcggggggcgtcgggcccgagggtgatgtgttcgcccttctctttgtctccccgaggggtcggaccgctcccgtctcggccccgagggccgaggcgccccgaccccttgtgggttttgtgccgtgtatatggggtaggtgagcatagcggggctcacctaaccacatttattgtggtttggacgagcgcgtcacgccgcatgtatcgcagtgcagcacgctcgtttatccggtcagtgaccagtcatagaccgatcagatcgtgggttaggtggcgacaggcggtctgacgcacgcctcgccccatcccgtcaggatgagagcctccaagcactcgtccctagccggagccggcgtgttagctcttggagatggcacgttggtcccggtcagatatataccaggcttcatcctaaccattacaagcaagacattgtatgaagaggggcgaacatgcagattgataaactgacgcatggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaatagataggataagtccccacaaaaaagagagagatggtgcatgtggtatccccttgaggtataaaaggaggaccttgcccacttagaaggaaaattttttcggatcccagaacgatcgggggctggctcgcactttgtagcttcttcatacacagatccaccaaaacacaggagtagggtattacgcttctcagcggcccgaacctgtatacatcgcccgtgtcttgtgtttccactctcgcgaactttccacagaccaggagcttagaatctcacccagggcccccggccgaaccggcaaaggggggcctgcacggtctcccggtgaggagccccacactctgtcatctggcgcgccaggtagggggttctgcgtgtgttcttctaagctctcgcactctttcgtgtgcgccaagcttttcctgttcagcccaatggctgaacaagcaaaggcgcacaacctctctccgagtgttagcggtgacgacggggagccaaacccacgccgtcgagctcgtactccaccgccccctccacgccaaagtcctaggcgggaggaggcgctcgagagggtcgaaggatccgcgacttcgacatccacgggtgatggaggagggcgccgagatggggagcgtcgcctcctcgtctatggcgacggcagcacgccccagggcgcactccaagctgcgggcgcgctcctacgtcacccgcccgttgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggcggttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggatgcggggatcagccctccgtgcccccggttggtggtgtcggctgtagagcctttgtggcgagccttcgtaacgtccgttggcccccaaggttccggcccaccatcgccgaaaaatatgacgggagcatcaaccccgctgagtttcaccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcactatgaactttcaaggcacatatccgcacccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagcttcttcagctcgcggaccgagtggctcgcaaggaggaggcccagacttggaacccctccggttccggtgtggcagcttcggccgcccccgggtccgccgctcggtcagggcggcgggacaggaggaggaagaagaggtcggcccattccgacgacgagggtcatgtcctcgccgtcgaaggtgtttcgctggccacccgaaaggggaggcctgcgagcgacaaaaagaaggaagccgacgctccctgacctcggctacttggaagagcgaaggtggcgcgcggcccttcgagccgcgcgctaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgacggcacagagctgcctaacccgtggaacatcgaacacattcgtcgcttctacccctagtgggggttgggtgtcaggtcttgggctcgggccaaccccgcacccccccgggcgtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccccgggacgtggtgaactccgggggggaatcggcaaaaacccataatcgggtcacccataaccctcggtcaccacgctcccggcctggccagtctcgacatgtggatctccccaggcactagccttgacccgcgccgtttgaggctgggacctgggtacgagcccttgttcaagccaagacacagaaggaccgtggcacagaccatcctcgtctcatacacagaacaaatgaaattgacacaaaaatttcctctttatttgattgcagattaaatcagcctataacaagaagggggcccgaaggcctcggaagaagaaggaaaagctattaagattggcggaggcctgggggctcactccgacgcgcccgggtagccggcctcgccatcgctgtcgtccgcaccgtcgtcaccgcactcctcgttggagttgaaggcaaacgcgagccgaggggccgctcattattgtcggtcggttttcctttgctgatgcgcgcaatttgcgaccgccgggattctgcccgaagagagagagagagcagggaggagaggcccccgagccaaacggcggcccaaggcccccgacggccggagctggccctccgcctgcttgtccgacggtgccaggcgcccccgacccccaggatggcctgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagtgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttatcccctcggccaaatcttgtataaccgagagggtactggacgggtggtgaaatgggcaatcgaactctctgaattcgatttgcgctttgaaccaagccacgcaatcaagagccaggccctcgccgactttgtggtggagtggaccccagctcccgagctcgtctccgctcccgaggccagctcgagcccatcgcagctgcctcacaccgccctctgggtgatgtagttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgcccttctctttgtctccccgaggggtcggaccgctcccgtctcggccccgagggccgaggcgccccgaccccttgtgggttttgtgccgtgtatatggggtaggtgagcatagcggggctcacctaaccacatttattgcggtttggacgagcgcgtcacgccgcatgtatcgcagtgcagcacgctcgtttatccggtcagtgaccagtcatagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaaga

SEQ ID NO: 79480 - DNA, 11869 bp, Oryza sativa
catggtgacgtgggcgaatctcggacgtccatttctcgatccaacggtagttccaagtttccactacatatgtggtttgtactacatattttccccaaatgagtaggcatcgcccccgttacgcgctcaaatatcggaataattaattatttgtcactcttacgaggggtgataaatgatttgccactggatccacatgtcatatacacatgagggctcacatgttatacacagcgagtggcagataattaattgccacatcttaaaagtgaaaaaaaagttaaatgtccctcaaatatcatactactagtggctatgaccaaaagtggacatacatgatccaacataaagaagtaaaataaacgagagaggtaggtggtttctccatcaaacagtttgccttgccatcataatcccctcgaagggaagatccatttgaacataagggaaggggtgcatcttccagtcgaaggtaagcaaacctctatactgtatgtatgtgtttttctatgtaactgtgtccgatgaaatgtaaacagagttcaattggatatctagactaggtgaactagacaagaatgtcaaagctaataagaaaccggaggcatctgaacatagaagggaagggggatgagtagatacatcttgttgacgatcctggtgcgtccctcagactggagctgggagcgccagtcgccgccggcgggggcgggggcgggggcgctgagatcgatgcccccagcggcggcggggtcggccccctgggtgggcctccagttgccgccgccgccatccatcctcctcttcgtcttcctcttcttcttcttcgattgcaatttgcaagccagcgaagaagcagcaaccgtggagctgatctgtagccgatttggtgagatacccatcgccagagtcaaccatgacacagcgaaattacttagctgccctaccaaccactaggtaccccgcggcggaacgacgttagtaccaacaggcaacaggtaccgatcaatcatttccatccgattaaccttaatcaatggctgagatttgatacctcccctctcaagtactaagcaagttttaatagtatagcccactattaactccaaatcatcatagccaatgtactccctccgttttataatgtaaagcattctaccattgctcacatcatttaacatatatataaatgtgggcaatactagaataactctcgttatgaaacagaggaagtaatagccgatttatacaatagctacttgctataatattaatacctagtctcacctgtcatacacacattacgtcttggatttcatgctacgcctgattacaaatctgtagcccattgttcttctctctcttcctttatctctttaaaatatgtttatagctggcttatagcctgctattgtacctgctctaaggctgcgtttggcagctggagaaagcatgctgatctactaaatagggtgttttttgcaaaaaaaaaattctatatgtaatttgctttagaaaatcttattaatccatttttgaagtttgaaataattaatactcaattaatcttgtactaatggcttacctcgttttgcatatcttctcaatcgtctcttttcccctcatctcaaactcaccctaaaactcctcttcctacgctgagttttctccagctcttccgcgcacatgcttttcaaactgctaaacggtttataaaaattttttatatgaaagttgctttaaaaatcatattaatctattttttatatttattttagctaatacttaattagtcatacactaaacgctgctccgttttacgtgcgaagcagagggttcccaacctcactccctaacacagccctagtcacctagtcagtcccatcgatatgggtcagtggtgatgcgcctatgcatctgaactggcctagatatatttccgtataggaaagtgaatcgatctacggatctcaaaaaacagaaaaatgatactcataattactcattagtatatgtatacattgcttttcgatctatctccccatctcgcagactgtccatctgccaccaccatgaacatggcgccggcctccggttttttggagctcaaactagattattcggcgaccaacgcctacgccgtcggcgacatgctcacctccgacgtcttctcggccggtgggttcacctggagtgtagactattacccgcgtggttacgagaaggagggcaacaatggtgattacttatcgctcttcctaaaacggcggggatgggacgacggacgtctccttcgtcgtcgacggcgagaggttcgccgcccaccgtgccgtgctcgccgcccggtcgccggtcttcagggcggagctgttcggcgtcatgtccgaatccacctcgtcgtgcataacgctgaaagatatcgacgctgcaacgttcagagctctactccggttcatctacaccgacgacttgccggccgcagacgccggcaaactcaatcatcagggctcctcgatgggcgcgttcttccagcatctgctcgccatggctgacaggtacgcgctcgacaggcttaagctcatgtgtggccagaggctgttgcacagcatgacgtcggattcagtcgccggaatcttggcttgcgccgagacatacgattgcccggagctgaagaacaagtgcatcgacttctttgccgtcgaggagaatttcaggagagccgtgttcaccgatggttttgcgatgctggtgcagaaattcccgctcatagctgctgagctgaagaagaggattgtgaaaccgtagctgcatatatatcttttagtcctctatcgcgttcactgcacttgtgttatgttttttttttctaagttatgtctggctttgaacttgtttttttttatcatgtttaattatattgggggtgttatatgtactagctgaatgctcttgcttttcatcagaatttgtccaactacttcatcagctgatcttggggtttgttggaagcttcatgcatttctttggttccaaatataccaccaggcgcctggaatcgaccatattatcaattgggtatttttatcattcttaagatacttagagatgctatatattctagggagacgactccgtgtcggacgtccgatattccaccaaatatcggacgcccgactgtttacgcgtcatcacaccacctacgtatgcaatatgcaaaaaaaaaaaaagaatcagtcagtcaaatgttccaattaactaacgagtgaaatatcaagttatatagggttaaaaaaaatcagcaactgaaacatttaaaaagtttatgaaacatggtgaagatacacgttaaaacatatcgctatcacatatgaaacaaccaatgttaatggattgaaatatatgtttttctttcatcaaaatataattatgcgatatcctgttgtaaagatttaattacaaagaatacaacggtgtgatcggatcgtagattggataattaatttaagagaaaaatcgttttgaaactagctaaaatgcatgcatgtggagagagaggagagacgctgaagacacatattgaaacatgtatctatcacgtatgaaacaaaaagtgttaatggattgaaacatatgattattttttatcggaatataatcatgcgacattttgttgtaaagatttaattacaacgaatacaacggtgtgatcagattatagattagatgagtaatttaagagaaaaatcgttttaaatatcgttaaaggtgcatgttatatggttggaggtagagatataggcttggatatgtgtatgtgtgtcagaggctgcctgtccgatttttgtcattgcttcgaacgttcgatgagaagcattttctattttctagtgtaaaatttgatacctctagatactataataagtttcttaaggtaccaaaaattatagtgcaaaatttaggtatctcaagtattttctaaaggactgcaaaattcatcttatcatgttcatgtgccgggcatgtatccgaatccaataagactacgacacaacaaatcgatcgacacatccaaaaatcgatcgacacgacaaatcgattttcttattatggaaataccgaaataggagtttgtactatccaataagaaaatcgatcgacacatccaaaattagagaaagagatcacaatacatatatataactcatcacatcggcattatacggtatacacattggcgttcgttcgatatctatctatccttctcagtctttctgctgaaatcacacgtacgtctcatctcagcacacgatcgatcgagcatggcgccggcctccggtttcgtggagctcagactggattactcggcgacgaacgcctctgccatcggcgatcccatcaactccgacctcttcaccgccggagggctaacctggagggtgaactgctacccgcgcggcgacaaggcagacaacaatggcgactacatctcgctctacctcgagctgatcagcaagtccaagaacatcaaggccatcttcgacgccttcatggtggatgaacacggcaacccgtccgatggatcgaacaggttagtgcaggtctacccacccgcgggctatcccgcgtggggatggccacgattcgtgaagcgaagcaatttgtcatcggtgttcgtggtggatggcaaggtcaggatcatgtgcgtcgtcgtcgtcctgcgtgacgacgacggagacggcgacggcaaccgtgtgccgctgccgtcgccgggggtcaccggcggccatctcgacggcggcttattgccgctgccgccgccgaacatcggggtccatctcggcggcctgctggacagcgaggatggtgcggatgtcaccttcgtcgtcgtcggcggcggcggcgagaggttcgccgctcaccgtgccgtgctcgccgcccggtcgccggtgttcaggacggagctctttggctgcaagtccgaatccacctcgccgtcgtcgtcgtgcattacgctgcagggaatcgagccggcgatattcagagctctgctccgattcatctacacggacgagttgcctgcagacgccggcaaactccatcagggctcctcgtcgacgaacgtgttcttcaagcacctgctcgccatggccgacaggtacgcgctggacaggctaaagatcatgtgcggacagaggttgctggacaacatgacgccggattcggtcgccgcgatcttggtttgcgccgagatgtacaactgcccggagctgaagaacaagtgcatcgatttctttgccgtcgaggagaatttcaggaaggccgtgttcaccgatggttttgcactgctcatgcagaaattcccggtcattgttgctgagctgaagaagagggttgagaaattgtagctgaaatatttatatatcttgtactagctctctagctaccacgttgactgctcttctgttatgttttttttttctaagttttgcgatctcttgatttgaactcgggtgattttcacatacacctgatgcagacggatcaaagacctgcatgtgaaaatattttttagcggtatgaaaaaaaatccttttttatagtgtatcaaagatgctcatataccaaattttatataaaaaatatgatatctcccggtaattcccaagtagtacaaaatcactcatacattagcttataaaattattagcaactaatagttgtgtgtatcgggaaactgttttaatcacctaggtggatgtccacccgtttattgcatgtcatctaaatggttatgaaaaaaaattaaaataattaataagatagatcaatatgtaatataccacttcataaacatgcaagttaaaattcaacttctataaattgtaacaattaattttgttatttttgttataactagcaaatatgcccgtgtgttgcaccgggtgaatatcaaacaaacatggatgcttaagattgctttgtacttataacacatgtgcacaaaaatattgaatttggaagcgtacatatcagaaaaatatgcaattaattaaatacaaatttattgacatatttggtatttttaagtaggtatgtgtataattaaataaatttacaagtaaagcaaatgtgagaaataaaataacatggttaaatttaattttattaaattctccatgattagttacgctctttagaattttattggaatttttagagcttaattgttaattttaataatacaaacatcatttaacaattatttaattggaaaaagaaagaaaatccttcattttaggtttgattcgaaataaacacattcaataactataattgtaaatgcttctgaatctttttcttcggcccgagggacctaaaatagacttcttttcgtcccttgccggtcggcctatggccttttgcgcatgcgcgggcgctctacccctccccaggccgcaacctaggcttgggccggaaaagtggcctcgctctcgatccctcttgggcccatttcggcccggttgacggcggccgtccgatctctagggttttgatcggacggccgagcgtcgagatcggggaaacaaaaaccccctccctctccttagccatcaaaaaccctagcccatttccttctctcccttctctcgcttcgccgccctcccctccgcgcccctgatgctcccgtgacaaagcggcggcggcggcggcgcctctctccccgagcgactgcggcggcgacgccgcctctccccccgagcccaagcggcggcagcggcgccctccccccgaacggcagcgggggcagcgccctcccccgagcccaagatgcggcggcggcgcccccccccccccccccgagcagtggcggtgccgccctccccctgtgagcggcgacggcggctcccccacaaccggcagcggcgggggctgcggcgcccagggaggcatcgacagcccgccagcgtcccagcggcggcggtggcggctcgacggcgacctcccctttgatccttttttgatatatttgtgtgtgtatattgcttcctccgattttattttatttgtgtgattgattgaattctgattgggaagtttttttgggtcggggtgatggaattccgactaagatttaggagaggcgagggggacaaaaaaatcaccgcacatatgaggtgacgaacgaaaaaataagaatatttatattagttatatatttgtagaagttgaatttgaacatgcatgtttgtagaattgtatattacatattaatttattttatcaaatattttttaaaaaatttataaccatttagttaacatgtttttactctatagtgattagaatccggtgtgtatccgcagtttcgtttcatttgttttttgactatcaatcgcactgacacgcaccaggcgtccaggcgtcgtcgtcttcacattctcgacgctttggaagaggcgttgtatggagacatcatggatcttctcctctccgcggttggaactccaaagcgttactaattactccctccgtaaaaaaaaaagaaagacaaaccttgattttcgtgtccaacgtttgaccgtctgtcttatttaaaaaagatataaaataaattaaaaagacaagtcacgcacaaagcattaatcatgctttatcatctaacaacaataaaaatatgaattattaaaaaaaattatataagacggacagtcaaagttggacatggaaacccagggtttatctttttttgggacggagggagtagaccctgtttagatgggactaaaacttttaatttcctatcacatcggatgtttggaaattaattataaatattaaacgtagactattaataaaactcatccataatcttggactaattcacgagacgaatctattgagcctaattaattcatgattagcctatgtgatgctacaataaacattatctaattatgaattaattaggcttaaaaaaattgtctcgtgaattagctttcatttatgtaattagttttataagtagtctatatttaatattataaattagtgtctaaatacagggactaaagttaagtccctggatccaaacaccacctaatactttgcatcgacctaatactttgcatcgatgcgtatgcatgcattgctgtactataaattctctctttagcagtctttatgtcataatttggctcatagttgattttatttgagcaggccaaattatctaaaataacttgtactatatgtgttaagtggtttgctggaaagacattatctaattatgaattaattaggcttaaaaaaattgtctcgtgaattagctttcatttatgtaattagttttataagtagtctatatttaatattataaattagtgtctaaatacagggactaaagttaagtccctggatccaaacaccacctagtactttgcatcgatgcgtatgcatgcattgctgtactataaattctctctttagcagtctttatgtcataatttggctcatagttgattttatttgagcaggccaaattatctaaaataacttgtactatatgtgttaagtggtttgctggaaagacaaatttatgtgtgtcaggattagttgtgatgcactgggattatatacgtaattgatggaaggccataatggctgacttagcttggagacatatgcttggatcattgaatttcacagcagacaactcggctcctgtactgatcgattgcatgccgaagctgtggatgtgcgtggttgccaggagtggaagatagatatttttggtagtttatttgttaggattttctggtaccttgtttccgtagatttctcgtctgcgccgtagcagtgcatatacccttataatcttatacatatcaggggttttagattcgaggacgaccccgaacattaccgatctgctatttttctcgttcctttacttttccgttattttctattttacttttatgcctgagttatagcaatcctaggatttggttgatctttaccgttttgcgctgaaaaacggttgtgcttctctataaaaatgaggaggttatcctttgctagtttactcggaaactagtcgttcgtcgtcacgtaagtacgatattatcttctttactaatttgctcgtaaattagctgtgtgattccatgaaattgaattaatctcgaaatcggttccgctagccgattttgatctatcgattttggcaactctgttaattataccgtaaatcgttaggtgatcttgtgttggccgtgaaaaagtgtcaaccagcagatcaaataataatactactactactcaggcggtcaggtcccatagacgccagtagcaacatggtgtcctccggtttcatcgagtacaagtttgactaccaacaaatccacaagctagccattggcgagagattgccagcaacaacaatctcgacaggggagcacaatgcgaagatcatgtgctacccgcatgggtttgggtacggcaatggtgaatacatctctctcttcttcgtgatgctgaaacagattgaccccaaaatcaaggtgatctttgaggccttcctgattggaaaagatggtacaccatcctcgttccatgcgaagaggactatgcagtgttgggcgtcccaggatggctacgactggtttgggtggcatcgctttgtgatgcgaagcgatctcgaatcactcgacggtatggtcacattcatatgtgggctcgtagttctgcgcaacgacgacgacggcgacgaccatgtcgccgtgccgccgtccaacctgggcagccagctcgccgccatggtgggcagcgccgtcggcggcgagacgttccacgcgcaccgggccgtgctcgccgcgcgctcgccggtgttcagggcggagctcctcgggtccatggcggaggccaccatgccgtgcgtcacgctgcgtgacatcgagccggcgacgttcagagctctgctacacttcgtgtacacggacgttctgcagatcgaaggctcttcgtcgacgagtacaactgatctgcttcagcgtttgctcgcggcggcggacaggttcgcgctggagaggctgaagctgatgtgcgcccagaagctgtgggagagcgtgtcagtggagacggtgatagcgactctgtgctgcgccgagatgcacagctgcccggagctgaagaacaggtgcatagatctcgtggtgacgaaagacaacttcatggaggtagcggtaaccaaggactactttcatcttgggcagagttttccgtcagttatcgaagagataaagccacggcttaagaagtgaacgttgaaacattatactccctccattccaaattgatctatatataacgtttagcccttttattacgtcgatagatatcataattattatttgaatattgcttattagtcttataagttgcaaaactgcatattaatccgtcgcacctcgtgcatttcttttaataattccgcgtttgtactgtctattcacgtctgagaattggttgtgttggtatttggttggtcatatgggcgtgacgacggcgggcaggtagaagacctccttccccacgccactccttcgatctcgaagtggttagcaccaatctgcaaccggtgggcttgcttgttgcacatgattggtggatgcatcgctctttcttttttttccgtttagatgttatggctgttttgggcaaatgaatgagccgaaatgcaatttgagatgctattttttgagatttgttcttgtctgttttttggggaaaattttcaatctgggtatgacaccgagttggccacggcttatggagacagaaacgcatacgcggtctcaccgatacggatgaaaatagcttcgatttttttttgccctttattttatcaccaatcgaccagagtccggagatgatctgtttacaaatcctaattaaaaatttatctgaatcccctgtcgtttattcctcaccagaccgaacaactcatcgctactttcggtagtataaattgtcctctctctcgtatgatcaaattaattctccttttgggatatccgcacgcaacaaaacatacgccgccggcgaccatgctgtcctccggtttcatcgagtacaaatttgactacctagaagcctcttggatgactgtcatcggcgaatgggtaccagaaagaagaatctcggccggggagcacaatgcgacgattgtgttccacttctactcgcatgcagggtgcaagtacatctctgtcttcctgctgctggatgagaatgagatcgaccccaaaatcagcattatctttgaggttttcttgatggacaaagacgggaaaccttcctcgcaccatgcaaagaggaccatggggccaaacatggagacagcatcgggtctccggttcactgggtggcgtcacttcgtcaagcagagtgatctacagccggatcatgtcagcgacaaaggcacggtcacattcgtgtgtgggttcatggttgtgcgcaacgacgtccacggcaatcctatccccgtgccgccccccaatctgggtgcccaactcggagctatggggggcagcgccgacggctcggacgcgtcgttcgccgttggcggcgagacgttccacgcgcaccgggccgtgctcgccgcgcgctcgccggtgttcagggcgcagctcctcggctccatggccgaggccaccatgccgtgcgtcacgctgcacgacatcgagccggcgacgttcaaagctctgctacacttcgtgtacacggacgttttgccaccattgttaggtacatccgacctgcttgagccgcttctcgcagcggcaaacaggtatgcactggataggct

SEQ ID NO: 79481 - DNA, 16171 bp, Oryza sativa
caagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgcttataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacatagtgacaaagtacatggaagaaaaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttacttactcacacgttcttgctgctgccggtgattgtggcatatctcccaatgtgtacatctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcattagaaatgatatggatgagtcagaagcaggcgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcagacgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagttattgttgtaatcagaaatatttcgtatggtaacacttttgtttgtttgtactcttgtttaatatgtgttagtaattcgcttatgaacatttattacttatgttgaactaattatttatatgtttctgatcaatctatttgatgcaagtatggcgtacgacacaccgacgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccatactctacagtcgggcctagcaaggcttggttgctctagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggcacgctgtggacttccggctggtccactacgcacggtccatcacggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgctgatggtgttcgacattttcgttgagccttactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactacctttgctggtacctttctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcactgcagtccaagtgaggttgaacagaggtttgcacttgactgacgttgagcagagggtgaccttcgaccggatgcaggagaagatgcgtgcggtcatgcgcgtcttctcctgtcgtagcgccgtggacgtcgtacctccagctggtccggtacaaccacggcctcgcgcgcctaccgtcggagcaggacctcgacctacggtacctgtttcgcatggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttatttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgagatcttcggtactggggcctcttcatctcaagccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccatttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctagttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgactgttgttaggtgataaggtctgtaaggcaccgaactcgaggacaaaggtgtttcgtgtgtccaaacattgtcgacaatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgatttgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagtctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatgtttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccctagggcggcaagggggccgcctgcaaaattccaggccccccgccgcccatttgcaggcggccccccgcatagtacaaaatcgccctagcagaggtcggcaagggggccgcctgcaaatttcgttgacggccgtcgcccgagagcgaacggccgtctgccacgtcactttcgccgccctctgggatggcgatttttaaaaatcgccctcccagagggcggtaggcaaccacttctgtcaattttcaaaatgaaaaattatttttgtaaaacttttaataaaaaaaattaaaaataaaaaaaattcgcgtgatcggcagggggtctaatgcgccactaacctcacgattagtaattgtgtaattaatgataaaactgagaaactaattgataatcgtgtacatattttcctttaatctatacggtcatattgtaacaaaagagaaaaaatattctcatactgttatattcacgccgtttcatattataagttgttttgactttttttctagttaagatttgttaaacccgaacaaattcacatgaaaaaaatagtaacacttaaaatattaaattatttttaaaaaatctaatattaaatatattttgataatatatttgttttgtgttaaaaatgttattatgtttttatataaatttggttaaatttaaataaatttgattagaaaaaaatcaaaacgacttataatataaaatggaaggaatacattccaagtcacaacaaaatgggaagaaatgattgacatggaaattgaatgattgccacgaacaagtatcgcaagcactacagattaacagaagccgcagaggcagattagagacggaaacatacattggtaggaagtcacagtactatccacgtttacaatttttttattcctaaactatccttattgaatcaatggtgcgtgttcatccgagagggaggtactggaggtacctctcaagcacagtaaaagcgttttgtgcactctcttcggtgaagacctgatagtaaaattgagtaccaaaaaagagaagagcgtgccactgattcgcagttttgcaggctaataacaacttatcaacatttagaacatctaattgacgctatcaaccgaataaaagggcgaaatgtagaatactcttgccactaaatatctttcaggtctcatctctcaagtctcaagccgttcttttattggtaaattggaaccatgccattataattttgcaaagtttaagatatgtcatcggtatctcaatgatatatagaacccacatgagtcaatgacacgtgggtcaggatggcatatcttaatttttacaaaattataatggcatagctctaatttttccttcttttatctcttcgataactaagggaaaattctgtataagaagaaagtagccgtcggtgaccactaccttcttgaagttgctctccgccatgaagaagtcgaggcacttgctcttcagctccgggcagccgtgcatctcggcgcagcccagcgtcgtcgccaccgtctccactgacacgctctcccacagcttctgggcgcacatcagcttcagcccgtccagcgcgtacctgtccgccgccgcgagcaaacgctgatgatgaagcagatgatcgctcgtgctcgccgtcgtcgacgacgatgagccctcgatgatctgcagaacgtccgtgtacacgaagtgcagcagagctctgaacgtcgtcggctcgatgtcatgcagcgtgacgcacggcatggtggcctccgccgtggagccgaggagctccaccctgaacaccggcgagcgcgcggcgagcacggcccggtgcgcgtggaacgtctcaccgccgacggagaaggacacgtccgagccgtcggcgctgcccaccatggcgccgagctggccgcccaggttagagggcggcacggctatggcaccaccgtcgccgagaattacgagcccacatatgaatgtagccatgccgtcgatcacataaatcgactcgagatcgctccgtgtgatgaagcgatgccatccaatggagcgatgccatccgatgaaacgatgccatccaaggaagcggaagccggaggatgttcccctaattacatctatagagctattctttgcacagagtgaagatggtttaccatctttgttcatcaagaagacctcaaagataacattgatcttggggtcgatctcagtaagcagcaggaagacagcgatgtactcaccattacggccctcacatccacgcgggaataacaaaatcgtcgcattgtgctccccggccgagattcttattccgggcaagcactcgccgatggcaagcttctgggtttcgaggtaatcaagtttgtactcgatgaaactagaggccagcatgcttgctgccgtgtactccatatttgttgtatgggggcactggtggagaaaccctttgtagtcccggttcgtaacccccctttagtcccggtttccaaaccgggagtaccaatccgggactaaagatcgagctgacctttttttttttcatggccctgttgctgcatggtttatatatatatatatatatatatatatatatatataaaccatgcatatatatgtttcaatacatatatatgcatacatatatatatgtatatatatattatattatattatatgtatatacatgcataatatatatgtatttatacatatatatgttatgcgaatgcatatgtatatagatatatatatgaccaaaatatatttacattatagaaaatgtgtacacatgcatatagaaacatatgtagtcatgtattaattacaatccattatatgtcctagctagctacgattttgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcactacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacagaaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctatgttgtatggcaacagtatgaacgtcttgtaatgctgcgccttcaggagatggacgagattgtcctctgtttcttgtggatattggtcgagcattgcgacgtttacttttcgagggtcgatgaatccagtatcgaaaaccctccgccgtcgggccctttgaatctccattctacaatgataaaagggagtatattattttctatagtctacttatatacaaggacctaattaattaaaggaggtgtatagtaagaaatctaactgaacgatatacttacaaaatccagcaactcataatagagacgtcgagggcgtccagctggtatagttcgtagattcccctgaaattgttccagagaatgtcatctccttgcaagaagtccgtgtccctgatcctcgctccgatcatctctctaccggtggcgctcatctccatgtacagctgatggaacttgtacatttatgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcatcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactgggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtagatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcttgtgtttgcatggcgtccatgctctgtgatcctacctgccccgttgaggcgcagctgctatggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctccacatccgactcctgtacgtgtggatgtcctccttgaaaccaatcttccaaggaatcacccctttccctcgtgttcatcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctactcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatccagcacaacctaaccgttgtgacgtacatagttcttggcggcttcggccggggcactaggacgtccatcttcttccacttccgttatgatgtgccgaccctcaagcttcttcgctgcacctcgttgcccgcgtgccctcttttgtccaacggagggttgactaccactagcctcctcctcctggttcccctccacatccttttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatatatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatatatatgctaagtgtttcgtgcgtatatgctaagtctaattaagactacaatagtcaattgctacttgtcgcaccaattccgtagtcaataattacatactaagtctaattacaaataaagtaatattatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaatacgtcttttctgcaagatacaaaaagatgtattaggataaatgcgaagtaacatatatatatatatatatatatatatatatatatatatatatatatatatatatatatatatatatatatatatatatatatgtatatatatatatatatattgcatttcacgttaacgttcgtcctcgttcgttcgctcgttctcattcatgttcgttcgcttgttctcattcacgttcgttccctcgttctcgcttgtcttcgttcgatcgttctcgttctcgctctcgttcgttcgatcgttctcgttctcgttcacgttctcgcggcaacgtacgttgacgtgttcgttctcgctctcgttcgttcgatcgttctcgttctcgttcacgttgtcgcggcaacgtacgttgacgtgttcgttctcgctctcgtttgttcgatcgttctcgttcgttaacggcggtgtggcggcatcggggcggcggttggcgcggcggcgtggcggcggcggcggcggcgtggcgacggcggtggtggcgtggcgttgcggggccgtggcggcggcggcgtggcgtggcgtggcggcggcggcgtggcgttggcatgcggcggcggcgttgcgcagcggcgaaggcggcggcgtggcgcgtcgtcgtcgtggcgtggcgtctcgtggcgggcggcgcgacggagagagatcgagatcggagagatcgagatgcatgaagggagatctggcggcggcggctctcaccccagagatgcggcggcagcggaggaggtggaggcggcggcgaggacgacgagctcgagacgacggcgagatacggcggcatcggcgcggggatttgccctaggcagtggcggcgaaggagagaggccgagagagatcgatcggccgaaaacgtctaagtgttggtgaagaagacgagggcgcaccgggaatatatatacccccggatct

SEQ ID NO: 79482 - DNA, 31414 bp, Oryza sativa
tggcttataccttcctttactggttgccgttctatatccggcacaatggtatgtcctatatgcttcaagtacattctatttcttaatttttcagttgagaatcagtagagtatgatcttattgcttgatgctagttttttataatcaccgttaaccgaatgaagactgatagtatctactgtctagcactctagcaatgggtttaactcaactatctgcgctgcaagtttgttaaccttgcatcctgagccctaactttgctgtcaaactctagaggcttggaattatgttgatgccagaagtttcaagatgctgggttttaggcctgattcaaatttgttggatgattagatagttatgtagcatcatcaatacatcaattgaattcaaaaaacaaaagttctatttatgagaccgtggtttatgttcccctgtttgatttagattagtgagtgaattattattgtgcattatctacttgattatagggataaattaaatattttgagaaataaatttatcaaatagcttaaaacaagtgctctaagcaatgcagtagaataagttttcgtgagaacttactttttgaagcgtgaagcaaataatccgcttcaataatccagtgaataagctgaaaagaacagggtatctagaggatactggatctttgcatgtggaagcaccatttagttgttgattgaaaatactatgcattaccaacctagctttccagctagaggcatgaaagaactaatagaatttgatgcaagtggctaatctagcttattaagcataactatgcccttctatgatgaaatgaaagtttgtcttctatctgtaggattttgtgaatttctggtagcattatttctgttctcgttgtctggagtaagatatctatcattttagagcaaacataagagcatgttctatttactcaacatcctatgtttgattttgcagctgtggcaggtcagttcttatcacacaaggcttcaggaattttgtctgttgttttcgatattggaggagttttgggaggcatttcggctggtttgctctcagacaaaataggtgctcgtgctgtaacatcagctctgttcctttttctttcaatccccgcgcttatcctttaccggacatatggaagcatatccatgcaccacaacattgggctcatgttcctcgccggctactttgtgaatggcccatactcactcatcaccacagctgttgctactgatcttggtactcaggatgcaatcaagggaaactcgagagctttggctacagtgtctgcgataatcgatggcacgggttctgttggggcggctttgggacccttgttaactgggtatatttcaacaagaggatggaacagcgtatttttcatgctgattgtttccatatcacttgccctggtgtttttgatacggctggcaaaagatgagattgttagcaagatcagtgcgaggcattagtctttgtatttttctgatttttgaggactgtagatggttaggaagagttgtagatgatagaaatacgccatttctttgaggactgtcaatctttaatcctggagacctggattatacatcgtcggttatatgcttggcaagcaaacatttgatggaatcatttttgtacaaaatttccccaatattttttgggcgggccaacaattgtccaatatcacggcacacaatcaaaatgttctacaggttcttgatgaatttctgccggaggaaggagaagtgctgacaagtggaacctgcatttttttaatatttacccttgtcacttgcacatggaacccacttctattttaaattctttaagggcattaacaatgtttattacaaaagtaggtagtaaggtgggcctatgtttgatgaattgatggtaatactctctccatctcaatacaagtgtagtagtagattgaagatacaccacaatgtatatatatgtgtaaagtgggtaataaggtggagcccatttaaaaaaaaaacaaacatgagtcatgccacaattaaaaaataggtaggtcccaccacaaaatacttataacttggtagtaagcttatggtttagtcgtagctatttactactttcacaatgtatcttacttagtagtaagaatattttaatgtctaatactcacctttttcactacattgtgaatgtcctaatgactaggctgccgtgtcagtcaatttgacaccaataaaaaccgtttcccaaactattgaaggagtcaatttgcattagtccctttaagtgggggaagaggtttggttaataaccgattttgccattgagtgatgagattcgagcaatggcaagagttgaaggagtcaaaatagacttattcaatattaggcctctacacgatgggccttcacaacgccacccctacgccgacgccgacgccgacgccgatgccgatgctgccctggttgccggcggcggcggcatcgaccgcgacccctccccgtcggcgccaacttcttcaattccttcctcgatggcatcgaaggccaattcctggctgccggcggcgggggccccgcggtgcccctggccggcctcaaccctccccgttggcgccgatttcttcaattccttccacgatggcgtcgacgcagtaagctctgtattccccattaatccgttcacagcaacttcgacctactgatgatgcaaggtcctgcaggttgcccccaagaacgggctggttgagtggatgaccagactttttttttttttatgaaggtggatgaccagactgattgctattccccaatgcgaggttttgggtccaaaagtgagcagtctgcagatgaccaggaccgatccatctccgaggaaactactttgtttttttatattattattattattattattattattattattattattattattattattattattattttctcgtggatttagtcattgctaccatggagcaagcatgccggcagtccacttatccaagactccaagtccaagccccactcgcttgctggaataaagaaatctcaggcttttcttctactaagagataatgtgcgcgggctggctagcttcacggttgacgccgagtcacgaggccgatgctgacaccgatttcttttcatttcaggtaggcagtcattaccgtcgaaatcagcgacctgcttgatgccaccatggggagtgtggaatctgctggtagtggtaattgagtgtgatgcaccgagaccatcagtataaaatcggtgcctgtgggttaaatttcttgagagctagcgtatttgaggattgggaattgtggtggccatgaggaacccctgcatttggtgttgcttggttctgctgaccttggtggtctgcgacagttgtttgcacgaagagaggaaacatcttatggacatttgcgatgcgttcctttggccggctggcaatccgcctgactggagtagcagagattgctgccggtgggagagggtgacctgcagctccatcacagggcgtgtcacggcccttgatcttgatgcagcttatccgtcgtggtatggcctactcaactgcagtatgttccttccattccgtgagctgcagaatttgtccttgggaaatgccggcatcgcgggatgcatgcctggtgcaggtcagcaggtcttccttccttctcctccctcaagctgtttcacatatcgaagaaggcatttaggaacattgatattatatatttaccaagagaaattttacaatccttgagaggtaccacaatttttagtgcaaatttggtacctccgtacctccggtactgagaggtacaaaattttacagtagaaaatacggtatctttcggtaccttctcaacgactttaaaatcactcatttacggatttaccaatcgttgggccgcaagttgtagcaactaagaagtctctgttcagaataacttggatttcaccacaccaaggttgtcttgctagatgtaaacaccttgtccctgtgacccaccgaggaagggatcagggagctccctagggtgtgtgatgcttaggtaaaatggtcaccttggtgtccttttgttggaccttctctaggtaggtgcatacgtatgcacgcagtcggataactcctgttgcattagtctttatttttactaattttcatatttatagtgtttttcatcattcgctgcaggttttgaagtatggtctaatttacgccaactggaaatcctcgatctatctgaaaatgagttgaatgatagtagtatcatgcccttggttggacttgcatctctgcgttccccattcctcggtgggaacgccataaagaatgactttactgtccaaagtaagcatcacacatgcttgtattttcaatattagtttttttcctgacaaaagattttttatttcggaatttatctcttattttggtttatttattgtatgttataggattaagcaaaatgaagctggatattcttgatctaagttggaatggaattttcgggaacatatcaagaggtatggcatctcatttaaagtttttgtgaaagcataaaggtgcaatagtaaatgagtaaatgaccgtgtcatggttccaatattttacaactgtttctacgttgttcaaaataatctcagccacgcttacaaattaatggcatgcagtttgaagttcaaactttgaacaccgatgtgagtgtggtggaaaagtgaataactttacactttacattggggcaccaaatttaagtacatgattattatggtagtaatatatcttgttctccttcaatcgataaaataattcaaatttagtgtgatcacaaagtagatacaccaactccaaaccacagtgtgcttaacttcagtagtttagaaccagaagctcccaagtcccaagggcaaaaacttttaattgctgccttgtgggagtattctttcaaatagtcatgtcaaagaaatcttacttaactctgctctttatgctattttgaaacattagtatgacttcccagttcccaatgattagtatgtacttcctccacctcataatatagcaacgtagtactacgtatgtggacaagccccctgtccagatacgtagtactaggtgatatcccgtctagtactaggttgctatattgtgggacggagtgagtactcgcaaacatagcctagaattaggagcagctatgtgtaggaatcatgtactgacatcacacagttcatttcatttacagctgtttgcaatatgacaagtcttcgagaattgcatctaaacggaaattttttctttggggtgctcccatcatgtatcagaaatctaacttttctcagagtacttgatctgtcaaataatctcttaacggcaaggttccccactatttcgttcgcaaacatgacgttacttgagcaactttccctttcccataaccagcttgaaggtctgctactcctaaactctttttcaaatcatctccaactgaaatacctgagactatcaagcaacagtgccagcttccaagtgcaaactgagaatccagaagcaaatatatctagtcagcttcaggttcttgaactatcaaactgcaacctgaatgccaattctggtgttgtaccaagtttcttatcacaccagcacggattatacctaattgatgtttcgaacaataatctaagtggtcatttcccgacgtggttactggagaataatatatatctatcatacttgagtgtgaaacataactcatttgttggatcactcattcttccttccacagtaaatcagaacttatcatggttagatgcatcttataacaggctaagcggggaccttcctgtggacatcaacatcacattccctaatttgagctacctaaacttatcgaagaatttttttcaaggcatatttccttcagccgttagtcacttggagaatctttcaactttagatttatcttacaacaacatatcgggtgaaataactgctagttttcctacaactatgtcgatgaatcatctagtgctaaacgataataatatctcaggggagattcctactagcatttgcaccaacgtgaatcttggtgtggttgattttagcaataacaagttgactggatccattccaaattgcatagcttcaaatcatctattttttatcctcaatctaagagggaatcatttaactggatcaattccaacaggtctatccagccttttgaatcttcaatttcttgatctgtccaaaaaccatctgtctggccccttgccttctttgcccaatttgacatatctccacttaagtgagaatgaactgaatggaacatttccccttgtctggccattcggtgctaatttgaagacaatggatctgcgatataaccaattcagtggtgcaatcccaagatgtatagatgaaacttttccagagttacgaatactattgcttaagggaaacatgttcgaagggatggttccaaaccaagtgtgtctacttacctagccctgtcttttcacatggacaactttatgtcgcactctcacgtgtaacatcgcctgatggtcttcgtattctaattgagaatagtccaactgagcatgtgaccagcactcacaatgttgtttacaaagaaatatttaacgatctggatcaacaaggaatgcatacatgattacaggtaagtcaagcatacgtgttctacctattggtaatttgttgtgtttggttgccttgcccccaatgtgagtcctaggttcttttttctcagacctactaacttgacctgattatattctttgtgttttgataatgtcaaatttacctatcttcattgtttgcaggattctttatctgaaacctctgccttgtcaaagcagcacgcagttggtattattacaatagttcagttctttcctgtctattttatgtgatcttcacactcaactttcctctaatatatgccttctggtatccatggtttcttcgtaagtttgttttcctctttttatattttgcattctgaccactaaacaagttcaatgtgaaaagaagtttacagcattttacaggttacctatataaatttgaagatccttgcattcctgcattaattgccaaaagaaaaaaaaaatcttccacaccaaatctagattctctcacagctaatgcttttaagtagtctatcatatttgatcacacacctattcctattaatttagtcttggtacaagttcatagtatgctataattcatcaagttttccatccatatatatgtttcataacatgtcttaccacttcatttgtcatctcatcaactgtcacatgatattattttccctgtttcaatgtgattagccacttcaacaactgtatatggatgtttcacacacatacctattttacttaaaaattaatctgttattcactatgctaccagtcttgattatggctgatgctcataatcatactataatgcagctgccatcatacgaagaaccaagcatccagccatctcaatgatcattataaatttcatttttccatcagcaggtgttctgctagaaaatatatcaatgcacctctatgccctattatgtaccttttggcttgcaagagtgttctacgagataaattatttgtctcactcacttgtatgcctgccatgtaaataatataactattttaattgccaactgactaccgtcatcagttctttttgtccgatgaaataacatatcttacatatattatatgctttagtaagtaaacttccagtaatatttttgttgtcatgtgaaatattaaaaatatatgtattcacatttatattaacgacactgcagtttctaatcatatcagctttgacgttggatttatatttcaaaatctacatgaataccttttgtttccgtgcttcactccatgcttataataaccaattttcattatgtcccgcggcaacgcgcgaggcacatactagtgttttatgatcatgttgtggccaacagcttgtgataatgctgggtggttgttttcttgtctgcattttagtgtcagcatatttacagtgataagataaacccattttctcagaatattttgatctggtgtttgttcagagtctgtgcaattcaatctttgcttaaacattacagactggtgatgtcgttttgaactgatgatgtcgttttgactttttacttgtaacgtttgaccattcgtcttatttaaaaaattagtgtaaatataaaaaagataagtcatacttacttttgataataaatcaagttaaaaaaaataaataataattctataatattttaaataatacgaatggtcaaacattacaaacgaaaactgaaaacgacaagtatttaggatggagaagtatttaggatggaggaggtagtactagtatgttgtacaagttagcctatataattaatagcctgggagcccgtacattaacgggccaacaggcaaagatgcaaatagttagggagggacaatgattacttttcagttttcacatacggactgcgcacgttgagatgagatggaagtacttcctctgtccaaacttgtggacttgtcgttctaaaatgtttagcatgtattaaagttagaagaaaaaacccataataccctttcataaatactcctaatgtatagttggatgtaggatggtgattaggggcgatcaggtaatacccctacatcctgttggccggagccgatgttgctttttattcaccataatcacaccagtacaatatgtgaggtagcctatctaactgttgtcgacatggcggtctgaaggtctgacttgtagtcgacaacagggtagccttcctcctcgaactcgcgcccgacggaatcagagacagtgctagatccctacggccggcctctgaaggtaccggatagggtcgatccaggcgtatctctgatgtcgatatccggcggcttgtcttgacgtatgttggcttgtatgttgtcccgtgtattgtgttgattgtctcgtcatggtgggtgttgatcgtgttgatcgtctcatcatggttgtcgttgatcgtgttgatcgtctcatcatggttgtccccctgtcctcctaggggggcttgtatttatacccataggtgtcccattgttcaagtagaactaggaaaaccaatatggatacaatccgagtagtccttgtcgtttccatgtagaactctggttgtctttccttatccggaactccctcaaggtcagtttccgtataagacatggtatgtggtgggtcctgccgagatttagtcaactactattaggtatgtggtattcataaccatgacactctttgataaaggtttcgttaacagctccatcttttcacttatgtgtatgcttatcagtcaaaatttgaattctcaaccttaaatttgaagttgattttagaggggggggtttatcgaagtttatttttcatcatttgcttttagatcactaagaaaatgtatataaagttttatttacaaattttttttcgtttgcaaatatgccgtagtggacataaatttatgtcgacagatatttgccctaattatagttgattttgagccacttgattctctgcgatccgtgcaggagcaacgcagatatgaaccgattctgctggaacactagcaattaaattggaacaacatgtgtggtgatcttgggcatgtggtacaaattaattgatctattcttgcaatgaatgttagtacttgtttctcactgcctaatgcagtgaattcagttgatccgattttcttaacatgaagtgaatggcaacaaacaaattacattgcatatttaatggttacattctaattatattatagttatatctcaattacatcttaattacaatgtaactagcatgtaagtgctaaactaggaaaagagtgggtaaacgacaacttttaaatgatatgcaagttaattgttcaccagttgattatgaattactaccattcatatatcaaatgaaatattgactaatttttccttaaaaatatgccgacatatatacatgtactctcttggtttattgaaaaaacatagaaattttagaggattcaatcctaaaaaaaaatttcctataaagactgttgaaagagaggattgaattatcctatcatttgaaattcctatggaatagacaatcatacagagattttgtagaaaacttagcaagagctctgacctcttgaaacatttcctttaagtctatatctcttatcaaaatcctatatttttcgtaaggcccaatcaaataatctttcttatgtctttgcaattctctgttttatacttctatttatattagaatcatatatttttctatttcttctttttttttcattcgtgtgatttaaaatggcacattagccaccgaacaaaataaacaccctctcgcttggaaaaaaatgaatatgtatgttttttacataaatatacacgcttagaagaaatttgcagaagtataccgtcgtcgcacgacggtgccgcgtcacggtctcgcagggcgaggcgcgagaccgtgactttgtatccgtattagcatgattaatagattaattagcatcattagcaattaattaattattttaattagcattattagtgattaatcaggataatcaactcactaattaatcatttcccaaaatgctgttgctttttgggcatgcccaaatggctgttgctcggtctcgcactgtccacgcgcagtctcgcttcctcagtctacgagaccgtccgcattgttacaccatcgttattttcgcacaatagttcagcaatattgtgttgattttacatttccatacagtgacgacgttgtatttgtgaaaaaaaaaattacatccgcatatttctaaaaaaaagataaatatattttttaaatttaattcctctcgctctcctacggcagcattgtggcattgtcgtcggattcgaggtccacaatggaaggcccaaagcccaaccacgtcagatgtgacgtttctacgcccacgtgcttctcttcctctcaccatcatcataaaaaataaataaatgtctagatggcgtttgacagaaaaatacctcataaattcaaattctacagcctcgtcttttgactcatgcttataaatcaaaaattaaaatctcaaccttaaatttagagttaattttagggttttttcattgtagtttattttccagtctttgcttttagatcactaagaacacgcatataaaagttttatttattaggttataagacgttttaactttggtcatggtcgttcaagtttgactaagtttatagataaatatataatatttataatatcaaattaattttattaaatcaataaataaatatatttttatgataaaattattttgggttgaaaatgttttgtttctacaaagttgaagcagtcaaaacgccttatgatatgaaacggaggtagtaattatttcccatttacaaaatatgccgaaacgatagagtccctagaccgttggattagctttaagattcgtgcagttctaaccctaaccccccattccaggccgccgccgcaatccacctccatcaatccaactaaccaccaccaccgcaaagcttttccctctctcgcccccacaccacaccacacacccacctccatttccctcccatttctttccttctccgcagatattccccaagaatctcctcctcctcctcggattcccctctctctctcctcctacagagtagtagcttgtgcttgctttgctccgattctctctcttccctgtctctcctagctgcaatataccactagcagcagggcgcccagttgcgcgatcgatcgatcgagctccgtggtgccaagaacgccctgtacggcgcgccggtatgtgcgtggaggagtcggagggcgcggagaggctggattttggggagcccgccgccgccgccgccgacgccgggaagagcaagagcaagagccccgacgaactcccctcgcctcgggtgagtagggtactacttggttttctctctcttccgcaacgagagattcgattctttgtcttggggcgtttcttcttcgttaggttcgtttgatttcccttcatggcgtgaaggaaggaaggacgatgatgatgagattgggaaggaaggaaggaaggaaggaagcaaagcatgcccttctgggtgcttgctttgtgcacacgcctcttccgtttcttgaaacacatggagtattattagaagtgattgtgattcttttttcttgtttaattattactgctagctagtactgattgtgcctagactgatcgtgtgtgtggaggagttaagttttctgcatttgttagctgcgaagtttggtggcctggtaggtgttcttcttgccaatgtgtgatgatactactactaatactacgttattggtcacctgttcattgcattgttcattggtactttgattttgtactgaatatatataattatagtcgcagcttccaatctctggcttgttcattgtggagtactaagggggtgtttagatggggctaaaactttttagtccgtgtcacatcgaatgtttgacgctaatttggagtattaaacatagactaataaaaaaactaatttcataaatgaaagctaatctgcgggacgaattttttaagcctaattaatccataattatgaaaagtttactgtagcatcacattgtcaaatcatggtgtaattagactcaaaagattcgtctcgcgaattagtccaaggttatagaataggttttataattagtgtatgtttaatactctaaattagtgtataaacatccgatgtgacagggacttaaaataagtccctgtttcccaaacaggccctaatttcagactgttgtacctaccaaacagggcaaaaacaatcatcacgtgctttagaacaggaaagaggtagtacctgcaaagtgtacatggtactttatttccctctcttgactgaaatgaggaaaaaagagtggttcttgtgcttctctctcacccaagggcacatttttcctgaagtgatccatgtggtttgctaactttgaagtgttcttttttcttcatatcagttgtagaaactgcttggctttaattatctatggctagtgagattgttggatcataagtgttgcggcattaattttttgctatggagagtgctgaagcgtgtagtttttgatgatatatttgttgcatctagcaaacaccaggcagtagcagctatgggatcttttcttatgtgatgttaccccaagtgcttaatcttctgttttgttatctggagttacatttatcggccgttgacactcaatgaataattcattcattactcgttagctagtaaatcatctaataaataaataaaatgttcaattggggtttgaaataacttgtctagccacgtttctaaagaagcattttaaagaatgtaactttgtagcaaagtattgcctcctcttttcattagagttgttgtttcctattaattgctccagctctgaatttccagtacaaattaattgatctagcattaatccttttgtttggacagatggaaagagtttgtgagaacactacagctgctgatttcaagcaaaataagtctggtaattttgtcccaaatattcgatctggggattggtcggatattggaggtcgtcaatacatggaagatacccatgtgtgtattactgacctagctaagaactttggttatcaatcggtggataatgaagctatttccttttatggggtaagcactttcccgctcatttgtatgtttccccgattctgactgaccaaatgagtacctacctttttttgtgcataaacttacagctaaaaagagactagcatgtcatgaatgaaagtagaaacttttgtcagatttgttcagaactagatatatgttcttccagttcagtagtaacatatcaatagcatccagtagaccagtacgctagtccagtagtaacatatttgtgtagtgcgcatagtagaaaataaacatgccatctgcattttttgacccagcttatttgtgtagtgtaacaggagtacaattactaacaaatttgtatgcattcttaaggactatccaaccaatcatatccaaacatcctccatactcacacctacagaacttgatcttattcttcactgtttcaattttaatgaaatcgagatatctcagtaaagttactctactatcacatttttggggctcagtttttatttaatgttcaataagtggctttataatttttcttattcttctgcttctgtattttgataaaactactaatcatagcacgtttatgtgaattaagtctttgctccatttccactatcaggtctttgatgggcatggtggaaaagatgctgcccattttgttcgtgataatttaccaaggatcattgtggaagatgctgattttcctcttgagcttgagaaagtagtaagaagatcctttgttcatgcagataatcagtttgcaaagacaacactgtcttctggcacaacagcacttacagcaatgattttcggaaggtgcttttatgacacattaaactgtggttttcccatctttgaatagtatgcttataagaatcagttatcagtaccatgagacatgaactaaatacctgcgacaatcttggtttccttattgctattcaattttactttgggcttggttagatacttagatctactagcagatgtgttttccaattatgttaagctataagatcatgcctgtttttgaatctttatcacgtgctatagatttcattgctttattaattcctagatataattctaaaagcatgaagtggcaaacatccatatcatgtctttctgtaaactttttgctacgtttttatacctgtcacttgttcgcaaacacttatgatggatactgatatcttcatgtctactgcaggactcttctgattgcaaatgctggagattgtagggcggttctttcacggtgcggcactgcaattgaaatgtcagtggaccacaggccttgcagcctcagcgaaaaactgcgtgtagaatcacttggtggctatgtcgacgatggttacctcaacggtttgttaggagtcactagagcactcggtgactggcatcttgagggcatgaaagaagctggcaatccaggaggtccacttagtgctgaaccagagctaaagatgatcacactgacaaaggacgacgagttcttgataattggcagcgacgggatctgggacgtcttctcaaaccaaaacgtggtggactttgcacggaggcgcctccaagaacacaacgatgtgaagtcctgctgcagggagatcgttgaggaggcaataaagcgaggcgccaccgacaacttaaccgcggtgttggtctccttccacctggaggctcctccccaggtcagagtgagccgacccggtagggtggcgcgcagcatttcggctgaggggctgaacagcttgaggacactcctgagaaaccaatgatggccatcttctttgcattcttgctgcaatttctctagtatgttgcattgccgagtgttaattgtatgtagtgatctcggcacctcattgttgttagatgttaccaccattgttgtgatgacaccagctattattcttgttggtaattaagccaacgaacatgagttctgagctctcaaattgtgagaaattctaagcggctgtaacaagttgagctctgtgaagaaagaagtgagtgcccaagctcacagtgtcatatttttctcctattcttgtctgtaaataaaaatgtcagctactcaactcctgggtaattgaacgttgaccatgtaaaagatacccccattgagtgaaattgccgccaattggctcatcttttccatggttttgtctcatgttttttcagttgtttggtttcttgatacaaaaaacacggagacaaacacaaaagaccaaaataatgccttcaaagtgcaggaatgatgcatgccaaattgcacgggcactgatcattttcgtctgattagtcctaatcttccattaaaaaatcaaagctttctcgtacgccagtattcaacccaattaactaatcaagtttgtacacttttcctggaggaatgcacaagcaaatatacgcaactctgtacattccttcagagacatggatgcaactttctaggagcagatgtatatcacacttgagaccaaatacagtacttgacaaaattcttaattacatttggtacttccaagtgtggcattggcacctaatccagggaccaatggcctaaacatggcccatactttgggcagacatacttctctaaagtgtagcagagataacataaattatgcccaaattttgcatctgtacttcagattacacctccattgcagacatgagtgcagcaatcactagatgggaccatggctttgcttctgaagcaaatgatgtatatatatcatctctgggtcaaagggttgcagcaacctaacttcatagctcctcactgttccatctgagctgaagtgctagtattccagtctctgaacttttctcaggattcttacttacacagaagatcgaaatgaagacctccttgccattggttgctgctgtcctggctctgttcctgatggctgcaacagttcagagcattcggttggatgcagagagtcattcagcattcagcaaacagactgtcaataacgtaagtgttttatcactgtcatttaagttttctgataaagattgatcaatgaatgtatatgttgattccaagttgctaactgatgctcattcttggtttgcagacatctggcgataacgtagtagcagtagtagtagcaaagactgatggtgagccatctggtgaaatggagaaagccatttctgaagagaagagcagagtaggacatgagctgcctgagatccatgtagattactatggtccaaggggccataaccctagacatcactgaacattttttcttcttcttcttcttcttcttcttcttcttcttcttcttcttcttcttcttctatgtttcattctttctttagataatctgtgctcaactagtgagacacacacacttgagaaggcaaccctgctatagcaagatccaaggtgtaatttctaatttcatttatttttcccttcttcatcttcttccccccctgttgaagagggtgagaaacaccattgatgtactaacttcttgacaacatttcaatcaagaaactgaaacttgatgacagcatttcagattttcaatcaagaaaatgcaacttcgtgaatcggtacgcttctaaatgttgtttttttaaaaacaaagtttcaatcaagaaactcacaaaatggatgcagaatgcttagctgtgtgtcagtgtgtgtgtgcctaatccaacatatcatcctcagctttaggtgtcagtctcacgtatggttgagcatctcctgatgtgcagcagttctcttctcctggttttcttatttatgtcatcaaatagtttgacagaagacaaggtcaataatttttctaagctaataatgatggagtagctaatttaatcttttaagtataaaatgtgtaggaaacataccaatactttagcatttacaactagagggcattatctaaaaaaactagagggaatagtcattgcatttgattgctcagcgccattattagtaggaatttgtgattttttctgctgcttctttatgtagtggatgttttttccccttgggagcataggccatgagcccatgaagaaagaattatgttagccaattaagttgcagtccatgtggggcagaagggggtatgacagctgcaacatttttttcttcataatcaaatgtccatgtcatgatggattgctagcgtgtaaaggattttcttatattttagcttcaaaatattgcaagtaaaatgtcttccacttggatcagacaagttcatgtcatgtcattgtattgccttcttttatcatattttattcatgaactatggactgaagtatgggcaagcgaaaattccatgctaactgatcaggacattattgtttactgcaaattcggttgagcaactcgaacatttaaaaaaaacaaaatgaattgttgtttaattgccatatcttccctggcctaatcggagacaatagaatgtaggatggaaatttaaattgataaatgataagtcaacagttgctggatcaatttgtctatatatatatcgatcgtaatcatgtaactattaataaagaaaatgaattcataatcttacgcagattatcttcattaacacgttatagtgatactcctcataaaaagtgattgtgacattgatcctagttataagtaaactagctgagggacattatagtattattaacaataaataaagactaaactgcagttgactcaagctatagatgtgattttggttatggcgcccacagcccaactcgtaggtgaaattttagaccgtttaggttgagctaaagtgaacaaagagcatctttgggtaatgaattgagcataactcggctagtaagattagcccctttgattcataggattggtaaaggatttttataggattcaaattcctatgaattttttcccatatatccttttgattcagaagaaagaaatgaaactttccatatgattgtattcctatgcttcacattacataggaaaactagcaagaggtatgatctctttgtaaacttccctttatttttcccatggcactatcaaataattcttattgtttttcctgtatttttttattcccgtaggatttgagaagcgtactacgtcaatactttgatttgtaggaaaagtgtaggaactttggatgatttcaatcctacgaaagtctttgaaacaaaggattgaatcatatcctatcctttaaaattcatttgagtctatctctctcatccggttcctgtgtttttcctgtggtccaatcaaacggtcattcctgtgtttttcctatattttccaatcctctgttttacacttgcattcctatcagaatcttgtattttttctattcctcctttttttccattcttgcgattaaaaggggccctaagttttaagtttcggacttaagatatgtgttcacatttccttgtgatttaatctcagtagataatacttaaaataatagtacttgcctccaatctctttaacttaaaatgtgccaggacacatccacatggttttgtatgtgtgagcacaagtgtggtgtgtgtggatgtgtcagttccacttgtgctgtgaaaaagagtaatatctctgtcccaaaataattgtaattctagattgtttagtatatattaagatttgagaataaagactattgtgcttctcattaaatagtgtataggtaagtgtgtggtggtggttgaggatagaatagagaggaattcaaatcaaaagtgattaatggaacaattggtactatattgtgacaactattttaggacaaatttgaatattagaaatacaattattatgggacggaccgacggaggtattatttttggattaacccctttccatcactagtttggttttggatatagtttttctttaactgaagttttggatatagtgaatacgtacataggtgagttcctccttgctactaagggcccctttgaatcaaaggatttatgtaggaatttcataagattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatctgattcctgcgtttttcctgcgctccaatcaaacgaccattcctgtgttttgcaatcctctgttttacacttcaattcctgtcagaatcctatgtttttcctattcctccattttttctaccctgcgattcaaaggggccctaattgttagaaataaaatttaggatgccaccatgaaataattggacaaaaaccttccctatatcatgattttctataggtgcggaattaatcacaaaattacttctcaccaaacttgcattgtatctatccaagtacaaccaaagtacaaatatacaagtataaattaatccccaaaacaaaacaaaaaaaatcattaaatacacacaaaatccaaatcgcacatgtacacttgtatagcagcaaaatcccaaaacccaaacgcatgcaatcaaatccaaaaaaaacaaaccaaccaaccacgtcgatcgctcgcagtcgccgccgcgctacggcggcggcgcgacggcgacggcgccgaaccaccgcgagcaggtgtagaccgagcagaaggcctgcagcgtggtgagcagcagcatgaggacggcggcgaggaaggtgagcagctgccacgagccgaacacgtagcgccgcatgaaccgcctcgccttcacccgccaccgcgcgccgtggtaccggttcaccccctccaccgccgcgtccatggccgccaccttcgtcagcctcaccgacctgctcatcccgttccacagcctcgccgcctcgccgtcgctcttcatccggttcagcaccacccctcgccgccgcagcgccgccacgtcctcgccggtgtcgatgatgccgttcatcagctccgtgtaccgggcgagcaccagcggccccgtcgccgccgacgcctcgtaggcgaccaggttgcggagcaccacctccgtcgtgctgccgtcaagcgtcaccacggggaggtgcagcgtcgccgtcttggcgtcgaacgagaccgtggtggcgtcgccgttcgtcggcgcgaactggacgccggcggcggcgagctcggtgactgacgggatcatgatctcctcgatcagcggtggccggctgatcgcgtggtggtggtcctgccccgccgccgtcgacgacgacgacgggtcgccgccgccgccggacatgaagaaggactccactgggtgcttcatcgccgagaagcccgggaccacggtgagcatcttccatggcgccttgacggcgaacgagatcggcttcgccacgtactgcatcggcccgctcttgaggctcgacacgatgccccacaccgcggcgagcagctgcttcacgtactcgcacccggcggattgctgcttctcctcgccgccgccgccgccgccgtccaccggctgctcctcgatgtcgtagccctcgtcgtggccgtcggcggcggcggcggcgtcgtcggatggcttcgggacgagcaggtggtagaggagctcgaggaggtgggcgtgcttggcgacgtcgatggccgggaagttgtccatcatcttgaaggggcagagctccttcatgaggccggtgaccatccgcccgagcagctcgctggcctcctccgccgacgagcactgcggctcgaggagcttgcggaggaggaagagcgggatctggttctcgagcatgagcatgtcgcggaggatgaggttgtgcgccgacttcctcccggcgaagtccaccaggtgcgccatcctcgacgacaccctcctcagctccggcttccctccgccgccgctggcggcggcctccgcggcggcgaagatctgcaagaactcgagcaggaacgcgccgtcgacgaccatcatccacgccagcgtctcgccgctgaagtcgaggtagcggtggtagtgcgccctgaccttgcgctccgcgcgcgcgaactgttcgacgaggtgctcgagcttgacgccctcgcggaggtgcctctgggcgcgccgcgcggcggcgagcttgtatcgctccatctcgtacagctccggccgccaatggtggtacggccccagcgcgatgaactgcggcacgtacgcctccggcttgtgcgcctgcagctgcttgggcacgttgaacacggacaccgggatgccgttgtcgtcgtcgtcgtcgccgccgtcctcctggagggagcgccggatctggatcacccaccggagctcgtcgaacaccagcggcgcgccgtcccggccgccggggtggtggtcggagcccgccattgccgatcagctcgagctctagctagctccctaattccacacgtgcgagttaagctgcagctgcttgttgcttgtcagtctgatccactttggcagtaatatatagtgaaacctatcatgattcatgaatagattaaatggtgtgtaaattcaattaaaaattgaactaataaagtactccctccgttccattttaagtgcagccatgattttccatgcataattgaactaataaggtagagtcgatggcgataagaacgtggaaattaaaaagaaaaggtttagaattgctcaaaaagaaaaggaaaattagtttggttcgcaaagttgaaacttgttctgtcactctgggccatgcatgtctcttcgtttttcgcatgctcaccagccccagagagatgcagattgatcagaaaaatgtttcaaacacggaacaaaattggccaaattcctttactttgcacatgattaacactgaactgtactaagaatcagcattggtagatcaattggtgtgtttagttcatgccaaaattagaagtttagttgaaattggaacgacacaatggaaaagttagaagtttgtgtgtgtaggaaagttttgatgtgatggaaaagttggaagtttgaagaaaaattttggaactaaactcggccgtagcacgtcgtcagtaaaaaccaactgaaattaaccccgaattctgtcatcttctgacgaactctcactctcacattcaagaggagcagcttgcagcaagcaacgctggagtctggatctagccaaggacagtgacagtgtgacactgttgctgaacaaaacggcaaattatgcattgcatccataaaatattcatcagatcacgcatgattactacgagctcccgatcgatccatccatatatggggttgcatgatatgatcagagcatgacattaattcaaacacaagaccagactggaaaggacattgatttggttttttgaatgaatttacagatggattgctgaagaatctgaatatgcccacttgagtgtttctgatcgactgaaacttcttcgcatggctataatacattaagcgtgcagcatgagcgttggcagtgagtagtttgtggcccggttaagcttttgtttatctacatgtgggcgctaaattagctgtttttttggtccaagaaattagggttggatggtcattcgcaatgatcatgccattattcaagtcccttctgatgctgtcatgccacctaacattagcagtgaaatagtacctgtggtcaacactgcaatggagaaagttaacctatatttccctcatcatttaaagataacactgttcatccaaatagttgttaaaaattctaaaaaaattgacaacattcatagcatatacgtaaactacttaaaaaagatcagcaaatgaatagtattgctactattcatgtctgaatttgtccttttcatttctcatatggaaatggattaaactcataaactggatttattttccatttttcaccccttcgagggactagaggtttttcttttacaaatataaactttgaacgaaaatgcccccctacccaaatgttccatccatttggccggcccatcagcccatcatccacacgagtcttcttcacttccagccctcccacgaaataagttctctttaggtccctcgtcttaacctcgaatttgaatttcatctttaaactgcaataccaaatatagcatgtctctcaacttacaataacgatgtacccgaggtcataggctggctaacatgctggctaaatcatcgtgggccccacatgttagcatcatcctcctctcccctctctctcccctcctagctttcttttcctctttccccctctcctctcttctcagcctcctgggcggcgggccaatgggatacagggagagaggtgcactagtcgcggtgcatggggctcaactcgaggccaccgccacgattgggcatctccaccccatctatgttgtcctcgtcggcaggcgcgagggggagtgaaggtagtgacgctgctatcggtgtcgaacagcggggagaaggggctcactccccggaacgtgccaagatgctagaactcccaaaaactgagcgtcggtgtcaccagcgggaactcctccatcggatctagattgctaatggtaataaccttcgtcctgctcatctctcatcccagcaagccatcccgctccttgtcacgccgcggcggcagcttttgatgcatgaccagacaagcaccaccaatctcaaaacctcgcataccaatccgccgaagaggtggtgggacgggcccaacacagcgttgtcgtgggatgaagtaggaggtgacggggcgagcccggcgttgcattgtcttgggatagagtagaaggtggcgaggtaggcccaaggcggcactttcgcgagacggagaggtgcctggggtaggagaggtcgagccttggcgatgttgggctactggcgcggaggatgggttgtcatgtcagggaggaggcggagagggagtaggatccgggctatgcccggcacggcggtgggacggagaatgaagaagaaagttgggagatgagagagagaagaggaggaagttgacatgtgaggtcatgatgacttaggctctgttcgtttcctggagttcccaactcccccatctcattttccgtgcgcacgtttttcaaactgctaaacggtgtgttttttgcaaaaagtttatatacgaaagttgcttaaaaaattatattgatccatttttgaaaaaaaaatagcaaataattaattaatcacgtgctaatggactgcttcgttttccgtaccggagggatgggttcccaactcaaccaaaagaacagagccttagccgtcacatcagccaaaaccaatgactatattgtctataaccacgagtacaccgatggtgtagatcgagggacgtgttatacctgatactagatgaataccccgccgcgttgctgcggaaaattaagttgcataatatgtacaaataagatataatatgattatcaaaactaaaacaaattgatagtacaattttgagtctaaaaataattgagattgcatggttttatgagagaataaagaagtgacaatttgaaccatagatctatcatttaaaggctagaaataattagggtgatgtggcttaatgagagaagagagaaatagcattaactacacttagtggcgatgaactatataagggcaagttttatagtggaggtgagtgccacatctaatttaaaccatgttatcttctcattaattaagaggtaacaagtacaacatgtcacctctagtacacaaaccccaatattagtttactcccacatcatcttatatttttattggagattgtgtgggagattgccacttgcatgaggggtggctcattctcatcttatatttttattggagattgtatggatgttgcctcttgtatgaggggtggctcattctttctctcctaacttctctcctccaactcatcacctaatcttatgtggtaaatttagaggcaacatgaaggggcttatagtactttccctaagtactactccctccgttttacaatgtaagtcattctagcatttctcatatttatattgatgctaatgaatctagatatatatagtatcaatatgaatgtgtaaaatgctagaatgacttgaagtatataggataacggttcaattcaaagacgagattcatattcgacgttaaggatgagggacctaatcggagtttattccccctcctcctcctcctctgttccttccggcccagcccaccgcgtcgcgcctgtcccagtggagaatccatcgcttttccgcttttcccgcaccaaatccaggtactaccctcctccctctgttccatattaattgacgttttgaataaagttgagatcaaacttttataactttgaccattaataactttaaaaatatttagttttttaaagcattataataaaaataaacatgcatttatttattatatatattataataaaaaaataagatcaaagatatatcttgtactccttccttccctaaatgtttgacaccgttgactttttaaaatatatttgaccgttcgtcttattcaaaattttttgtgaaatgtgtaaaactatatgtatacataaaagtatatttaacaataaatcaaatgatagaaaaagaattaataattacttaaattttttaaataagacgaacggtcaaatattttttaaaaaatatatcgtatcattgtccaaaatgttaattaaaatgaaaccggagggattactggtctactactccaaccccgtggccaccgtggccgccccggcacagtccccgtccgtcggacaggtcccaatccgctctccctttttaacacctcatcccccaacccaacctgctctcgctcccaccacgcttcgctgctgctgatcaaaccccgcttctcgatccgaccagggaaggaggaggggaggatgaggggggcggtggcggtgaaggcggggagcaggccgccgtgggtggggctaggggcggcggtgtgggtgcaggtggcgggcggagccagctccaccttcgcgctctactcccacgccctcaaggtcgcgctcgccgccgaccagcgccgcctcgcgctgctcggggtcgcctgcgacgtcagggagaacctcggcctcctcccgggcgtcctatgcaaccgcctccaccccgccctgctgctgctcgtctgcaccgccgcatgcctcctcaactacggctccacctggctcgccgtctccgcctccggccccgcgctcccatagtggctggtcatctctctctacccttctctttgctctgtaatttccttttttttttttaccttttttcttttcttggatctgttgttgctaggtgtccacttctgagatcgattcgcactgtattttttttcttgtaattttagttttagaaaattgcatttggatgcgcattagtggtgcattttcgttaggttgtgaaattggagtcgaattgctctagtgtattggtagtgcgcttcttttacgccaagtggccacttttgggcggtgcaagtaacgactttttgagttagatatagcaaggaacctgttcccgggaacaaaaggagtcattttcaaagatcccagcaacaaaaagtaaactacaaaataagaattgttgtaccaaacactaactagcgaacaagtatgggtcacattcacatttgggttggaaaaaaatgcgacatttggcttcacacgccagcaagatgcacatattggggatttttactggaagcttgttctggggcaggtttctggggttagcttactttgctaggctgctagcttcttctgatggtgagacgccgagatttaatttcgtaggacagcttaaactgactagtgaccgtactgttgtatttcagatatggtttgccttatgccttgctgcaaacagtggtgcatggttggggaccgctgttttggtaaccaatatgaggaatttcccactcagtagaggtgccgtcgctggcatccttaaagggtacgctggtttaagtgctgctgtgtacactgtaatatacaccggagtacttcatgattcagcttcaaactttctgctttttgtcaccctgggagttcctgttgtgtgccttgtgacaatgtacttcgtgcggccttgtgaaccctcccttgtggagaactcttcggagcaagtgcattttctgttcacacaactctccagtgttcttctaggggtttatcttgttgcagccacgatattggaccatttcgtaactcttactgatgctgtgaactatgttctgcttgtcatcatggtccttgtcctctttgttccacttacagtacccttgaaaatgacattgtttccaagcaaccgaagaaaagggcaatccgattcatcagagtgctcttcttcttctgctgatcatgatcatacagaatcattacttccttcttcatcagcatcaaatcttggtaatatagaagatgatgattccatggatattgatattctcttagctgagggagaaggggctataaagcagaagagaagaagaccaaaaaggggagaggactttagatttcgtgaagcactgctgaaggctgatttctggcttttatttgcagtgtattttattggggttggatctggagtcactgttcttaataatctagcacaagttggaattgcagcaggtgttgcggatacaaccatatcactcgccctcttcagtttcggcaatttctttggccgtttaggaggtggtgctgtttctgagtatcttgtcaggtaatggaatttcttgtcctgcataattgtgtttgttttgaaatgagaatttcaataggatagtttcatcaactagtctccaagtactagttagtcatcctgtcaagtttcttggagattgtggctactgtttaggacctggtagctagccaacccatagattttacttttaggggagcaagcatgttatactctaccattgttcattggtcatctatttcctgatctaaccatcaagcccccaatccagttttaatttttcagtaattagataatgaaccgaccgtaatttctctccttttttaatagaagaaacagtaggtatggtccccattaccattgtataaatgctgtatcaaaatattttcttttgggttcatcactgaagtgcttgtttttaagttctaaattttctaaatgaccattctgagttagttcactgatcttctttcgcaggtcaaggacccttccacggacaacattgattacatgcacccaagtcatgatgataattatatacctgctctttgcattgggccaccatgccacacttcatgtctctgttgctttacttggtatttgttatggtgcccagttctcagtgatggtgtcaacttcatctgagttgtttggattgaagcacttcggaaagattttcaatttcatctccttggggaacccacttggcgcactcttgtttaacagtctcgcggggtatgtttacgaccaggaagtggagagacagcatgccacaacaatggacactgacattgcatgccatggccctaattgtttcagacttacattttgcgttctagctggagtggctagcttgggtacattgctgagcattgttttgacagtgagaatccgaccagtatatcagatgctctatgctggtggatccttcagccagccgaggagctctgctcactgagaaaggcttttccggaattcacattgatgtagcatgagatcgagatcttgtttgatgatattcttggatccactgtattcagttatgagtattggtgctctacactgttatttcagctatgaggttcaggaatgagagaggtgctttttgttgagtttgtaatgcgatgctggtgctgctagtattaggctgatgagctaaagcaagaaaacgagaatgtaataacagaaattgctgcttttgtataatagaaatttatgattatacttaggcacacaagctgtgtgatattcaggtgttctcatgttctgataaagaaaatatttcatgcattgagcatctcaacagactaacctattggccatttcttcagaggtatggttactgaagctagctagctacttgtccattttgacattgtcccagcactgaacgtggcatcaaacgaggtaactacaacctcctgtaccttaatctccataatttatctgcctctcagttctgaactgtgaacactgaacccaaaccatgtgcccatgtggccaatttaccaattactaccaccaatcaaatgcatgtcggcatgtcactatctgactctgctgtaatttgtaataacaaatttctgtttactttgtgtggatcaagattccatgacatggcaggcagcaagaatcctcctgaagcctcatcagcaggctgaattttcaacaggcagatggcagttcagatttgagcagcgccaaggttggccagctacactgcactgaaagccgacagatctaaaccctgcacaaaaacgtcctctcctgcctttttgaatggccgaagaggctgttattcctaccactcacaacaatgtcacactagcagttcggatctggaaaaaaaaaacaactttggcatatgctactatcaccctagcttgtttcgtttctgatctgaattgtgaaactgtcagcatgtgctacgactgccaaggccctcaaaagtaagctttgtccttagtatctagctgcacttaattgtttgagatactaaattttatacggtatttattagttctgaactcatgtcatatcatggcacatgcacaaaacaataatacagtgaacagtgatgtgtgcatggctatacgtataatccgaacctgaaaatgaagatgcactgctgaaaaagacatggtttgattggttgtcgctgggcctgaatgtaccaaacaatgcatgaaccaaacaagacgaagaagaaaatgttaccagaatcaattataatttccagctccacagacaaagaaagaacatggtaaaaacggttacaaaacacacataaaagcttcatcttctctcgatctctacacatgtacagttacaaaatacagagcatacaaacagtaagtagtggagtagtgacagtgagccagtgaccacagtggatgtggatttacatgtacgcaccttgtcttcttcttcttcctccggacacagatcgatcgagcagccattgttgcatgcttggagctcgccatgaatggacgacactacgcatgcagctaagctagctctgtttatgtgggcttgagatcttggaacatggactcccatcgcatgtcctcgccgtcgtcgtatagatcgaattcgtcgtcgctgtagctgtaggcgtcggggtttgcggcgaagcagccggttatcgccgccgccgccgccgacgcggcggcgggggcggcggccttgtaggtcgtcgccgcgccgtttgtcgtcctcgtcctcttcccgccgccgccgccgccgctggagtggttggtgagcatgggcttgctgaggtgcctcagcagcgccatcttcctgccgccgttcc

SEQ ID NO: 79483 - DNA, 11032 bp, Oryza sativa
cgagctcggtaccccgcgctggaggagcgggcgcggcggcacggcgcggagtacaagataccggacggcgacctccgggagcagatcaaggcggcggcggcgaaggcggtgcgcggcgcctacgccgggttcctcagggcgaacgacagcgcggtggcttccggcggcggccggcgggagttcctgccggtggacgccattgaggggatggtgcggcgggtgttcgacgaaatgggcgacggcggcggcgtcgccggcagcgctggccggacgaggagccgacggcagagtggcaatcttgaggggtttgagggctaattgaacccacagtggcgcatttggcgccaatatatcttttaaattttgatggcgttttcatttaagtgtggattagaatacgttcgtcaatttgttctctttgtggattatggttaagaataagaatgcattttattcacaaatatgatcaaccaggtaaatcccaagatttaaacgtgataattaaatttcatgatatcagtttgccaaggcagcatactgagtttctaaccattgataattaaattatgagtgaaatgcactttatgccatattttgttgttaaatttttattttagatcaccctttattcaacctttttactttgaactactccctttatttttattttaggttataagatgttttgactttcgtcaaagtcaaactgttttatccccgcaaaaaaaagtcaaactattttaaatttggccagtttatagacaaatatagtaatatttatattataaaattatttttattaaattgataattaaatatatttttataataaatttatcttgaattaaaaatattactattttttctataagcctaattaaacttgaaacagtttgactttaaccaaagtcaaaacatcttatattgaaatggaatacttttgctatacaatggatcacctcaaatcatatcacaacaacctcgaacacatcaataacaactgccggcgaacttcaccatttatacacatgccgtacctttgccaaaaagacattacgtatggcaagtgaagaattaagaatcttaggatggcccattgtgcaacaaaaatgaaaagattagacataagatgataactttggcaataaaatatggcccaaagtacagttcgttcttgaattatataccttttcttcatagcggatgaacagcttctgcctataaatctagcaaatatatgcatcacaatatcacatgattggacacatcaaattggcgcacagctgcgattcaagccactaagcaagcgattacattaccaagcagtcgataatttatcgcatacaagccactaaatcttcttttgcaaacagctacccaactattacagtaccattattgattctataaataagcaaacccctaacatagatacactgatgcacaccactaaactgtatctagcacctaggctaccacctaatgagagtcacttatgtacaatctgaaggagacaagagttttgttagcccttctggaagcactggaggttgttcatcttgagggctccaggcatacacctccagtgaagaaatatgctaatttttcaagaatctgactcggtgtctcctgaaagtatcaaagcataaatagagtcacttgaatgttgcacttgaaggttgaagaaaaccaaagagaggatgcagttagaagtaaaaagtagaagaggatgatcaccttcaccacaaagttgctcaactcggctcacaatatgcttgccataggtgtacttccttaatgcttgcagatggcccttcacacggctgagcaggagctctctctgttgctcgttgcatgtttcaagtatcttctgaactacatagtttgcatactggtccttcatcatcgcctaaatgtgtaaaaggttgttagcaaatcaattcgtacgaaaaccgcaggaaagaatattgtggaatctaagagatgctatattagatatagtgaatagtatatcggtttttatctaattttttcgtggatgctaaaaacacgggatgctactgcatactggttatcccgctaattcaggctttgctccctgtgcctgagagagggagggagagaactgaatgaaaatatttgatttacagtatcaacttctcaaacataccagcaagttatcattgccctcagtctgcttcacaatctcccggatcagaagatctcgctctgtcatatccccatgttgaaagcacttctctatcacatttgatgcgaatttgttttgactcatggtaacaacctgcccagccaatttactgataatttgggtcctttcatgtccccttcctctttccaaaacatgctacaaaagagaaaggaaaaacaacgagctgacaagtaagaatacaagatgacataaaattgagttcagtcacttcattatagcatcattcactaaaaatatgcatgtagatttcagtgctaactgccaacaaatgagccaacacacttcataacatgcaatgcattctacgtctgttacacacagtctgatcatttactagtcaagaaactgtttgaaattatcatatttcagcaaggcaggattgactgattgacagggtattattccgcagttgtgatgggtactgccaaggaaataggaatttgggcagcaagtattgcatcagcttgtagacaaatttacctgtgtaacatagttgccatactgatcttgtgcgaggacgcaagccgactccagtatctcatctattatgcactggccttgtgaatcaccaccgcagtgctccaaaactctctaccaagtaggataaagattaatgagaaagctggccaccaagctctagcacagaacacatctcaaatattattctgaaattacctgaataacacggcaaccatatgggtgcattgaaaggctggccacctgcccccgaaaagcagatactacaaagccaatatgttctgtaggaacacattcaatgcacttctgtataacatggttcccattttgatcacggacacatcgcataatgtttccatcaagctcacgaactagttctattttttggtcaagttccataacttcaagagcctacatgttttaaaatacaagttaggtaaatatagtactggtaacagatcatagatggtactaagctgcatctcgtattctcgtcgcagtgttgcatgtatgtgcatccatgtcatgccaatgaacattcgccaggtccacacaatacttgcaggaggacataaaatagctatttctaggcatacaaaagtagtttattttgaattccccaggcaaaatttccccaaaatactgtaatgattgcatacacagatatagaacatggatacccttatgtatctcgtgtacaaccgagtacttctaatctcgtgtaccacttgtttctcgtgtacaactgagtacttctactctcttaaagacatttcttaatttctaaaatattttagttctcttcaaagttctcaagttcaaaaggctgaggacctatggaacattcagtagagctagatggttaatgtaaggttgatagtaacctttaatactctgcatataatcgatgttaaaaaaaatctaaataagctacatcagaacttcaaatcaataggcaatagccaataagtaatacacctttcaagatcagaagtatagctagcaaaggcacacagtcatagacaacctgaaaccatctatcgctaacccatgtattctatggtattgtccaaccagttatttaagtttaaagttttccacagataaacccaaaaatctgctataaaaaaaagaaccgcatacccacagtccaatatttttatagttgccatcaaagtattcaaaagcattcttgattttaggaaagataaaataagaaaaaggtaaagattaccttttgaattactcggcatccatacatttgaaggctcaaaggtaaaacatgaccaacaagcttagtggcaagatccctcctttgttcaggagttccatgttcgaagaactgcagatattatatgtcatttcttcagatatgataaaactcagagttgttattggtcacaaagcatagttatgtaagatgaagtgactagaccacaacatgcaacacatgatttttaccacagacaataggcattgacatattaactcttacagcagcataccttttggatcacataattcccaaacacatcagtcattaatgatgaagcatgagggagaacttctgaaaacacagatgccttctcttcagcagtgcagttctctaacttctgttggatgaatcggctgccatgttggtcagcgctgaggtaaaaaatacatcaggaattaatgaccaaaagttgtatatgagtagacatgtctaagacagaacaactaaaaggaacacctcgagactaacctgtattctactatatggcctgcaatatcagatagttcaaccctgcgagccctgttagacttgagttcttccaggaaggaacatgcctttgggtcatcgaatttctccctttctcgctgcccttgaacaccagaataagcggtcatatttcttgagggagtttggaatctcacagaatcatttctcctaccaggagaaaatactccagtgaaagtctgtccctgaaacactgggcttgttgggtaagtcattggtgctccaacatatggtgtcatgccttgataatttggagcggcccctcctcttctggctgcaggagagttataaattccagttcttggaagttgaagcctctgatcagatggatacgcaggctgggataataccttttggggatcaaaactatcagcaggattcccaacaacactaacccttggtcccattgtattgtattgatttataccagcatatgaaagtaaagaaggatgctgaaagaactgaaagaagtttgggtcaggaacggatggctgcatggtaaccccaagttgttgtccatacattttatatggctgaacaaattctgctcctgcactaagattccctggtgaaggaaaaccagatggtctaccactaaagcttggagtaatagggctgtcaacaggtgtagcaacagaaacctggggagcatagctagtcataacaggtggtaaagctgaaccactcaaagcatatccagcagttccaaatggtgttggcaatacactagccggatgcaaattttgatagtaagggcttccaaaagaatttggtgcataaaaaggtgttgtcataccaggcggtggtaaaaattgctgcatgtcaccagttggtaattttaattgagtatgcgacaagttctcaacaaaaggaacatggggaagatgtgttccttgaggaatcatttgaataggatcaccctggactaaaggtgaggggccaaactgctgcaagacattgtccggccactgctgcttaacatgtatggtatcatggctatccaaacttatcctcagattcttcatattggagttcacagtatctagttcagtcagaatagaaccgctgccaggcacatcattcccatgcttgatgtctatgctaggcttctcttgctgagaagtttgcatactggggttgttatcaggacttgatgaactgggaacagatgtagatgaaatactgttgctatgtgtacttctcactgtgttagtcacaggaacaggtgtccatgaattcaacccagatgtcttgacagcatcaattgaaaaattcgttgatgagttaatgtcagaatggtcagatataccatcaccagtattgctatttgatggatgagtagaactgtcatacaaagaagcggctttctgctgaaaactctcctaaaaagatataaaacagatgatgagaatatcaactataatatgcatgaaaataaatcaaagcaatacttcaaacttcatttgcaagtgaagacaggaaagaaatcaataattcattatcaaaagaaacaaccaaatacgatttggtcaaatcccaagctcaacaatttatcatgccattgtacactagtgactttggtagggtgcatatgagaatgactatggattttaataaaatacctccttttatttattttacagtttcatagattaactaattaaacattatgaccttagagatataacagaaaagtagagttgtccatgacatgaaatattcaaccaccaacgatgttctaatacagattagcacaattggtagcatcctgtaacacataacagagttattatactatagatggtaaataactaaagacactacagaactccactccgcaaagaaggaatgccaaattgaactttgatcagttataaggaatcttgacaagctcttgaactatagcaaaatagcaaaggaaattccaaggtttaagtagggctggttaggctagtgactttcagaaaagcaaaatagctgatgaaaatgtcataattatttgctgcctgctgcaaaatttgctgtgagttaacaacttaacactaactggtttggacactccaaacccatgcaacatgtggcagatataaaacactgtatggcagcttagaaatagaacactgcaaacatcttcaacactttttgtatggtatgtacaataatagcagagaaattcatgatcatttttgaactagaagattgaggcaattaactgtagatttacgataattatatagatgtaagtgatttggcaatttggatattgtactttactactgatagtttgactgtcacatcgcctttctcttgttctcaaatactagctaaatacccctgtgttgcaataggatttacaataaagcccaaaaggcaaaataaaagtattcccactctaatcatcatatcatacttggtacaattttgtacatgtatgtgagctacacagttgctcgtagcgaggaacaattgatataaattatccatattgtatttgattcatatagtgaacattggccactaccaatattcaaagtagtatatagatatgcactaagattagagtgatcagttccccataaaatgggaaaccttaatattttctcaccaaaatagtgtcatatcatcctcgaactcaagttgaaagactgggtgacattggtagtggttcattagcaattttggaagatactttgtgaaatcaaaacataggacgataaaatacataaatatttttatgtgagacatcaggggagcaggagaggtttggatcatgaggagcactcaccgatgcaaaatctccaagattcatacaagtataatggctatcaaagttggatccacttttaccagaaccttgggcatcctctgctgaacttgaatccaaccttggtgacctatcgtcctcaggctcttctctgtgtgttgacagagtagatcgaggaataaacaaggaacctttgttgctgtcatcttgagaaaccactctccattctttaactttgccaacccggttcatgaagcgtctgctctccctagacataagtggtggcggaagccttgggttcaaattgaccttggagccataatagtcacagtatgccggatcagcacgtagctgctcctcagatttggaactgtccgctacgtttcccagcttcccccctaaagtggcttccaagttcccactctgctgacctatcatatgaccaagagcagcaagagacccttccatgctaggcggcgcacttccactgcgatttgggacagactccctccagcccccataaacgccactgttattgtccacaaaccccagaccttctcctgaaagactacccagtgatgagtcaaatgcaccgaagtccttgctccagttaccagaccccgttcctccaattaaccggacagcgctctctgtagccatcacactgcaaagagaaactgaatattcagtgttcatccatcgaatacatttgcaatttccattccccactttgctactttccaagtctggctattcagaatttactaggttcgataatgcattaggtaacaatattagattggtgcaagcaaacaagttcccaattatacttcttgaatagggtaaagaaacaactgtggataaataaaaacattaagctacacaacctcaggacctcccaaaaggatacaaatgaggcagtaaggaaaacttgtgatttggtggaactggctaatcgtaaaaatgaagatttttagtagcacaataaaaggttatacataatactaataggctacatgttgcagtccaccagccacaggcgaacgtaacgtgtggaatgagggggttaagctgaacccctagccaacccaaaaaaaaaaaagaaaggaagaaaaaaaaaaggaaacttgcaccgaagtcgttgctcctcagaaaggggattgggacgaaaccggatggggtaaacggagcagtaataaaaatcaatccaagaaggaatttttatccattatatctccaatctacaccgcgccggctcacgaggtggcgcggaggagaagggctagggcttggagagaggaacaaataccttcagcccgattccacccggccgcctcctggctatctcctccgaacctgctcgccggccgacgaggccacaccccaccccaccccaggaggagcagcagcctagagccagaccgtggatgttcgccgccgccggagggggagctcggagcagcagggtgaggcccgtggtctccggcggaggaggaggaggagagagagagagagagaaagagagagagagagagagagagaggcaagggtttggagaagcaaaagcgaaagaggaggaaaagagaagaggagaagagcagaggcgaggggtggcggcgccgctcgagtcgagtcgacttgagacttgagacttgagaggtgagctgcggtggtgtggtggcgtgcagtgcgagtgctacgctctctgctaggctaatcttctggggttttactggagtaatagctcggaagtatattctctctttttttttagtttatttaaattgaaatgagtaaataaattatatctaataaagttgtacttatctatcgtaatccctccgacgtaaggtagaggagctgcgtccgaggggagaggggtggtggcgtcgcttgagtcaagtcgagttgagcgaagccctcgctacagctggtgctggtgtcgtgtactggggtttcacaccttttatttgtagttcataagtacattcttattttttttctttatttacatcaaaatatgtaaataaataggtataattaagttgtacttatctgttttttcaagaatatcaaatgataaaactttaactatatttataaacagttggttctaataatttcgtttggctaactggttttcttttttaatttatgttacaaataataatatcattatgggctgcaatatataacaattgggggaatcatgaaggttggataacatgctttatctaactataattatattggtcaggtcaattttaaaaaacagttgctttttaaccaaggtaaaactgagagccaccgcctaacgatatggacggttgccccaatctcatcggcgaatagtaataattttttggtgttattgtaggaattggaaattgatttttttcaaacaaataaagttatactcgatatagagatatttgttcgtgttcttaaaaaaaataggtagttgttctcattttctttgtgtagtttccgtggttctgttagtaaatcgtctctcctaagcgatgatgttatttaaactgtgttgaccttgtcttgtgttgctgtagttagacgtatacgttttggaagatacgtgaagggaaggtactctactccttttgcatggaaactgcttgactcgttctcaaactgtactgtagacaatcttacgatgtttccacttaaatgttatgaaatgcattcggcagtttcttcattaccacatgttgtcatatttgagtacgtaaatactcgctccgtttcaaaatatttaacgccgttgactttttagcacatgtttgaccgttcgtcttattaaaaaaattaagtaattattaattcttttcctatcattttgattcattgttaaatatatttttatgtaggcatataattttacatatttcacaaaagtttttgaataagacgaacggttaaacatgtgctaaaaagtcaatggtgtcaaatattttgaaacggagggagtaattcacgccttccaatcaatttaagttatatacgaggagtactgaagcaagtctaattataaaacggtgcaaattaatcaacaaagccaacgaagccaccggttatgctgaataaatcaatacatcatccatatagcaccgtgtattgtgatggcactactaatgacattatttgagatagttaaaattgatgagtactttttccgtttcacaatataagagtttctagcattgctcatattcatctagatgttaatgaatctagatatatgtatgtgtttagattcattaacatctaaatatatataggtaatgttagaaagtcttgcattatgaaacagagagaataatcagcttttttttatgatacaatagctatttaagggtatagcaaatgaattaattagttaaaaaagttattctaagatttttttttttaaaaaaacacaccgttcaaaatatcggaaaacatgcaaaccaacatcccaaatctgaaatcagaaaaagaaataaaaagagcctaggtacatgtgatttatgatgtagcatactttgtccatctaaaaaaactcaatttaaacgagaatgtgatatctcccacgtctagatttttataataggaggaatcaacagcctcttcttggttgagtttattttttatttttaggggggagtaggtcttttggcaagaggtgaaggaaacaattagtagtgcagtagcttgctggattaaatcaactaattgatactgctacagtttctgccagatagctcatgagtaatttacattttat

SEQ ID NO: 79484 - DNA, 5138 bp, Oryza sativa
ctaacttatcacttcattaaaagaggcaaaataaaaggcaggagaagttttaaatattgatagcttcttgtggtaaaagattagtgcaaggaaaaatgacaatatataatatacctgcacagggaaatccatttgtggcctcctagttgaccaattaatattgtcccagtctacggagggtggaaacatcttgtaatctttttgcacaaaaaaaccctgatcgatcacagtaatcagtgtcgactcttaaaataatgatgaggtactgagctgaatttttcagtaaacctggcattcttcttcaattatgttgatactgtcaagccattttacagagcgtgcgccaattactccaggtacaacaacacgaagtgggtatccatgatcacggtttagggtctgtacacatcatagcgccacattagaaagccagcaacagcaaagttcacaaaagaacatacatgcatccagaatcccagattccgagcagagtgtctctgcccaacatttttttccacgtctagtgcactgtgtgcaccagtaattgacaatcactaccacattaagttgccatagactgggtcagcgtaaaaaaaaagggctactagtggatattgatacttagtagtaatcaatatttcaggtgctgcttgtgctaaccattctgctttaggaagaaacaactatatgaatgtagcatgtttactacagtgcagcgtcagtacagaaaatattatattatatttaatcacatctaaaataaagaaatggttatatctcagcatatgtaattttgaataaaatagtgtgctagataatattataatggattaatagcacaaactcaaaaagggagaccggagaaataaacataagcatttgcaaagtcaaacattttgagaaattctaaaccgcatagggaaagttatcaattttcatactaaaagaaaaaaaaacaatgttctttcacctctccgttcatttcgtatgcaagtaacacatcagcttcaggatctgttgcctgctttagtggaattgatgccttatagggaccacctttttcttcctagaaacaaatggcttgagattagttcggtaggctaaaagaacttctgcgggtagataaggacttacatactcactttgcacctgtcaacactgacaaactcaacatgcttgcctcctaaagatgtgactgagctgagtttaggtattccaactagttcaaggacatcagatagctttgctcctccccatgttgctgggaacaatatgaaagaagaaaacatagtacgattattacaactatataaaattgtgtccatttcatacagataaatctaggaggacaaaacagtcccgtatcagtaatttatgcatgatataacaatcactgagcagggtactgttaatataggaaaaacaaaaggtaaaaagaaatgacttattatggtcggtaaagttatatagcatgaaaaagaaacaattctaggcctagctaacaagagataatccttgcaaatccctccaatcatacgataataattatctctataattcctgctatcagaatgtagttgtgtagtgatagcatgcctagatcccacaaagtgcattatcttctggacattagtgacgagtagtattcagtaacacagtacatcagattgcatttctaaaaccttgaagacaacactcttcagtacatactataaacatggtgtatttcttaccatttccaagagcagatatgtcccacccaacgcctctcactttccgtaccttactcattgcagtcctcctgttgcctgcacactacaaattcgatgttgtatcgttatgttactaacaatgtcaatattatccatcagataaagatttggggagagggatttgtggcaaacctgtaacgttgcagttacatcatactttgggagactcctgcatgtgaaagtttgcatcaattctcaaaacaatattttgtttagtcataacaaaacataaaatgaagtacttacctaatgtcagccatggacagctgcacattcttgttgacaataccagtaatggaaacactgtatctgttgattcagtcaaactgaaaaaggtaaggtttgttacaaaacataatgataaatggcaacttatagttcatgctgacaaccttgagaggtcatccacaattggtatcggtccatggtttctcttgtagaagaaatccaccggggtaatataagatgaaactaatgctgatcgatgaggctcagcattaaatggttcctgccaacagttgtagtaaagtaagacttgctaactttatatatataccgtgcacttgtatactatgatagtgacagaccatatagaaaagcaaattgggttattctttccctcacatatttatcctaatgtacaatcctaatcaacaatgtaagagttgttctcgattggctggttacataataactttatagcatggaacaacatcacaatttgaataaagttctgacttagaaggaagattataatgaagataaatatagcttgtctctttcttatcttttcttttaagaatcagtctgttgtctgcaatactgctgaccaaggacaagcgcaaaagtatccgagcgtgttccaataaggaatcgacaaatgcgatagcaatgttcatccaagttattacgaaatatgtagaaaaaaaatcagagacttgtttacttcaatatttaggatccagttccttgtcaaaggtatattcagaaggggatcctctcggagagtgaaccgattaaacagaacgaaatgccccatttctatgtcttgcaaaacaatccatgaacagctgaagctaatctacacgacagaaggcccgcagagcagccttgtagcacagcacacccgagtgaattgtatcgtgaacaaacagaacaacatcgcaaaatcggctaatcctaaaacccacctgctttcgctcaagccgggaaacggagaatcggagatccatttctccaccgagcaagcgagcaatgacaagccaaactaccctacacatccccgcacttcactacgcaacgcgttgcgtctctgaacatgggcactgtgtacagcataaacggagaccgcccgcgattccggcgatccagcggcgtgggtggacgaacccgacggcgggaatcgtccggccctccaaggtggcgaacgacgacgcatgcaggatgcaggcccccaaccccgagcaaaccccaccaacccacgcaggttgaacgacgacagatttcattcaggaacagcgataggccggtgggagggcggagcgaacggacgaaccttggagttgatcttgagggcggggtggcgaggcggctcgtcggagtagctcgccggcgcggtgagccccggcatctcggtggtggaggcgaggcagaggcgatggatggatggatttgccacgggctccaactccaagtgggccggagtttttttggttgtgtggtgatcgactcggccggcaattgcgaggctgggtgacggctgtcacttgctgacctaacattttttcaggtccatgacatgtgggccctctccaaatcctttgtgctgttgtgttttgctcaggccacatcgtttggcttttttactgataagacaaaacggcttattaaggaataaaaataaatttattggtaaaatttatatatatgtgttcttgtgacttaaaagctaatgctgtaaaagaaactccattgaaaatatctcaaaattaagtttgaaaatctaaaatttggctttttctttgactgtttaggccatccgatgggaggcctcaattgttcgttctggagcagaaaaccaggagaagtatttctaaaggaaatattaattcttttgcaataaacattatttatacattcggttcataggattcaaaagaagatttttcataggaaagctatgccaattctccaaaatgtactaattccatatgaataaaaacatccactccatcctctcgtttagctcagtgtagaaaaaattaatatgttccaatcattttttttgcacgtgcattcctacattatttctatgtttttcctattcttgtgattgggaaatcccgtgaaccgaataggcctaagagattttattttgcttgttttttcgcagggccggcgacgaagaggagcctcatgtaatgagatttagatagagttgttacaaattacaataagcactgtgaaacataggaatcttttatgtcgttcctgcgtgagccaagccaaaggatcgaaaagattgtaattgagtggattcttttttcctctgttttggtgaagggatagcaagttttactgtagttttccttttggtggattcctttggattcactgtggtatagtgtcaattccaaaggattgcatatttatgtactttaaaaaaaatcctttcaaccaaatgaggcttgaatcttcttggagaaaacaaggctcacagtacttgtttattactctcttttatcacaaacatttgatgttcggtgttagatttggtcaaaattaaaaactttgattataatttctctaatgcttagtttttttaataaaaaaaaggtatgcctagatttgcctcaaatactttgaaacttattggtttttataaacttattttaatataacattgatggccggatttttaaaggtttgattgaatattgttctaaatgtcaaatattcatgaccggtatttggcatgacaaattcaaaacgacgagccgcaaccagagtaaggccttcatgtctcaaacttccaggcccagcttatacacatggatcctcccccttagaatgtatcataatgtttgacctaattctttttatgataatcaattcaacctcaaacatttatgggtaagattttgtttttcaattatttcctttgaatcagtagaacatcggagtgattgtgcgctctacacggcccctacttctcaggaccttgtaggttctagctgcatatacatacctccatatgctaaccattttcatatgtcaacatttgtatacataggtgccctcatgaaatatacaattcatagattttgtatctgatagcagcatagcaccaaatctccactatatgct

SEQ ID NO: 79485 - DNA, 14436 bp, Oryza sativa
tatgagtgtatgagaggtatgaccgagtattaatgatgtagtatatttttatataggtaactattgtatgaatggactattagattgactatagatgatttagagccagcaattggctatactattgaacttgctctaatggaatttcaacggcggccgctagctgatgaaatccggagtagattgccggtttggcgcggcccatgaaagagtgcatagtcaaggcacaaccaattctactctacagattacagaagccaaaccgccaatatccaatcaaaccttacaattcgaagaacatatttcttcttgatgtgccgcgttaacattggtatgtaccaatgaactcgcctattctacggtgaagacttaatattagtataataaatagtataaaaatgcagccatgcatggctcatggattaatttgcagctttgcgtctaaaaactaattatagatgcaaggaaattcacgataccaacgtactctccatctctaaataaataagtgcaattttaattaatcaaatcaagcatacagagtgaaaaagagacaaggggaagaaaacgaggagaagggagtgctattaaaaacgagaagaaaaaaagtaaagtacttcctccatcggataatataagacgcgtacgtattttaagattcaacctttaaaacatttgacgaacacttaatataatatgaaatgcattttatttgttaaaaatatgtcattagattgagaattaaatttacttttatatggttataatttcgttgctacaaaccttcaagtatatgagaaattattagctaaaaattagtttttgagaccgtgccaattttgaattataagatagagggaatagtagtaataaagaggtctaatggaccactctaaaactacattattaattagagactaatcttcaagttacaactatacttcctctattctattctaaaatataagtcacaaccactcttaacccaaaactaagaaataattattatcacattatagttcggattatcctaataaatagaatgcatgtacccaattaaattagaaatcttgatgattagcatttaaataataatattttaatggaaaatatgtgttagttaatgacatacatgcatgcacgtcttctattatgaaataactttaaaaaatagttgtgtcttatgttatggaatagaggagtacttatttagaaatggaggggtaaatcccagcctctatatctaggacatacaactagctaggataagacatgcgagtaaaattttatacttagttataaatatttaatgtttaggatgatatttgatcataagctacttaccataagtttggtattaaataaaaataagtgtataaaatttaatagggtgaatagctaattgagtccctcgagttttatcgaaggctcaatttgatccttcacgtttcattttgtccacatggctcctctaaatatttgctttggtttgaaatcatccttggcccacttaatatgccatatgactatttctagttaatatttctattagaaaatattccttttgcctttaatttgtatacaactatataccagaaaagagaaaaccaagatgaataaacaacattgcagatgtacttcccattatttcaacatgtgcacatatcgtatacgctttctagtacataatttattttcgttttacataatttactatgtattatctataaaaaaatcaagcatgtaatttttctcttatatatgtgaatgatggggatataagtgtcatttatcaagagagttgttggttcaaggatatgtttgaactaaaatgaaaacaactcgaaggactaatacgggtaaattgaaacattaaggactaaactgagcctcaaataaaacttgagggaccactttagctattcacccaatttaattggctgttgatggatatatatagcataaatattttaactaaatttgtatttataaaatttaactcttaatttacagacaaaatatttaggacttgaggaaatgcacaagtgaaatctcaagtttcaatcgtcgcttttatctcctcgcaacgggaaactctgcccaagttgaaagtagcccttggttagcactacgttcttgaaattgctgttcgccgtgaagaaatcgagacatctgctcctcagctctgggcagttgtggcaaccgtctcggcacagatcagagttgtggcaaccgtctctaccgacacgagctcccaaatattttgggcacacataagcttcaggctatccagtgcagacctatttgccgctgcgagaagcggctcaagcaggtcggctaaaccgtttaaacgattatccattaaatatttaatgacaagatgatacaagtaaaattttatagttagtcataaatatttaatgtttacgatgatatttgatcaaacttgttgaaactattgccatcagttttttacaccctccaggctgataatacttgtagttttagataagggtgaggtcaaactttagaatatttgattatgaattatttttaaaatatttattttcaaatatggtgactatatgtataaattagtattaaaaagtactttaataaaaccatatatttgttaacacttttatacatattataatgaaaaataatggacaaagttggtttttggagatcattcaattgtccaaaacgataagtattatcaacccggagggagtattattataataagattataaagattaataggctgtcgatggatagaatttaaaaaaaaactaaactaaaatttaaatagatcttattttacagataaaatatttatgactcgaggaagtgtataagattaagtttaacaatatagccaactactagctccaaaattaaaacattatctataaccaacctaatagtccacccatacaacagttaattgtatatatatgtaccacataagtaattaatgtctaatcaactaatctctctcatatagtttgtttgagcccgtactggagctgactataaatttgtagctcacttttcttcaaccttcatcacataaacaaaaatatgatacggtataacttatatatcccgcttaattttggccttgtttggatcctccgagctattaaatagccctccggaatcttgctatttagaagtattaaatatagattaccgacaaaactgattccataacccctaggctattttgcgagacgaatctaatgatgtatattaatccatgattagtggctgattattgtagtatcactgtagcaaatcatagattaatatacctcgttagattcgtctcgcaaaatagcctaggagatatgaaataggttttgtcagtaatctatgtttaatactcctaaataacaagatttcatagggctatttaatagccctccagatctaaatagggcctttaatgtacttctcaaagaagtcgcaagtttcaatcctcgcttttatatcctcaataaccaacgggaaactctgaccaaggtgaaagtatccctcggtaaccactaccttcttgaaattgctgtcagccgtgaggaaattgaagcatctgctcttcagctctggacagttgtacactcggcacagatcagagtcgttgcaaccgtctctaccgacacgagctcccatagcttttgggaacacataagcttcagcctatccagtgcatacctgtttgccgctgcgagaagcggctcaagcaggtcggatgtacctaacaatggtggcaaaacgtccgtgtacacgaagtgtagcagagctttgaacgtcgccggctcgatgtcgtgcagcgtgacgcacggcatggtggcctcggccatggagccgaggagctgcgccctgaacaccggcgagcgcgcggcgagcacggcccggtgcgcgtggaacgtctcgccgccaacggcgaacgacgcgtccgagccgtcggcgctgccccccatagctccgagttgggcacccagattggggggcggcacggggataggattgccgtggacgtcgttgcgcacaaccatgaacccacacacgaatgtgaccgtgcctttgtcgctgacatgatccggctgtagatcactctgcttgacgaagtgacgccacccagtgaaccggagacccgatgctgtctccatgtttggccccatggtcctctttgcatggtgcgaggaaggtttcccgtctttgtccatcaagaaaacctcaaagataatgctgattttggggtcgatctcattctcatccagcagcaggaagacagagatgtacttgcaccctgcatgcgagtagaagtggaacacaatcgtcgcattgtgctccccggccgagattcttctttctggtacccattcgccgatgacagtcatccaagaggcttctaggtagtcaaatttgtactcgatgaaaccggaggacagcatggtcgccggcggcgtatgttttgttgcgtgcggatatcccaaaaggagaattaatttgatcatacgagagagaggacaatttatactaccgaaagtagcgatgagttgttcggtctggtgaggaataaacgacaggggattcagataaatttttaattaggatttgtaaacagatcatctccggactctggtcgattggtgataaaataaagggcaaaaaaaaatcgaagctattttcatccgtatcggtgagaccgcgtatgcgtttctgtctccataagccgtggccaactcggtgtcatacccagattgaaaattttccccaaaaaacagacaagaacaaatctcaaaaaatagcatctcaaattgcatttcggctcattcatttgcccaaaacagccataacatctaaacggaaaaaaaagaaagagcgatgcatccaccaatcatgtgcaacaagcaagcccaccggttgcagattggtgctaaccacttcgagatcgaaggagtggcgtggggaaggaggtcttctacctgcccgccgtcgtcacgcccatatgaccaaccaaataccaacacaaccaattctcagacgtgaatagacagtacaaacgcggaattattaaaagaaatgcacgaggtgcgacggattaatatgcagttttgcaacttataagactaataagcaatattcaaataataattatgatatctatcgacgtaataaaagggctaaacgttatatatagatcaatttggaatggagggagtataatgtttcaacgttcacttcttaagccgtggctttatctcttcgataactgacggaaaactctgcccaagatgaaagtagtccttggttaccgctacctccatgaagttgtctttcgtcaccacgagatctatgcacctgttcttcagctccgggcagctgtgcatctcggcgcagcacagagtcgctatcaccgtctccactgacacgctctcccacagcttctgggcgcacatcagcttcagcctctccagcgcgaacctgtccgccgccgcgagcaaacgctgaagcagatcagttgtactcgtcgacgaagagccttcgatctgcagaacgtccgtgtacacgaagtgtagcagagctctgaacgtcgccggctcgatgtcacgcagcgtgacgcacggcatggtggcctccgccatggacccgaggagctccgccctgaacaccggcgagcgcgcggcgagcacggcccggtgcgcgtggaacgtctcgccgccgacggcgctgcccaccatggcggcgagctggctgcccaggttggacggcggcacggcgacatggtcgtcgccgtcgtcgtcgttgcgcagaactacgagcccacatatgaatgtgaccataccgtcgagtgattcgagatcgcttcgcatcacaaagcgatgccacccaaaccagtcgtagccatcctgggacgcccaacactgcatagtcctcttcgcatggaacgaggatggtgtaccatcttttccaatcaggaaggcctcaaagatcaccttgattttggggtcaatctgtttcagcatcacgaagaagagagagatgtattcaccattgccgtacccaaacccatgcgggtagcacatgatcttcgcattgtgctcccctgtcgagattgttgttgctggcaatctctcgccaatggctagcttgtggatttgttggtagtcaaacttgtactcgatgaaaccggaggacaccatgttgctactggcgtctatgggacctgaccgcctgagtagtagtagtattattatttgatctgctggttgacactttttcacggccaacacaagatcacctaacgatttacggtataattaacagagttgccaaaatcgatagatcaaaatcggctagcggaaccgatttcgagattaattcaatttcatggaatcacacagctaatttacgagcaaattagtaaagaagataatatcgtacttacgtgacgacgaacgactagtttccgagtaaactagcaaaggataacctcctcatttttatagagaagcacaaccgtttttcagcgcaaaacggtaaagatcaaccaaatcctaggattgctataactcaggcataaaagtaaaatagaaaataacggaaaagtaaaggaacgagaaaaatagcagatcggtaatgttcggggtcgtcctcgaatctaaaacccctgatatgtataagattataagggtatatgcactgctacggcgcagacgagaaatctacggaaacaaggtaccagaaaatcctaacaaataaactaccaaaaatatctatcttccactcctggcaaccacgcacatccacagcttcggcatgcaatcgatcagtacaggagccgagttgtctgctgtgaaattcaatgatccaagcatatgtctccaagctaagtcagccattatggccttccatcaattacgtatataatcccagtgcatcacaactaatcctgacacacataaatttgtctttccagcaaaccacttaacacatatagtacaagttattttagataatttggcctgctcaaataaaatcaactatgagccaaattatgacataaagactgctaaagagagaatttatagtacagcaatgcatgcatacgcatcgatgcaaagtactaggtggtgtttggatccagggacttactttagtccctgtatttagacactaatttataatattaaatatagactacttataaaactaattacataaatgaaagctaattcacgagacaatttttttaagcctaattaattcataattagataatgtctttccagcaaaccacttaacacatatagtacaagttattttagataatttggcctgctcaaataaaatcaactatgagccaaattatgacataaagactgctaaagagagaatttatagtacagcaatgcatgcatacgcatcgatgcaaagtattaggtcgatgcaaagtattaggtggtgtttggatccagggacttaactttagtccctgtatttagacactaatttataatattaaatatagactacttataaaactaattacataaatgaaagctaattcacgagacaatttttttaagcctaattaattcataattagataatgtttattgtagcatcacataggctaatcatgaattaattaggctcaatagattcgtctcgtgaattagtccaagattatggatgagttttattaatagtctacgtttaatatttataattaatttccaaacatccgatgtgataggaaattaaaagttttagtcccatctaaacagggtctactccctccgtcccaaaaaaagataaaccctgggtttccatgtccaactttgactgtccgtcttatataattttttttaataattcatatttttattgttgttagatgataaagcatgattaatgctttgtgcgtgacttgtctttttaatttattttatatcttttttaaataagacagacggtcaaacgttggacacgaaaatcaaggtttgtctttcttttttttttacggagggagtaattagtaacgctttggagttccaaccgcggagaggagaagatccatgatgtctccatacaacgcctcttccaaagcgtcgagaatgtgaagacgacgacgcctggacgcctggtgcgtgtcagtgcgattgatagtcaaaaaacaaatgaaacgaaactgcggatacacaccggattctaatcactatagagtaaaaacatgttaactaaatggttataaattttttaaaaaatatttgataaaataaattaatatgtaatatacaattctacaaacatgcatgttcaaattcaacttctacaaatatataactaatataaatattcttattttttcgttcgtcacctcatatgtgcggtgatttttttgtccccctcgcctctcctaaatcttagtcggaattccatcaccccgacccaaaaaaacttcccaatcagaattcaatcaatcacacaaataaaataaaatcggaggaagcaatatacacacacaaatatatcaaaaaaggatcaaaggggaggtcgccgtcgagccgccaccgccgccgctgggacgctggcgggctgtcgatgcctccctgggcgccgcagcccccgccgctgccggttgtgggggagccgccgtcgccgctcacagggggagggcggcaccgccactgctcgggggggggggggggggcgccgccgccgcatcttgggctcgggggagggcgctgcccccgctgccgttcggggggagggcgccgctgccgccgcttgggctcggggggagaggcggcgtcgccgccgcagtcgctcggggagagaggcgccgccgccgccgccgctttgtcacgggagcatcaggggcgcggaggggagggcggcgaagcgagagaagggagagaaggaaatgggctagggtttttgatggctaaggagagggagggggtttttgtttccccgatctcgacgctcggccgtccgatcaaaaccctagagatcggacggccgccgtcaaccgggccgaaatgggcccaagagggatcgagagcgaggccacttttccggcccaagcctaggttgcggcctggggaggggtagagcgcccgcgcatgcgcaaaaggccataggccgaccggcaagggacgaaaagaagtctattttaggtccctcgggccgaagaaaaagattcagaagcatttacaattatagttattgaatgtgtttatttcgaatcaaacctaaaatgaaggattttctttctttttccaattaaataattgttaaatgatgtttgtattattaaaattaacaattaagctctaaaaattccaataaaattctaaagagcgtaactaatcatggagaatttaataaaattaaatttaaccatgttattttatttctcacatttgctttacttgtaaatttatttaattatacacatacctacttaaaaataccaaatatgtcaataaatttgtatttaattaattgcatatttttctgatatgtacgcttccaaattcaatatttttgtgcacatgtgttataagtacaaagcaatcttaagcatccatgtttgtttgatattcacccggtgcaacacacgggcatatttgctagttataacaaaaataacaaaattaattgttacaatttatagaagttgaattttaacttgcatgtttatgaagtggtatattacatattgatctatcttattaattattttaattttttttcataaccatttagatgacatgcaataaacgggtggacatccacctaggtgattaaaacagtttcccgatacacacaactattagttgctaataattttataagctaatgtatgagtgattttgtactacttgggaattaccgggagatatcatattttttatataaaatttggtatatgagcatctttgatacactataaaaaaggattttttttcataccgctaaaaaatattttcacatgcaggtctttgatccgtctgcatcaggtgtatgtgaaaatcacccgagttcaaatcaagagatcgcaaaacttagaaaaaaaaaacataacagaagagcagtcaacgtggtagctagagagctagtacaagatatataaatatttcagctacaatttctcaaccctcttcttcagctcagcaacaatgaccgggaatttctgcatgagcagtgcaaaaccatcggtgaacacggccttcctgaaattctcctcgacggcaaagaaatcgatgcacttgttcttcagctccgggcagttgtacatctcggcgcaaaccaagatcgcggcgaccgaatccggcgtcatgttgtccagcaacctctgtccgcacatgatctttagcctgtccagcgcgtacctgtcggccatggcgagcaggtgcttgaagaacacgttcgtcgacgaggagccctgatggagtttgccggcgtctgcaggcaactcgtccgtgtagatgaatcggagcagagctctgaatatcgccggctcgattccctgcagcgtaatgcacgacgacgacggcgaggtggattcggacttgcagccaaagagctccgtcctgaacaccggcgaccgggcggcgagcacggcacggtgagcggcgaacctctcgccgccgccgccgacgacgacgaaggtgacatccgcaccatcctcgctgtccagcaggccgccgagatggaccccgatgttcggcggcggcagcggcaataagccgccgtcgagatggccgccggtgacccccggcgacggcagcggcacacggttgccgtcgccgtctccgtcgtcgtcacgcaggacgacgacgacgcacatgatcctgaccttgccatccaccacgaacaccgatgacaaattgcttcgcttcacgaatcgtggccatccccacgcgggatagcccgcgggtgggtagacctgcactaacctgttcgatccatcggacgggttgccgtgttcatccaccatgaaggcgtcgaagatggccttgatgttcttggacttgctgatcagctcgaggtagagcgagatgtagtcgccattgttgtctgccttgtcgccgcgcgggtagcagttcaccctccaggttagccctccggcggtgaagaggtcggagttgatgggatcgccgatggcagaggcgttcgtcgccgagtaatccagtctgagctccacgaaaccggaggccggcgccatgctcgatcgatcgtgtgctgagatgagacgtacgtgtgatttcagcagaaagactgagaaggatagatagatatcgaacgaacgccaatgtgtataccgtataatgccgatgtgatgagttatatatatgtattgtgatctctttctctaattttggatgtgtcgatcgattttcttattggatagtacaaactcctatttcggtatttccataataagaaaatcgatttgtcgtgtcgatcgatttttggatgtgtcgatcgatttgttgtgtcgtagtcttattggattcggatacatgcccggcacatgaacatgataagatgaattttgcagtcctttagaaaatacttgagatacctaaattttgcactataatttttggtaccttaagaaacttattatagtatctagaggtatcaaattttacactagaaaatagaaaatgcttctcatcgaacgttcgaagcaatgacaaaaatcggacaggcagcctctgacacacatacacatatccaagcctatatctctacctccaaccatataacatgcacctttaacgatatttaaaacgatttttctcttaaatactcattcaatctataatctgatcacaccgttgtattctttgtaattaaatctttacaacaaaatgtcgcataattatattttgatgaaagaaaaacatatgtttcaatccattaacattggttgtttcatatgtgatagcgatatgttttaacgtgtatcttcaccatgtttcataaactttttaaatgtttcagttgctgattttttttaaccctatataacttgatatttcactcgttagttaattggaacatttgactgactgattctttttttttttttgcatattgcatacgtaggtggtgtgatgacgcgtaaacagtcgggcgtccgatatttggtggaatatcggacgtccgacacggagtcgtctccctagaatatatagcatctctaagtatcttaagaatgataaaaatacccaattgataatatggtcgattccaggcgcctggtggtatatttggaaccaaagaaatgcatgaagcttccaacaaaccccaagatcagctgatgaagtagttggacaaattctgatgaaaagcaagagcattcagctagtacatataacacccccaatataattaaacatgataaaaaaaaacaagttcaaagccagacataacttagaaaaaaaaaacataacacaagtgcagtgaacgcgatagaggactaaaagatatatatgcagctacggtttcacaatcctcttcttcagctcagcagctatgagcgggaatttctgcaccagcatcgcaaaaccatcggtgaacacggctctcctgaaattctcctcgacggcaaagaagtcgatgcacttgttcttcagctccgggcaatcgtatgtctcggcgcaagccaagattccggcgactgaatccgacgtcatgctgtgcaacagcctctggccacacatgagcttaagcctgtcgagcgcgtacctgtcagccatggcgagcagatgctggaagaacgcgcccatcgaggagccctgatgattgagtttgccggcgtctgcggccggcaagtcgtcggtgtagatgaaccggagtagagctctgaacgttgcagcgtcgatatctttcagcgttatgcacgacgaggtggattcggacatgacgccgaacagctccgccctgaagaccggcgaccgggcggcgagcacggcacggtgggcggcgaacctctcgccgtcgacgacgaaggagacgtccgtcgtcccatccccgccgttttaggaagagcgataagtaatcaccattgttgccctccttctcgtaaccacgcgggtaatagtctacactccaggtgaacccaccggccgagaagacgtcggaggtgagcatgtcgccgacggcgtaggcgttggtcgccgaataatctagtttgagctccaaaaaaccggaggccggcgccatgttcatggtggtggcagatggacagtctgcgagatggggagatagatcgaaaagcaatgtatacatatactaatgagtaattatgagtatcatttttctgttttttgagatccgtagatcgattcactttcctatacggaaatatatctaggccagttcagatgcataggcgcatcaccactgacccatatcgatgggactgactaggtgactagggctgtgttagggagtgaggttgggaaccctctgcttcgcacgtaaaacggagcagcgtttagtgtatgactaattaagtattagctaaaataaatataaaaaatagattaatatgatttttaaagcaactttcatataaaaaatttttataaaccgtttagcagtttgaaaagcatgtgcgcggaagagctggagaaaactcagcgtaggaagaggagttttagggtgagtttgagatgaggggaaaagagacgattgagaagatatgcaaaacgaggtaagccattagtacaagattaattgagtattaattatttcaaacttcaaaaatggattaataagattttctaaagcaaattacatatagaattttttttttgcaaaaaacaccctatttagtagatcagcatgctttctccagctgccaaacgcagccttagagcaggtacaatagcaggctataagccagctataaacatattttaaagagataaaggaagagagagaagaacaatgggctacagatttgtaatcaggcgtagcatgaaatccaagacgtaatgtgtgtatgacaggtgagactaggtattaatattatagcaagtagctattgtataaatcggctattacttcctctgtttcataacgagagttattctagtattgcccacatttatatatatgttaaatgatgtgagcaatggtagaatgctttacattataaaacggagggagtacattggctatgatgatttggagttaatagtgggctatactattaaaacttgcttagtacttgagaggggaggtatcaaatctcagccattgattaaggttaatcggatggaaatgattgatcggtacctgttgcctgttggtactaacgtcgttccgccgcggggtacctagtggttggtagggcagctaagtaatttcgttgtgtcatggttgactctggcg

SEQ ID NO: 79486 - DNA, 11654 bp, Oryza sativa
ctgcgcgccgccgctcagctcctcccttgccgcctgtcgccctctctcgctctcccgccgccgcccgctcaactcctccctcgctcgtcgccctttcccgcgctgccgacgctctcctcctctcccaccgcccccatcgtcgccagcacctcccttgccgcgccaacggcaccaccctcctccatgccgccgttgccttgtgttccggcgcgccgccgatgcctagtcaccgcgccggctccccaccgacaaaaaggttgagaggtggaagaagaggggagtgagggtgatatgccgccaccgccgctctgcccgcgaacctgctccgtccgccggccgccccactccaccggtcagtgaggaaagagagagatgaagagaggggagatggggagagaggaggaagaagaggggtgaggatgacatgtggagcccacgtgggccccaccattttttttaatttctatgtgaaactgacatgtgggtcccacgagctttatatttttccggatcgaattgccacgtaagcgccacgtcagatcaagaccccacgtaggtgccatgtcagccaaaaccgccttcaaaaccgccgagggacctaatctgcaccggttttgatagttgagggacccgttgtatctggttttgtggttgaaggacgaaaatcggattcgttgacaagttaagggaccttagatgaacttattccccaagagaataaacgaggcagcaacagaaatttccccatgatgaagataacgaagctccagcctccaggagagatcaagcagatggacaaaaaaaaaatgatgtttgttttaagataaactagtgacgagatttgacacaccaaaagcacattaaccgcacgtgaaatgcaaaaatgaacctcacaccgagacctgaaaacagagcgaacaactctagaattgctcagcgaatcaattgttcctcatagaaagctatttcctgacataaacaaatataacttttcctaactttgataatgagatggcagcagatatgttgtgcacctaacagatgagtcaaacatccggataaacagttaatttgctttattaaacaattgcttcagtgacagggaatgccaccatatgtagcaagccgcaaaaataagtttgcaagtcatacatactggagatgcatggaacgatggaaaacagtacatggacaactataactgaaccaaaaatgttatatcattcttggataattttagatcataaaaattccaaaagttgtggcaatctctgcatgcttcacatttagtatctgtgggatagcttctcctgctccttgtagtacattgcgtacctgcatagccatcaaaatagaccaggttatattgtttgtgatgctgtcaagaaaactgatagtcatcaatgtcaaggaaacagtgttactgcacacaaagaaacacaaaaggaagtcatcaattgtttacaacgtgaaccagcagtatacacactccaccatgttcctccatccttggattgaaaagaaggcctacttgcatttccctcacgaaaggcaaaaagagtgaatgctgtcagcgactcagtgttctaaaagttagcaggcgccaggtagccaccgtgtttagcaattagatggtgcaataggcggctagagtgctcttgtgttactattttagtgctatattgtttagcatgtaatatgttgctaatctcttggagtacctaggcagcactaggaacttaagaggccagccctgccaacccaactcctcttttcaattcaagttctcaaaaaacatttcaatcgttaggctcattgttttcaataattcacaatccgaggtgagggtttcctgatattaggaaaaacaagcatgcctataactgccaggcaaaaaaaaaaaaaaggtaactcatcagtactaagaaccatggagactatatgataagctgcatcaatggtcaaaacatagcatattgcatctacttaagacaacttcccaaaaatcctatggtacaaggtaaacaaacaacattcagatggtatttcttcaggcttcgacacatagtgagctcacaacgccaacaagctgtaacatgcagtttaacaagttcacataaagctaaatcactgaaaaatccatgttggaaaaaaatagtataataggctaactgatcattcaggcattcatccgaagacataatctagttttgcatatctcaagcttgggcatagattctccaggagacatgtgagtacaaaagctatatgtggcgctcaaaacattcagtttggaaacagtaacaaagccaatcaatattagaggcaaattcaactaaataatacagtacaagagaagtacttagctaacatgattggatcagcatcatgaccatacagaataccaaatcaatttgggtctggaactctcgattgaaacagcaaaatcgttgtgagaacaaatacaaatataacctcacagcaaataatttgcagcgagtccactgctccaaattctgcctaacctaattggatcgacggggcacgcgtttcccgagtcaaatgacaacccgatgcaacgttgacacgcatcaattcacgcgaaatctgcacaataattccgacgaaatgggagcaaatacagagaaactcatccccgcatcgcagacctaacgaatcaaccgaaaccgcaacgagaagaccgatccaaccagagccaccgaagctaaccatgcctaacaaccctagatccgcccagatccgccgaaaccgcatgcgcgcgagaggaggggggagtggagggaagaggatgggggaggcgtactcgtaggtgccgacgatgggggcgaggaggagcgtggcggagatccagttctcggagaccttgtggtggatcttggtggtgatgtccttccacagccccggcatcaccttctgctggaacggcgacagcgcgtacaccaccgccttcatccgcaccggcgtcttccccatcttcctctccctccctcgccgccgccgccgccgcctcggtggtgtgctccggtgcgctcgcctccgatcacctctacacgccgatcgatcgatgggcttctggattgttcgtcagctagggttcggtatataggatggatagaagtcgtcgtgtgttggggtattgggctttggcccaatcacaaacttggcctcttgggcccggcccaattacacagcgattttttgagtaaatttcagaagagcgaattataatctctaccatggcgagaatgcaagcaaccaaatcgtagatgtgaactctgaagaccttgataaacgatactggtagacctaactgtgcagatgcggtttggtagcatgattgttcactgggaaaaagaattatattagtttttcgaaatcatttttaaaatgtaaggtgttttgtttttgtcttgagttaaacatcctcaagtttaaccaagtttatagaaaaacaccaaattaatttaattatacctactattgaatatgtttagaatgttgctatcttttttcataaacttggtcacctaagacaccttaccacttggaacttggcattgattcgcgtgggaattacagtcagttccctatgaatttctgcatagttcttgtattccaaacctagcattagagttctcacttcttaggattgttaacatatttgtgaaatcccttgttgcctcacaaacaactcaacaaggttgaccaaagctcacatgcaaatatgcaatgtagacaaacaagttgcgtgcaaggtaagaggctaacatccaatggtatgtacaaacactgttctttcaatccttgcatcactgtcagtggttgcaaaattgcagttcaaagaaaccttctataaatatcaattgattaagaccatatcatggtcagttggtcaccatatggtgttaaaaaatttgggatagattgtctttattccctcgatgacacagcagcttattgagttgaccaatgaatcaatcacccacacagatagcacccacatgaccacatctacatccctaacgaacaggaagggcacagaattcacaggctctaagctggaccagaccggagagcatgatcaagatccgctatgaggtcgtcggcatcctcaattccaaccgatatcctgactagatcgtctgtcaggccgcgctcctcgcgaaccgcagaagggatgctggcgtgtgacatgaagcatggcaggctaatgagcgatttcacacttcctgcatttagttttaatttggattagcaagcaggaactgaaaactttgataagaaatgactggatcggttatattggcgcagtttcatcatggtttcttaaaaacaatgactcctgatgatgtatgacagcagaacattgagagaagcagaaatatgggtttgtctgaatgctcaccaaagctaactgttacattgaagtactttgtggtctcaacaacatgttttgagagagctaatgaaccagttaggaaactgagaactgaacccgctccctttgcctgcaaaaggaaagggaaatgttacaatcaaaagttattaggatgttctgaatccagttccaagatgtcaatccaaggaaatatcctaaatagataactatctaaagccacttaatgtaaggcaatttgaaaactactccaaaaaacaacctgggaatagtgtagagatcgtccaggatgatcaggaagtcctgcatagttcactttctttactcttggatgagaagctagaaattcagcaatcttctgagcattagcctgccaataatataggggtggtccgtctcttcagttgaatagatcacattaatgcatatgtaaacataaggattttggaaacagaaatataattaacagaaggcagactacaaagtcttataaattttgttgatactcgatatgtatattgaaatacatgttatggcacatgaaagaagttacacctgctgcttctccacccgcaaagccatggttttgattcctctcaaacaaagccagcaatcaaatggtgccaaacctgatccttcagcattttgtagaaatgcaatctctttagccaagctgctgacaaatgaaacaggtattacatcacagtttccatcagcttcaatttttaaaagtctaccaacttcaaggaatattgagtagatgtattcagcaagaaaaacaaaagagaaaggaattgcccattagcatccaccctggatattcatgcctattcatgccaccagcaatagataggagaagtgtaaagtgaggtccatttcaagaaaagtagaaaaggagggtagtgagaactgaagtactgtttgccaccagacaccaacataatattgaacagcttatagacatgaaatgggatagatgaaatggagaaattgcaaaagagtcaatataatcgttgaatgaagaatttagagcacacctttcacccttcaccgcaagaattccagccataagatcgctatgtccagctataaatttggttgctgagtgcataacaatatctgcagaggaacaagagaattatagatgaaactctgttgtcctatggggatgcaaggatgcttgaaatggaaacctgttgttctagataagtaaatatacaattatatacctgctccaagttctagaggacgggagagcacaggagacatgatgctgttgtctactaaaacaagagcaccatggtaatgagctatctctgctattttctgtgaagcaacaaaaacagtggaaggaataagaatactaccttaaaaccaaggcgaaaaacatctggatgaaataaaaatctagatatacgcttcatgaccaccacatacatcgaccaaatcttacctttatatcagtaatttgtagacggggattggtgggactttcaagccatactagtttagtcaagggcccaattgcagaagttacctcactaattttggttgtatcaattcgtctgtcacaagaaaaaaaatcatataacgcttgtaagtgagaataaagaggcaacaacaaaatataatcttactaaaaatatggagataacactaactttactacaatcccatgtctcggggcaacttgtgagagcagacggtctgagccaccatatatgtcctctccagcaactatttcttgtcctgagaatcataggtttgacaaataattatattcacaaatgcatacaggattccatggcaagaacatgagaaatatggaacagcaaaaaacataacaataccagacttaaggaggtgtgttactgcagctagtgctgccatcccactggtgaagcagaatgcctgatccgccttctcaagcttagccataaggctgaatatgtcctcaaaatcatgaaacaatcaagaaatgcattttttttcaccacagagtaaaaaacggatgagaaattgacctaacctttggagaacatcacgtgtagggttaccacttctagtgtaatcataaggtccattatcggttgctgaaggctgcaaattaacttgcaggagtaagtgtacttggaaatagacaagacaaagtgcaaattatgaaccaccataaacttaaaaggtataatttagttcttcacaaccaaattgaattgcagatattcccacactttttatcattcttagctgcatgtcatgattcttgtataactagagaatagagatcattagatcaattaagaatcatttacattatcaagaaagataaaaaagaaagcaccacgttcattttggaggcccaaaaattaacacattaaacggagaaaaagaaaaatatttacactgttagatcatggtgggtccaaatcataacagtggagattgattgatataattgtattaagaacaattatatctatagaaagaaatagaattctatctttaaaatctattgtatataaagtacaatggtgtcaatagaaatagaagctaaaatttgcatattggatcctattttgcttctgaaatctagctctgcgcaatttgcgcgggaaaatccactagttcatgtgattatctatccaaacattcaatagttgcattacagtggtatgcttaaggacagccaggacaaaatggcacaataaacaaatcaagatgccgtaatttgataattacaacggactcaaagggtctaaaaaactacaaaatcagaaaaccaattttgtatggccagcattcgcacacatcaacaaataggtgcattgaactattcacatttccacgaaattggatttgtcttccaaaatagataagttcaaaacagttgcctgctgccaatttccccataactgcctgactgactatccatatccttctccaaacatttcaaaatgaaaactagaatcctaaaatgttgaatccttacacaccacctaatacgaatcatcagctattcagacattaccgcaactcttcgtctaatatattgacgtgcaatcctttttgcatgttcacgaaaaaaaaaagacattaccgcaacctcatcacaagcattaacatgcataccaagcaaccgtacagccaagcaatgcgattacaaaacagcaattgtaagtgtatcactacattgacagaacagttgcggaggtataatcctcactggctgccaccatttctatccctaattacctgcttaaacgtggccgtctggtacagcggcgtgctcatagacccgaacccatcgaacgagttctcgaagctcgtcagtatcgtcgccacgctaggctccttcatctccacatctacacccccaaaagcaatcaccactcatcagttccaccaaaaccacaacaaaaaccccaaatcccacaaaatccccccacaaacccaccgaaatccggagcggcgacggcgcccagcgcctccgcgccgaccgcggacgcgctcaggtcgccgccgccgtgggagtcggcgatcgccgccggcgcctccatgcggcgagagagcgtgaggcgtgggtggtagctgaggcggaggaggggttgcgctgagctgccgctaaggttccgggaggggttcggggtggggcggaggtggaagaggcggccgagagaggtggggattgcggcggcggcggcggcggcggcggcggcgctcatggttggcgatgtgtcggaagcgggagtggattttgtttggtatcactgtcatgtcgctgcttattttaaaatgatctggtaattaattcttttgtaaatctttaggatttgacatacaaaatacaatgcgggtaattagttacctgatttgtttttgcgcaacgatgaatcagcatttttaatgtatttaaaattctgattcatcatttctccaaataataatcttgactcatcatttcgccaaaaaaatcataattaattaatacagaattactgaggattgagggttcataataccgagcttgccggttaccccgggtgcagtaacggtgcccgggctgtaatctcaccaaatttaaacaaaatttcaaaaaaatgattttttttaatattttttattttgattttcatggtttgtcgttgttaccacggctaccttgtcctcggaaattatagatttataaaagcatgttctttttgaaattgtgtgattgaaaaacaatgatcagatatgtagatcgaaattcgaaaactgtattaatgttctcaatttctctcatcaaagagtaaaaagaaaaaaaaaacagggtatgtagtatttgcgggttaaccaattagtgcattcataaatatggtatatctggactagcacctacaatgcattatccatatgcaaagttctgtaggtagggattttttttggtatatttgccactgaatcgattaatgatcgtatctctatgatctgtgaatgcattgtatatttatgtgcatacaatttatttacccttttcaaattaggaggttgcttcataacttttgtttcttacagaacttattatttttcataaaatacaagtcggatacatacacaccatactcactgccaccatagtaaaaaaacggaccaaaggtcgccccgatctggtcatcggttcacatgttcatcggtcaaaccgccggttttttattttattaatattatatttgatttgcattattttaaatatagaatcatcacaaaatggtgaaaatatgcataaataaactagtatttctattattatatggccacaacataaaaaaacaaatgtagtgtggtaacataatagattcataatgctatattgttaggacaaattaaaaatcggttcgatttttaaaaaacctctaccagttcatcggttttaataaaaaccgcctggttcactgttttttacaggtttgattgcaggggcggtctttttgttgaaccgagccaccaaggtcgccggttccgattttcccggttcaactgccggcccagcccggtttttttactatgactgccacacatttccacatgagttgaggaccctaacaaacgaaaccatgcgcagttcgcttcatagcatatttgtatgtgcatagctagctgattttttagtaaaaacaacgtatttgtatgtacatagttgtgtaacatacttgtgtaggagtagtttgtatatttaaagtgtataaactttatggtatatttatttggcaatgctccggtgtgctactggtacagtagaaataatttgaatcgttcattattaatggtaatttggtactttattaatacaatgattatgaataactttatcatttatatttttgcacgactagatcgatccgtggtcattcattgcactaacattgctcatattccatcagaaaagctaaaaaaggaggaaaaagagcttcatctgctaaatgacgattatactgactgcaccttctttttataataatgatcttccacgtttctactatcgataactgcagggtctttgtaggaagggtgctaggccccacacctttccattcgttagagttttgattaatagatctaaaccattcacacaattttttgctgatagtgagacgccaaagctaaggatcacataatttgtgtatgatgcgtaaaaagtgcaaagcattagtataggatctcgtccagattcaatgaatgcattgaggaaggaaagttttcctttgtggtaactggtaagtgataacaatgtccagattgggatggaataaatccatattacaactgatgaaccgaagctctcatgttcaaaagtctaccgaaacttgaaataccttagtatatatgtagattgtaaaatcaaatgtgtttttgattattattctatgatgaacaattaggcattggagattattggttttgttatttggaatttattcacgaagtggttttagagatgattggatttacaggtgatcgcaggattctatcattttatgtgaccggtcagaccgggctctggtagccggtcagactggcggtgatcgagcggtcggaccggccagcccgcggtctggccggccgacactgtgtcggtttcggtttcgggttgtttatttggatatccgagtttatttcatgattatgacttctagatggatactatacgtatgtaatactatagtttgctgctaatgagtcaaattggagatagcttggtctcggaatatggtttctttgtttattccatgtgtaggtgactcgatgtctcgggagagtatttgcggtgatggaccgggagtcggcttggggataagacgacgtccgtggtggtcaaagatcatgcgggatacttaggcaagagttgatgcacgtgattgatggagattccatatggcatacgatggaattattgtgtgcgtatgggatgcggagttaaatttggaatgagtccaaatttggtacgattggttatgtaaagtttatttcttgtactagtgggtttcctaaggtgtttaggactcctagtatgagtttggttcgtggctttaggctgcctacctcatgtataaatagagggggagcgtgaggcttccctgtatcgctttagagagcaatagagttgagttttgagttagggtttcgagtttagtcaaaatttttgtaaggagtgctgttggtgcactttgtaaacacagagagaatcaataaagtcgtcatccactttaagagttcttcgatttgtgtttaccaggtttcggcggtctaaccggtgatctaccggcggtcagaccggcagcaaacggcggtcagaccggcgggagcacggcggtcagaccggcggcgacgacagcaagcggcaggcgatctcgacggttagaccggtagatcaacaccggtcagaccaacggctacgcttcggtcaaactggctaatctacgtcggtcagactgatctcatcgaaattgagggtaacttttatttccgctaaaagttttcggtttttgggtataccaaccattcactcctcctctggttggtttggttcttgtgattcgatcctacaagtggtatcagagctttgttttcttctttggatttttatcgatctagagtttttgccatggctactcccgctaggttttcaactaagcctcatgttttcgatggaacggatttttctcattggtgtagtaggatgcaatcttatattatggct

SEQ ID NO: 79487 - DNA, 20649 bp, Oryza sativa
ggggagacggtggttggcgcgcgtgacgaggtaggtggaggagcggtggggcgcggcgcgggagagcgtgtggacgcggagcgcgtcgcgcggatttcgccgcgacgcgatcgcctcggcgggggttttggatgggccggagggggattgcggctcggctggcgtgtgggcccattttattattgggccggaacatgatcgtggctggctggcgtgcgggcctatgttaattgttcccgtgaaattttgtgtggtgggcccatgttaattatatgggatgggcttatgggatgatgggtggccccgtttagttgggaacggaacggggtggcagctgacgtgtgggcccattatgttcggcccatcagtgtggttctcaggagcgcacttgagcataaatttgacaggaaattttaaaagggaataaacctgcgatcttctatgtatgtactatttattttgtgatgttttttagctacgcaagtaggatctgttctcgctacattgtaatgtacatgccatttcttggagaaaagacaaaaagaattgtcagaaccatcatttcgcttattcgcggaataagcaaaacggtatatctgcaaacgaaaagtaatttgtgaataaaatttttatatacgtgttcttagcgatctaaaagcaaaggctgaaaaataaacttcgatgaaaaaaacctcaaaatcagcttcaaatttaaggttaaaaatttaaattttggctaataagtataagtataagcgaaaagatgagggcctgtaccttggactaaaatcaaatgcaaataacaaaaaaaaaacacaagagaactaaatgcatacactatcctttggattgctcagcagatatgagacattctcaatttgaccattaccaaatagaacaaaaaaattcatatacccagcaatttgtcaaatatgacagattccggggaacagataaaccaagaagaacaaacttggtagaaatgacacaaaaactctctatcatacgtgctaccaaagtaccaaattgcgatacgaattaggatatgcatttctatgaagttctgaaccaagccatgcacattgcctccaaaagaactgagtttataccttagccggcaatggcctcattgaaatggcaatgagatatggcagtgtattagccggcaaagatcgatgcatcttgtagagaaggagaaacagacttatattcagtgttgggaaactagtagaagcatcgtacattctttgcagaaactttcaggttccaagaacaactgatatgacaaaaggctgtttcttatctgaatttttaaaaacgaactattgatctgatacaaacggctagatgtgctaatatttgacgttattccaattgaatgaccatgtcacattcagcatttgtatcagtcatctatctagctatcactatgtctcgaaaacaattttacaaaaccattgacatagacaaacaattgcaatttggtggtctgaaaacgcaggataattgcctctttaagtgcacgtatttgtcaaagaaatcttgattaatacagttcccgtggcaataattcttgatcaatccacattggacccagctatcccatatagattattctgatcaaaattcaggacttcaagatatgtatttggacggtagcagttgcaaaatcctgtaacctgttggcctcttctccctggtttcacttgccttcaccaactagtatgttaaaaaattcttgtagaatccaaaagatcaaacaggaatatttggaaattctagagcttacctttttcaaatagctgtacactcggtcgtcccggcttagatttggtttatctaacttggatgataggacatgtacatttctttcagaagctcagaaacgtatgctgtcttatttctttctcattaccgaaccaaaaaaatattgtatttttgtaggaataccagaagatctgctaattttctattaaagtgaggaaggggtatggaaaagttcagttaatacagaaaaataaaagcaagaaaaaaagaacattatgtagtccaatcaggatttctgaacatttacctcaatgtactccagttagtgtctcataaacctgattgatcatgttttgcaactcaatatccacgatatttaattttcctataaggaattgttcgtaatcaatccaatcatccataaagaaaaaagcattaaacaacggagccttttccgcgaaacaagcttatcctttttctagtaaggtatcaatagaagtggcggtgcaatgcaaggcgaaattgcgtacaaaccttgatcattcaaatcaagatattttttcacaatcttatccaagatgagttcaattcaagatgtgagagcccccatgtcctttctcccaatcagcccccaccaatggccacagttcagccaacaaagcccttgtcacacccactatgattgagccaatttgtgcccacaaggaaagcaaaagagctgtaaagccccatgcagctagattgggtcgtttctggatcggcaggaccagttgagatcgagagttgagagtggtgtgctactaacttttcttggatcatgcatgatcttgtccaaattttgaaaggcaggtgtagcagatggccaacaaattgactcgtggtcaatcctttttctctgtctaaaccaatcagattcaccatccatggccagtagtagcctgacaagtgacaagcacattgctgggacaaattctccagtctccactatgcatggagcaaaattaattgcaagacaaacttaggatcccaaatattttgaggggatctgtacttttcctctcaagttaaattcatgacggaaatctccgttccaacatggtttacgtgggttttaaaatcttacttgcatgatgtacttaacgcttctcgataaacccataaccaaaaccaagttatcctttagaatccctaaattttatgctcagaatttcttttaccaacttaccggtctagagtgagtttaaggtttcaaccatgactcgtcccactgtggaaaaatctaattgttgtattctaattgttttctaatctattacactctcataaggtatacatagaagtaaataggggacaaagacttggagtacaatacaagtataagagtagatttatctctagcatactatctctaggattctatctctagaatatatcttatctctatatttatatttgtatttgacttttatctctaactaacatatttgtacttctaacacccactactcgtattgtaatttacacacccacttattacaaataagaatgcatccaaaaccaaaaccgtcctcttgtcgattttctcctagagatcagaaatctccaatcagaccgaaccactgcagccggcaagtatgaatgatcgatcaatcatccaagaatgcaaatgtaccaggctagacagcacgttggattcctagaaaacctttttggtgtttttagtaccattgcatgctcccctttgtcttccactgctcagtactgcactgcactgttaatcactccctccgtcccacaaagaatctatttttcaatttttgatacgactattcgtcttatttaaaaactttttatgattaatatttttattattgttagatgataaagcatgaatagtaatttatgcatgactattttgtaaaacaatttttgtaatttttttaaataagacgaacggtcaaacgtttgagacagaaaccgaaaaatagagtctatgtgggacgaagggagtacagtgttactgcttgccgaaatttaacctctccccggtcaaaacctgaccaaaattaaccgctctaactgctagcgaacagaaaacgaactgttcttttttctatctttcttttgcccgggcttaccgcgtcatcgtgcatggaaggtgatggagctcgagatcaagaatggcggtgaaaagggaaaagaaaaatggaggagaaattaaagaagctgaagcattctactccccaccaccaccgcccttatcttcttcctcctcctgctgctgctgctctgactcgatgcgtcgcccttggcgttttcccatttagtatttaggcagccatggtgtaggtggaggtggaggtggccggcagaaagcgccattgcccacctgcccacctcaggtctagccgggtagggtagggtagggtaggctcgtcgtcggcgaggcattccgccattgttgctgcttgcttgctttgccgggatggagatgaggcggtttcttggtgggctatgcttcttggctctgctgcggctgggcggcgccgcggaggccgtggtcggggtcgccggcgttgacgggcggcgcgccattgccgccaccgacgaggacttcgtgtgcgcgacgatggactggtggccgccggacaagtgcgactacggcacctgcagctggggcctcgcctccctcctcaacctggtcgagaatttctcgctccaaattctctccaaatttttctctcctcctcctcctccggtgaaattaatccaaactcacacgagctttgcatttgcaggatctctccaacaaaatcttgctcaatgccattcgaggtagtgtgcagcagtagctctcgtgctcgtgcttcttctccggcgacgtgatcggagtttaccttgttttttttttttttggcagccttctcgccgttgaagctgcggctgggcgggtcgctgcaggacaagctggtgtacggcaccggcgacggcggagggccgtgcgcgccgttcgtcaagaacacgtcggagatgttcggcttcacgcagggatgcctgcctctccaccggtgggacgagctcaacgccttcttccaaaaatccgggtaatcccaaattgtctagcctctgaatctgaaaaggaagttgtactgtatcttttttttttttagcacgagaattcgacgaaatttgctcaaattcgcagcgcgagaatcgtgttcgggctgaacgctctcaacggccgggttccgttgccggatgggtcgatgggagggccatgggattacaccaatgctgcatcgctgattcgttacaccgcgagcaagggttacaaaattcatggatgggagcttggtaagttcaaatcatcttgcaaatcgaatcgaccgtgcctcgaaatgtgctatctctgggtgctttttggtcagaaacaaagctgatttctcagttctgacgcatgctgtcaacatctgtttagtttaatgttcaggttaccaaacctaccaaataaagaacaggatgagaattcttgttctacctgcccttccatttctgctttcttttagcaaaagaatctttattagttagaagtacaaaaattcttcatgcaattcaaccaagttgattttggggaagatttgtactgtccttgcaggaaatgaactcagtggcagtggagttggaacaaaagttggggctgaccaatatgctgcagatgtgattgcactgaaatcactagttgacactatctaccaaggcaatccatcaaagccacttgttcttgctcctggaggtttctttgatgcaggctggtttactgaagttatagtcaaaaccaggccaaacctactgaatgtggtcacccatcacatctacaacttagggccaggtatgctcaccatgaactgctgataatttggtacatgaattggagtgtgaaagttctgaacaaacgcgatggattattcctggctgaaagttctgataatttggtcgccgcaggagtggacacacatctgattgagaagatcctgaatccatcttatcttgatggaatggtgagcacattcagcaatcttcaggggatactgaaatctgccgggacttcggctgtcgcatgggtcggagagtccggaggcgcgtacaacagcggccgccatcttgttaccgattcatttgtgttcagtttctggtaaaccaaaagcttctgaagtgcaaaaattgtagatatcaccaaagaggttgttctgaatttgtgtggttttcaggtttttggatcagcttgggatgtcagcaaagtatgacacgaagagttactgcagacaaagtttgattggtggcaactatggcctgctaaacaaagaaacattccaaccaaatcctgactattacaggtaactgatattcttgggctgttcttcagtaggtaaaaggcaactttcatatgaacaatttcctttgtatgatagtgcaaacaaagattttgatgcctctagcaaaagtttagaattatccttacacttggaaactagaagtagctacttaatggccaagataagaattggttccattgcatataatcttgcagaatcaagtgccaaacttgttgctttcatgacatttccccttacttttattcccctgcagcgctctactatggcatcgcctcatgggaaccaaagttctatctgcaacattcaatggcaccaacatgattcgcacttatgcgcattgcgcaaaagattctgtaagcaatccagaaaacccaatgcattttcatcagaacaatgaaaaaaaaaactcatctactaactgaatctatgctcaatctcttccttgcaagttcagccaggaataacactactgctgatcaacctcagtggcaacaccacaagccaagtttcagtgacaagtgaaggtgctcatgcaaacactgtgaagaagcatagcagaaagaccaggcatcttgcagctggatcaatgagagaagaataccatcttactgccaaagatggcagcttgcagagccaagtgatgctgctgaatggcagggcattggttgctgatgaaaatggggaaatccctaggctggagcctgtcaaagtggatgcagcacagccaatagctgtggctccttactccattgtgtttgctcacatacacaatttccctgcccctgcatgtagttagattagggcaagattgtttttatttttgggtgatttggtgtgattgttattgttgttataggaaaggtgaagttaggatgggtagctaagcttgcccatctcaagatgaagtaaagctgcaaggctgaaaagtttgtgattttttttttttggggttgttcaattgtgtaagattgggaaaaaaatgatatgatgaagaaaaggaaagggaaaagctctttcccattgaagatctttctgagatacaacctttttcaccccttgtttttctgagatgcaatctttcaacttttattttccctgagatgcaatctttcacttttgtttggatagaaagagcatgaaaagacaaatgagaaattatgtaagacagtatcaaactatcaatagaatgagaattctaggtaatcgactccaatttgagaatgtagaatttcatggctgctactgagtaggcaatcgactcaaaattgagaatgtagaatttcatggctgccactgagtaggataattcgtttgccccagccatgtgaacttgcaagttccaagttttaaagggtaagattctagccacccaattggagaaaatggcatttatatgtacgtgggcaatgctagaaagtcttatagtatgaaacggagggagtacattattgcaaaccagattttgatcagatgaagagatttaccaccagtaactaacatgcaacaatcatcatctcattgttcaagagttcaaacattatcgtcgtcatcatgggacgaggaaaatttgccagacacgcaccagagatgggagaacatctggactctggtctcttctaagtgaagctaacagtaaggctaaggtaacaactcccaagaggccaaagataagacaacagcaatcctgaaacaacatgagacccaaaaagaaacggtgcgggcgattcccaagcacaacgtacactggcagtcgttattcgtgatgtccgtcgaagatttcagcgctgctgccaatggtattatgttcttagaaccacttgaacagcagaccaccgtgtgtggcgaagaaaggcgcaaacacaagggactcgacggccatgagcttgatgaggatgttgagcgacgggcctgatgtgtccttgagggggtctccaatggtgtcaccgatcacggcggccttgtggcagtctgatcccttgggaccaagggtccgagcatgctcactggcaccagcctgaaataaaacagggagcaagttgatgtaaagttaagtctcgcgaaggataatgagttgcaaaacatgatcaatcaggattttctgaacatttacctcaatgtacttctttgcgttatcccatgcgccaccagtgttggaggccgagatggcgatctggagaagaggaagattatagatccattgaactagcaaactcgcacaagcacataatgagggagagagaacataatgccaacctgaactccggaaacaagagcaccagccagaacaccagacagggtctccacaccaaagagagttccgacgatgaggggggtgagcatcaccaaagcaccagggggaatcatctccttgatggaagcatcagtggagatcttgacgcaggtggcatagtcaggcttgccagttccctccattagcccaggaatggagttgaattgcctccgaacctcctcaaccatcttgagggcggcacttccaacactcttcatggtcatggcagagaaccagtacgggagcatggctccaacaatcaaaccgatgaagacctttggagacaggacatcaacaaccttcactccagctctgctgacgaaggcaccaaaaagtgcaagggacaccagagcagctgatccaatggcaaaaccctacaaaagaatataaaaggatcaaatcacagaaccaacataacagttcttcctaagcacccactaattctaatgcttaattaactaataatagcttgggaatgctcatcaagagtaagcacatgattgtaccttcccaatagcagcagttgtgttgccagcagcatcaagggcatcagttctctcacggattctgtggctcataccagccatctcggcaataccaccagcattgtcactgataggaccataagcatcaatggcaaggcctgttgcaatggtgcttagcatgccaagagcggcaacggctatgccgtacattgcagcaatagagaaactaacatatatgctgacagcaatagcaaaaattgggatgataactgatttgtatcccagagcaagaccaaatatgacattagtggcagcaccagttctgcaggaatctgcaacatcttgcacagggctgccaaaaagaagcagtagggattaaaacatgtaatgtaacaatggtgaaagacatcataattggaaactaataggtttcttacctgtatgcattgctagtgtagtactctgtcacaaaaccaatgatcagaccagcccacagaccaattgcaacgcagaagaacaagcccctgtgaaaccacagcaaattaatcagaaagaatacatttcacaaacaaataacaaaactagacaacatttcacaaacaaagaaagttagacaagtagtttaccagttggtaacttccttctgagcaccaaaattgaagatggtgaactttgctggaagggccaaccagctgattattgcaataccaacagtcatcaaagcagtggagatgatgagctgcttcttcagagcaggttcaatttctttcactgccttgatctcaaagaaatcagttgcaaagagtgtggtgatcaaacaaacaatgatgccaacagagctgacaagcagtgggtagcacatcccagtgaaatcatggttgattccaaaagatgagatagatgcaacaacaagagcagcacaggatgattcggcgtatgacccaaagagatctgatcccattccagcaatatcaccaacattgtcaccgacattgtcagcaatcacctgcaaaacaagaagaggaagttcagagagggaagatcatgaactataatagtcactacaatactgcgggactgatacgattatccccttaacttccctaaaataaaattaatagcctgacaaagagatgagaaaactcacagctgggttcctgggatcatcttcagggatgttcctctcaaccttgccaacaagatcagcacccacatcagcagccttagtgtaaatacctccaccaacccttccgaagagagccatggaagatccaccaagaccataaccagtgatagactcaaaaagaccttcccagtcatcaccataatacaacttaaatacattaatggcgatgtaaagaaccacaagaccacttgatgccagcaagaagcccataacagcaccagagcggaaagcaatgataaatgccttcccaacacccttccttgcttccagggtagttctggcattggcaaatgtggcgatcttcattccaaggtaaccagagaccaaagaggtgatcgctcccagcaagaaagatgcagtgctaaagagcgcgttgaaaagggcaggcttgcagtacttgtccttgctgtatgtgcaaggctggctctttgtactgaatccctcgactgaaccaaggaagaggaagatcacgacagcgaagattgacatgaagataccaacatattggtactccgtgaagagaaatgatgttgctcctgctcataaaaagaaggcaattgttacaaaaaaaatcatatcattcaacacgacttagtgtcagtataagcaaagttttgctaaattacattgcaattcccatacaaactatgaaaaataatacagaatattgatttgtcaaaccaatgcacatgacatgacactgaacaccataataagctttggtcggattttatcttctgacatcagcaaaaaatggaagaagagcatgtgcacatatatactagaaaaaaataagccgtaaaccacccgagagcaagtgacaagccccatgtccaaatcctagcagatattccagaagtagctcttcctgtgtccccatcacaatcaaagaaagaaggcatgagccaagattggtgacatacataaacaaaccgcactaatgggacacgcatctgaagagcattaagccatccatactgatgaagacagcaaattcataggtcatgtgctaagctgacacgttggtgacatatggcttggtatccttacgtttccagactagatctaccgggcaccagaagattggagcccaggtttacattaatgtaaaacttaagtcagcctaatactgactagatcaacttgttaagttgggacagacagatccctcacgcgccttccactgcagaatttgtactactactgaaagctacatctttcctacaaaaccgacacagggtaagagcaccgcttcaagcattaaaagaactcattactgaaccctcgatttagcccaactaatgtgcagatctaccgtcttggggcaaagaaaaatatttgccagcccccactcagtggcatagacaaaagtgaattctaacgaaaacaaaaaaagaaaacatatcaacacaggaggagcccccactagaaaaaatacagatttggggcaaaccaggagagactaaaatatcaggaaagcacatatttggacaaagtagcactatttggcagcccccacaaagaaaccaaaagccccaacgagaagatttggcttccatcgcctaaaacctccaatctttaacatcacttcagcggttcatctcggatttttcatgattcttcttcattcacaaagccatcttttttgaggagcttttggaagttttcccatcagatcgtcgttattgaaactaactaatcaagggagaatagaaccaaaaaacgaaccattttgcccctgcaatgtcgcgctcatcgacaaaatcatacgcccagatacgaaatgacttaagaatgatttaataatataagtaatccccacgaagaacgcgcgaaagccgcatcgtctcggccgaaacggccacgggaacgatcagatctagccgaaccaggcgacgcggccagatctgagagggagagagagattcaccttcggagatggcggtctggatctcgtggcacttgacgacgacgttgtggtcgttgagcccctcctcctcctcgatgaggtagtccccgtacccgccgttcttgctcccccccgacgccgcggccgccgccgcgtgcgccgggttgaccttcacccgcgcgacgagcagccactgcgcgacggcgaacgcgacgccgacggcggccgcgacggggatgaacacctcggtcccgagcgccgagaggatcgccatggcggcggcgcccaccacgaaaaccctaaccctactacggttgcaacggaggcgaggcggcggcggcggcggcggggaggaggtgacgcgtctctcgctctgcacactctcctgtgagctcgggagtcgcgttattatatagcggcgcgagtgaggtgaggtgaggtgaggtggcgatgcgaggagagagaaaggggagctggatttgatttgggaggtattataaggggttatatgtaatattgcctcaccatgccttgtgtggggagaaaattgatgagagatgtcactcttttttaaaaaacacatgggcctctttgaattaaaggatttatgtaggaatttcataggattcaaatcctatagaaattttttctatttagtcctttgattcaaaggattgaagcttttcaaatcctataaaattcctatggaatgtcacattgcatgtgaattttggaggaaatataacaagagctccaacctcttggaaaattttctttgagtctatattcatgcgtttttcctgcgctccaatcaaacggccttttgtgtgtttttcctgtgttttacaatcctctgttttacacttcaattcctatcagaatcatgtgtttttcctattcctccatttttttaaccttgtgattcaaaggggccctaaacgcgcagacgttcataacatccgtacgctcattgttatgaacacacacgtataacctattgtatctccgaacaaactaggtcagcatatcttgaaatatgagactgacgaagtcatgataggtacctcgctatcgacaggtatgtcaactaccattgaaagaataagatttaaacccgggtggattggtttcaccacaagtaacctaaccaattgagttgtgctcacttcgctatgagatgccactctttacgcgtggattcgatgaaaatgccaacacgcgcttctttgaaatgtggattttaaaacgaaggaataggaaaaaaaagtcatatgattttgataggaatatgaatgaaataaagaattataaaataaatacaagaatgatcatttaattagattgtaggaaaagtcgtaggtatcagataagagataggtttaaagtggaaattactaaggagttagaactcttgttaacttttctcctaaatctctataagaccatccattccataggaattttaaaataaaaagataaaatttaatcctttatttcaaataccttcgtaggaaattatcttgtgtgattaaaatcttccaagtttctaaagtttctagtataaattatagggttgcttagaatactcttgatatacactacattgtcattcttgataaacccacaattttgggaatacttaactatttactactttttagatgtgacaattaatcatttatcatctgaatctacatgtcatagatgtatgaggatctacatgttattgatatatacgtaagtgataaatgattaaacgtcaaatgtaagaatagcaaatggctaaatgtccctcaaatttaagggcccctttgaatcgtaggaatgaaaaaaggatgaataggaaaaacataagattctgataggaatgtaagtgtaaaacagaggattgcaaaatacagaaatgatcgtttgattggaccacatgaatcggatgagcgagatagactcaaaggatttttaccaagaggttggacctcttgctaaattttctccaaagtctatatacaataagccattccataggaattttgtaggatttgaaaaacttcaaccctttgaccataagaatgtcaacatagcgaatagtgctagtattttatcaattgcattatcaagtgtgctattttatcaaagtcacataaaaatggcatatcttttcccagtgcggggagttggaattaattattggagaatagtagggtgtgaagtgtaaggtttgcatcactgtacttttgtaattttgctggtgaggtggggtggaatttgtgcgcttttcttggggtccctggaggatgcaagtggggcccggaataaaatatctttctttttcactgatatgggaaagactagaagaattttcagatctactagtagtggcatgtttgcccttaaaatggagtgtagtacaaaattgctgttgaacattgccggtgaaattgtgaatgcttgtggcaggaagaaatgtgtgcgaaatgtacaaatctatggtttatcatgtataattatggccggtttggtttgaggcttaaattggtcttaccaatatttggcaatttcaatagtgtttagtgtctatttggtttgaaactaaattttggtatacctaagaaaataggccatttcaatagttaatttaggctattttgacttcaatccaaacacaactttacattgccaaaattagctatgccaaagcttgccaaaatttggcattgataaaaattggtaaggctaatttatgtcacaaaccaaaccagcccttaattttgcgctgggcctcattcttttctgttatatattatatattatgacgagtatattacttaagccctaaaaaatatagtaatatatgtttcttagataacattttaaaataacttttcaactttataatagttaatattaatatattcgtttgtacccggaaatattgtcacaaaatcatataatatattgttcagtcagatttaaaaaaactagaccattaatgtaatattggcaacaaaattgtctacaccccactctattgttccttgtatcagttagcttacggtttaacttaactgacgatccaacttatcaacgaccaaatcaaaatccaataagactctggatggtcagtactatttttccaccaaattcatacaaactactgtaaatccccctgaattacaaacagtacattctcaaatctcaacagtgaagttcagagcccctctcactcgattcgaaaggaaatcgcgcgtagctcggtcacagctaacgcgtggacgcggagacaaatccgattcgtctcaacttgaattggggccaggggcgttcggtccaactaacgatcgatcccccacactaacagcagcagcagcatgaccatccccttccatttctctccacgattagcccactgacaccacatgtacaaatctgcaattaattgtatatgattacccaacattatcaccttgagaaaaaactaacagctcttggctttacatatgttgtcaccttgaaccgtaatttacagcaaaatgtgtaatcctttcaaattcagacaatgttaattgatcttgatggttaaaggttaaaacctgacacaaacaactgggacagcgcagtactatgaattaagtaacctggatcaaattctcgttttgttcctttctctgaagccatgtagctatcctagtagtaaattaacagtagcgtatttggaggttagggagtacacgtcagagagtgttgccacgctggttagtttaaggattgctttcttttatagctgggcttttcggtgcactgatctaattgctttgatggggatctcctatcctacccacctcaccactgttgggtgatataattcagtggttgttgcatgaaatgcctttttttttggctctttgaatttgtattatattgtttgagaaaaaaaaagttggttaattagtcatattctactcattattctagaactgcattgtctatgcattttgttcagaaaatcttctcagttatggtacactcattcttctataaaaaaccaaaaacaaaagaaaaaaaacaagagtagatcctattcaatgacctctcaacaacaatgagcttcttctttaattacttttaatttttaatggattcataaaggataaccaaccaggttaaatatactgtcctgttactatcctttataaggccatcatagtatgaagataagatatttcatggacatccaagatgagcactcattaattagctagtccttttttcctttttggatgccttaatttccaagttaaaaggctgaaagcagtacgtgcttactaatcacgtctcaacaaccttaatctccatcacctctcttgaatctgcaacggatcggatctcatgtatatgttggcaccaaaattcagtccagcgtttccatcatatcccaactcacggaagtaggaatagctgcatcgcgtgatcgatcggtatcacaataattttgggatttttcattagttcttgggtcgaaagccattgcagcctcgtcacacctggctgtcacacacacacacacaacttgtgggaatcggaagaagaaatctctacagcaacacgggagatgggaaaaaaattgtcaggtcagtagatcaccgactgcaaagaaccaatgcaaggagagcgaagcgaccgacactttgcagcggcagagcacagcatctgatcgatcatgcggtcggtcgccggcgaatggatgccgtataattcgcgtggggtttttgacgccacatgtgagctatcggccgccgagacgaggacgagacgagacgaaacgagatcacgagacaccacatgattggtggcccggttgcatgcttgcacgccacgcggttggcaggcaggcgcacgccgggcggggcatgtgtgatccggccatttttccgaacgggaagtgaaacactgaaacagtgaaactactcccgtagtactctgttcaactgcacggtgtcatccgtccattggtgttttttttaaaaaaagacaatctttacctcgtatatattgatagagcagggaaaaaataaatataaattagtatttaccaggcataatcaaaatgaggcccggaaaagactttacggaattcctcccaaagcggtaagctctcttaggctagtcgcccctgtagtcatccaagtggccacttcttctttaattttggcgagaacggtcgttagtggttgcatcttgctccgaaagattcttacgttccgtttgcaccacagctcctaggagatgagaatcactagggtctttatgaccttaatcggattttgcatactgtgcgtaagcatgtaccaccactcttcgacggaggtgcaattgtcctaattttgaaggttaaggtgtaggcccgactatcttttaatctatctccatccaaattcgctaggagaatctacagtcctgccattggtgttggtattagaggttatgtctcgctgcaaaacgttaagaattatgaaactgaaaggagtaggattagacgtgttattacgtgactacgtgagtcgatcgatcaagtagctgactttgccaagttgccagccactcactcaccacttcgcaagcagcgggagaatgtggcgcggccaactacctcgaggctgcctgaatttgctgaagcaaagagcgcgcacatgcttgattcgaaattgctaaacttcatggacctaattcgtgggtgtacaatactaccagcctagctacgaaactgaaatgtaattaatcccaacatgccacgaattaataatgtactagtactactactatcattcattcaagcactactgttaggtgtaggttcaccaacaattttcaacagagatcggccggccaatcaaattcgtgtaaaatctcccgttgggagaggcgacgaaatactgcagctgcatccgcgccgtgacgcccgcggccggcacgctccccaccccaacacggcatgggcattcaagccttttttgctctcagcctgaccaccgcctgaccgtgtggggttgtggtaaagggcctgttcactttgatgccaaaaaaatctaactctaaaccaaaatttcggtatagttgtcaaaattttggcagaattttttatatagttacccaaatttggcagcaaactaaatgtagctacttttttggtaactttaccaaaatttggtaaggttgaaaatgacatcaaagtgaacaggcccaaaattgtcacaggtagggatgagaactgacaaaaaagaaacgcggatattagggaaggatctaaatatcaaacaataagaagggatggggcttcgaacccagatcgtctagcccaccaccttgtgaaactagtcggaagacctctgggtttttctcgagatgaaaacggaccgattcatgaacttacttgtataggtcaaataagtaataacccgtggattttcgtgccatgatccaacttatcgtatctagggatttaaggaggttgatccataattttatagatcaaattagtatgtaatccatgagtcaatccgtaggttactcactaatttttgcttataagcgggctccacgggttcacaggcttgcatttcgcaagcgccaacacagacatcgctgccaacttgcagaagctacacctatctgcacgtataccaactctgtttttttctgctgctgtccaacatgtccagccatgacgattgacgataggtagatggatcatgggatgtgttcttggtttggacgtctagccatgaagatgatgagagccaaggaaaaaaaatgccaaaaatggggagacgaatttcgtttgttcaggctccagtagttgcaggcatgcagagtagtgctgagtagcactagtgactagtgagtgagcgtatgatgatgtatttctgaacaaactcttaacaaccgtagaagactgtgtttagatttaaagtttgaatccaaacttcagtcctttttcatcacatcaacatgccatacatacacaacttttcaatcacatcatcttcaatttaaccaaaattcaaactttgcgctgaactaaatacagccgaagtcccagtcacatggatcctatttatgggtactagtactactagtagtgattagaagcaactttcttaaaaggtacggattagtaacacatcgtttgattagataagctgtcatggcatgcgtttcccacaatgtcacggatgggagcataaacaaatgccgtaatacctagctagtttatggtttatggttcccggcccgttgattaaaactcttgtggtggaggtgtcatctgcacatgatctgttcttccctcgcataaaatcagtatgtaatcactctctgctccatcagaattcagatctctctcctgcactacagctagatccaccatagtaggagcaaggatatagtagtagtactagtagtaagatggatggctagatccagtaacctcactgctccctccatgttcaaagctttgctgcaatttgtcccgacctatcccataattgacatataaaattttgcagagcagaggtgctgtctcccggtgcatttgcagcctcgtcaatgtcatgctagtataaagtcatgtactaatgttgcataaccaatcaccggtgttttacgacgttgatgatcgaccatagacgatgtttataaaatcgtttggagtgaggttgctgccaccccatgattttggtatatcgtggttctagaaactgaaaatattatcgcatgatatatcattattttaaaaactgaaaaagttacctcatgtgataataaccactataattgtacgattttataaacactgccatagactagtgtgtttgtgtccatccaagccttggaaaaattcttggatcctgccgtttcttttttttttccttttggtatttcttttacccgtccttaatacgtactccctccgtctcaaaaaaaagacaaaccctattccgtgtccaacgtttgaccgtccgtcttatttgaaaaattatgaaaaaaattaaaaaaataagtcacgcataaaatattaatcatgttttatcatataagacggacagtcaaacgttggcacgaaaacctagggtttatcttttttttttggaacggagggaactcattgctgaataattgcataggtttgtgtttgttggcgtcactgacgttggaggcacgcatgcacttgccttttatcctttttccccttcttttttgccgtgtcgtttcttttccgttccggcggctggttgcaaagggggctctgagcgagacagcgacattaccagtacccatatggccgtcacggacgtgtatttatcatcactggtgaaactgcccaacagcagcagtgccggatgcacgcactctagagttgctaccatctgttgacgcaggggcagggtatattccgcaggcaggtcgggttcacacctccaaggctccaaggagagaagggaagaggtgaaaaaaaaataattcagtaagagcaagtttaatagtatagcccactaatagctccaattcatctatagccaatataatagctaattcatacaatagttgtttaatatattatt

SEQ ID NO: 79488 - DNA, 20228 bp, Oryza sativa
tccaaaatcatttatattacgggacgaagaacgtagtttgactagttaggtttcttgtttgtggaacgaaccccacccagttgaagttctaaacttgacacgagtgctcgcatttatgactatttattcttttagtggtaggcaacgtacccatgatagtgaggagtccgtggtgactttatcaatctcaagatatgtgagcttagttttctggaggtgtgctcataggggtagggtgtgtgttcataggggtgagtggatgcgtgttagcgtgccgatgacaagtcatgtcacaacgctgttgatacgaaaaacacacactagcctgggagatctgcttagctccagtgcaggtccaagacgttgatgagatgcgggcgtgccagtcagtttgatcctgcaactgacaagatatgtaaacaagatatcaataagccgatcggctgacaagccgatgaagtaattccagccgataccgataccagccgatagcaatagggtttcgagctatcggctatgtgtttgatgtggggtctgacaattgatgtagataacaatataaagtcaatcagctgatgatgatataatataacaataatataatccagtagaaaccaatcggctaataatgatagagtaatcactgatccgaaggttaaagcatacatcggctggaggtctgatgtcataaaatccacaagattagataaacatgaaacctttgttgtcatcggctaaatccaacttatatgtatatgcaatccttataaaccgatgcaacgtctagtaacttatcggctagcaccccgataaaacactagcatgaacctatcggcttaacaagatttatattatcaacaacaatctagtaggtcgaacctaaccgatgcagcacgagattgtatacgataatctaatactcgatgagccgatagatctgtataatgtgatggatataacaaatctatttacaacagcattgtgattgtagagatatatcgactaagacagaagatcagacttaactaagacagttccaactaaaccgatgtgtctctaaacacaatgcaattagagatagaattgagatatcaggtaggcaaatatatcaaccaaacaagagcgatccaagagatcgaagcgatgcagccttgaacaacaccaacgtggccaatagattcaccagggccggcgaaacgtaggacttaccccttcgccggatatcgaactgaaccgatgcagccccacatcgggtgcctaattccgctggatgataattaaagacctcgggaaagagggtggcgatgcgccaagagtagttgtattgatctagagattgatagattatagtgaccctatgtgcacatatttatacccatgtgtagatactagtccttgtcggataagaaagaaactttcctaaagataaaaggaaaacataaattccttattggacactgaacacactttcctaaagataaaaggagactaacaaactactcctaattaatagataacttgccatgccgcatctcccttaaactcggactcttctggataaatttcctttaattgatccaactccaccaagaacacaattgctggcgatttgacgactcccatcggccgattccaagactctgaagccgatactgactctaggccaatgatgacttcgggcttacaaattctggcgttaacaagcgcacgcttgcatgcccatccatgtgtgctattaattaattaggctgtgtttagatccaggggtgaaaaattttggcgtgtcacatcggatatacgcacacatttgaagtattaagcgtagactaataacaaaacaaattacagagattccgcctgtaaactacaagatgaatttattaagcctaattaatctgtcattagcaaatatttactgtagcaccacattgtcaaatcatgaaggaattaggcttaaaagattcgtctcacaaattagtcgcaatttatgcaattagttattttttaagcatgtatttaataattcatggaggtatttaaacgttcgatgtgacatggtgaaaaatttcgaggtgggatctagacagagcattaatagtagtattaagtcatgaaatgacgtatggatgaattaaattcagtcgtcagacggcattaattaacaacactcccccgacgagcgtaataaaaatgcccgacattaattaattaacaatgtgcataactgtgtatatatatgcatgctaaaacagagcgaggccaattagccgtacgtacgtgatcggtgaagcttcatgcatgttactcatgacatgacatttcaaacctaattaaattgactgatgtgtcatgtacatgtgataaattgtgtataacataattaaattgactatggaagcagcagccaggggtgaaaatggggcgggtaagatcggatcacaatcagagttttcattactgtcggtaaccgcggttaccgccattaccgcggggtacggtaatagaaataccgcagtatcctccttaatttcaaataaatttagaaaataatttgaatttttaataaattttgcacggtttcgtacggtttttcacggttaccgcggtaaccgtgcttaccgccggggcgcggtaaccctggccccgatggtttaggaaaccctcatcacagcattctcatatcctaacctacatcttactttaaattcggaatcggatatgggtagtgtcggataacacatcactcatcccgtattctatcccatattaatttcttcgaatcggattcgggaacggatatttttttatgtccaactcatgaatatttaatgtaagaaaactattaaagtgctaaaaaagatacatcaaggaacaaattatataatattgcacgtgagctcataaaaaatagtgattaactaatcttttattatgtttataggtgaatttataatagattttcacatatgtttcataatatgtgacatgcgggcgaatacaacccttcctgtattctaatccatatattttttttacagatttgggttcgaactcggataatatcgggtatcccattttctctcccatattcctcccgcaggcctcggatcggttgggcgggcgggaaatatccgccccattttcaccccctagcagcagctactataccgatcgaccacatcacgtacttatacgtatatatatacgtacggacacaaatacaactatatatgcaagggcagatccagtgattcatctgtaaagtgtggacctacgtacgtatctacagcatgcacgtattcgtgtgtgtgtaataggtgttaatcgaaggacctatatatacgtaatactacttccatttcaggttataagactttttagctttgttcacattcatataaatattaataaatctaggcgcacatatatgtctagatttattaacatatatataaatgtgaacaatgctagatttattaacatatatattataatatgaaacggaggaagtaggagttatggtgcccatcggttggcttatttagggaataaaccaaacgacatatttgcaaacgaaaaataatttgtaaataaaacttttatatatgtattcttggcgagctaaaagcaaaggctgaaaaataaatttcgataaaaaacctcaaaaccaactcaaaatttagggttaaaaatttaaattttggctgataagcataaccacaatcgaaagatgataggtgacgaataaatttttgtcacgtgagcgtcacagattatgaactgtgacgaaattttatgtttttgtgatgtaaaagaagcgtcatttatcataagatttcttgtagtgaggccacatatataggttgtaaccgtgtcattgcatgatctaccgaccacacgagagtatactgcatgcatgcagacgatgtatacgtactcgtaaaggaagtcgtttaggacaatgtttaagtcaaacattgggaatataaattatgaataactctcaagttgttaagtttgaaaatataaaaattatatgaatagatttgtcttgaaaaatacttttataaaagtatacatatatcacttttcaataaatatttttatagaaataaaaagttaaaattctgttttggagaccgtgtcgctaaccaaaacaactttttttatgagtacggagggagtacacggaggttttaattaataatgacggtggttctggtattgtacgtgcatatgcatgagatatcagagtactgtacgtactaggtgagatgggcagatcgcaattaaaggtttggtttggtttaatttggtttggccctgtatacattatactagtttctgattattggaccaccctctgcatgcatatgcagctagcagttttttgcaatgcagatcgaggcagataatatttagagatgcagccactactgtacgttactagtactactgttgcccgtgtacgtgtgcatgggcaactcgttaaaaaccctagctttatgagatgatccaagataggccggctggccatcgatcactataccaatacaggcttagagctagcagggtacaataacataatgcaggtatgataatgcatgcaggcttatagctagataactattctgagctcttgaggggatgttccctggttgtttacatatcacttaaatagttatgaaaaaattttagaagatgtattaatatgtgatatatcactccacaaatatgcaacttaaaattcaactttcacatgtcacaacaaaaaaaaagaaattaatttacagctagttaacgtatatttatagtcaaattttattttttttcgttgcgatatgtagaagttgaattttaagttgtatgtttgtggagtgatatactacatgttaatgcatcttcttatttttaaaaaaaaattataactatttgagtggcatgcaagcaacgagtgaatgttctttccagagtgtaaaatttactcccgatatactagctcactattactacgctagtggataattagattttagctatatatccatggcatgatagtcaatagatatagctagtttttttttttgagtaatagatataggcatatagctagttggctttactattagctttgctatgttcggacatgttaacttttccttgaattcgtcatattggtgtacctaccccccctgcaggtaatctgcttatgttatgctctaactagtaaaacctgctttatttagatgagggaagaatcgtactacacatttgttggaaggacggacaacgataatcaatttctctctttttcaacatggccatggaaagttttttaagagtaggtaaaatagcaaactattaaccaactataaatatattttaataagataaaaaatgagagagaagagcagcgagctacagatctgtagccagctgtagcacggactccaagacgcaatatgtgtatgatatgtgggaccatatattaatacactacaagataattgagctattgccaccaaattattacagcaaaaaataattcgtagcaatatattatactattgcaatgataatttttctgtggcaaataattattttttattgcaacgatctacaatcgttgttttatttagtacttttgttgcaatagaaaatgagatatcgccacaaaaaatcgtactattgtaaaaaaatgttctatcaccacaattttaatttttgtagcaatttatatagtacatggtacttttcactattttttgttgccacgatcaacaaattcgttgcaataaaaaaaattgttatctcataatttaacttaattttttcatatggacacggattaagacaaattttatatagaaattatagctctcgacgagatctacaattttataggtgataactttttcatttgaaatcttttagatattcaaatatatgattcaaatctcagttaactaggctcaaatggaacgatatgtattttccaacagaattgatgcgtaggtgagttggtaaaggagagcacacctgaaggacaggtcttgggttcgaatcctatctaagacacaaaatcaaaaagataagtagataaatagataggatgatagattaatatttgtacttttaatttggtacgtaaaactaatgctacatatggagtggtggcaataatttttattacaacgatgcgaagtgttgcaatatgactttttgccacatccattccgtggcaacatctaaatttattaccacaaaataaaaatcgttgcaataacctattaccacgttgtttattaccacggctagcaacgatcttacaattgtggcaacatgtatctattgccacacttttagtattgatgccacgattttttttgtggcaacaaatgatttttctagtagtgatagtatagtaaacaactattgtataacttggctattaaattggctatagatgaattggagctagtagtgggctatactattaaaattgctctaatatgatttgacagacgtttctagggctcttattcgtccgaacacttgaccctgactccacattaacgactgtccttccacccaattccccacatccttgcatcgcatctccaacccctacctccacgcatccaagggtgctacaaggctacaacacttccaacttgtttagttccaaaataattcttcaaactttcaacttttccatcacttcaaaactttcctacacacacaaacttccaactttttcgtcatatatttctaatttcaaccaaactttcaatttaaccaaactttcaattttggtgtgacctgaacacagccgtcacatcgccaccaccagagttcaaaaacaaagctgggacgtaatcccgggcgtgacgagtaaaaatccaaaatttaaccattctgatttgccatgcgtgcatcgacgtgtttttcaagctactagctactagtagtacgatatgtttaatgttcaggcacagttcgaaatctgcatggatcgatatcgatgcattccatttaacatcgtatcgtcggaccaggtctcggttcgcagtggctgaaaaagcacgaggggttgtttagatttaggggtgtaaagttttaacgtgtcacatcggatattatataggatgtcgtatggggtatttggacactaataaaaaactaattacagaatccgtcagtaaaccgcgagacgaatttattaaacctaattaatccgtcgttagcaaatgtttactgtagcaccacattgttaaatcatggagtgattaggtataaaagattcgcgtcgcaaattagccgtaatctgtgtgtttagttattttttagtctatatttaatactttatgcaggtgttgaacgtttgatgtgataggatgtaaaagtttagagtgtgatctaagcaggccatgaatcactaacgaggcaacagcggcgtgcactgtggaatcgaccaattgatcgatcgatcataggtctcggtggatgatgaatttggattggcggccggcaaatcacgcatgtagcaaaaaggaggaagcagcgaaccaaaagtcggacacaggcatgtctgagatagatacaaattaacggccggtctttgtaggcagtcaacacctaacagtaggatcgatctaaacctatagatgtaaggagacatatatactgtgtatctaacgtacagtacactgtattacaacatatataaaactaggtgatacctcgcgctttgctgcgggattcatgtatgagtatatgttaaatatgtcgaaatgatgaaagttaatgttgagaaaataatgcgaggaagatgatttgacacatatttgttgatctctgtagtataatattatagatgatgtgttatgcttacatgagatttaaaataggctagaatagtaattggtagtaagtgaagatgtggcatgcttgtataggtttttaaatgggctagaatagtaatgctagtggatgatgatacggcatgtttgcatgttgaactttagcttctaataattatcagtgggtatcaattatatagaaagtatatatactactttcgtcttattaaaaaagcaacttcagactaggaacctacgttcagattcatgtttagaaattggttctacgttcagattcatgtttagaaattggttcttttataggacgcaagaagtatattggataacctccatcatcggtataagggtcgtatggtgtcagtgcggggggtgccgtcactattcagaaccttagaaattagagaccccaaatcttaattacatgaagcagtactaagcatacttaattagtgatatggttaaaatattaaagcccagaaggtccggagtatgacccagagctaaggccctgtttaaaatttttcaccctctcatattgaatgtttggacacatgcatagaatattaaatataaacgaaaaaataacaaattatacatattacgtgtaaattgcaagacgaatattttaagccctaattgctccatgatctgacaatatggtgctggtaatgatggattaattaggcttaataaattcatcttgtagtttacaggcggattctgtaatttgttttgttattagtttacgtttaatacttcaaatgtgtatccgtatattcgatatgacacgccaaaactttacacacgtgaatctagtcacaacctaaaagtggaacttaaagagtaatacctaaagctaaatcgattaccataatcacattttacaagtttttgtgatttgccatctgcctttctacgtaaaacagtcaatctcacctacttctagtagaaacattttacagttgggccgagtttagtttcaaatattttcttgaaacttccagctttttcatcacatcaaaacttttcaacacacgtaaacttttaacttttctatcacattattctagtttcaaccaaactttcaattttagcgtgaactaaacacaccgttggtagaagtaacagtgctagcttcccttcatggcttcatacaataccgttgattcctcggacccacttaccacaaacagaactatacagaacattaattactactctgtatttactactcggcccttaattactctgcgggcctccccagctctacaatttatgggctggcccatctgtctcccagatataagatgtgccccttgcaaaaagacattgatataagatggaccaaggtgacaaaacgaaaaattgaggctcagtgaactgaaaataatctggtgaactatgtcgattcctggttacattccctggcatatttacaacatgtagtatatatactggtctagctgagagtagcagattcaggagtcaaaagaccaggctctggtgaagtaattacaagtttacaacctcctatgataggacagccgaagagtgactcaagctgctttatacgcaaatgttggtcgcgactcttgttcctcatcttccgctaccatccaatctagcttagggccctaaagcaggaaaaggaagacataagggcctctgtgcatttatacaaaccgcataaaatgcagttgaagcatccagtattagctaattatgccaatcataagtcaacgaaataggtcacaaatatgaaatagataagcattacgagataatacataacggtgtgtttaaatgcagtacatatcatttgccaaatgtcaggggatagaatgagaaatttccttttgcttgatagtatagtcatatggtaggataactttagtccattaatgaaaatgcatacctttccctgacgaatgatggtagggtagcttcccgtcatatcaaccacagtagacgggtcagcaattctagtacctccatcgacaatgaaatcaaggccctgaaaatggaatcaccaattaatgaagcgtatcacgccaatttgtgtttcagcatgacccaggaatgggtacacaactgcacatcaaagtaacgcagaatggacgctatgatagttttactagacattccaagcagttcgttacaatttttacctttttacatataattacatcaatcatatttagtaaaaaatagcttcatgtgaaaatagccagcaactgcaactaacagagtcacacccacaattgttttgtaagtcaggactttttgcttcagttactaccatacaagccagagctgcagagcagatcatagagacaacttgtataaaaagcctagtagatgataactatgaaatctacaataacgggtcagcatgtactaataacaatatcacctataattctttataagaaaacaacaaatgacactctttaaaagatcaatacagtggaaagtgtaacgccattgatacacaaaagctcttttaataagatcataatgtgcatagtttctagtgtattgatggaagtgaagatatatacctgttgctcatatatatcagcaatgataaccgggtcaagtatccattcatcctctgacagagatttgacactgtaaatacaggaaaaggagtatgactatgagtatattgtttaagaaagaaaagttgataacacgacatctcgatcattatcaattcctcattcctttcaaacgctaaagaaacctaagctccagaaattactaaaaaaaagagagcacaagaaatctccgttcgtttttaactgacaagaccaaaacagagaggtacatatgcacgatatagtattgtgaatgttcaaacatgccagcagaaaaaataaagtactttctccaaactatttgatggtattataattcagcaatataacacagcatgtcactacatagagcaggaaacaaataaagtaaataaaaaaaggtagttacagcctagaccaaccttgtgcagatcaaaggctcatcaagattttgcaatattgcttcacatatggggtcatctggaagtcggacaccaacctgcctccttttcgcgtacctagtagatgatccatgccttatgcattgtttgggcaattccttggttgcaggtaaaataaaggtgtactgcacaggattaaataaacaggtcatttgtgaagtactacaaaactatggccaagggtgaaaagaagatatgcttacaggcccaggtattacacgcttgacagcacgaaatatgttagcttgcccttggttagtgcctcgaggaaatccggttgtgtaggtatcaatgtctcgtagcgagcggcacaagatgctgagaggctgcacaattcagaactggtataaatacacagaatctacaagtaggaggaactgctcccaggttgtgttttgcttgagaataatcatcaaactcgtacaaaaacattttttacgtctttgcatatcttgcctttgaatctccaatgcctttgatcctgaacaagataacaaatcacaaatccccgttagaactgaaatgcatgcttgcttctgttattcaacatactaacagatcaaaggctcagttgtacctgcgaaggcgctcgacagagtcattgttactgagatcacagacgatggagtagctggaaaaaatgatactataggtattatttatgttcccagtgcattatgcaaaacaataagagatggaaaattcaacagcacatttatgtatctaaatatggtcaaacaaaacgcacaacgaattaggaccaatgcaagctactactatcagtcttctataagttgattttgagtggaaatcaaggcttaaatcacaacatttgcagagaaactattcagagattgctgtgtctgcccattgacgagcatgtacttgaatgggcatgccatacttaatattgagtggaaatgaaaggcttaaatgacaacatttgcagataagttattcagatattgccggcgtctgcccattgccaagccaagcatacacttaaacgggtgcaccgtgggtatcaactatcaaccgcaattctgcaaagtcgcggaacgccacctcactaaactagacagtggcagactcctagacaagcaaagcaaccagacgaacacgcggtgagactgaaagcggtgggcgtacacggtgtcggtagggatgatgccgacggcgccgcggttgatgagttcgacgacgggctccagcttccacgcgtcctcgccggatggctccacctgcacccgcagcatcccggcatcccctctctacacacgcccccacccccaccaatcaccaccaccaccacaacacaagttcagcacactggagttagccgcgacggcgacgagcagcggatagagagagagagagagagagagtaccgtgaactggcgctgggaggcgtacttgagccgcttggggttgcgcttgtggagggcgacgacggcgaaggaggcgcggtggggaggaggcaccgcggggaggcggagctgcgaggaggaggaggaggaggcggcgcggcggaaggggaggcgcgaggaggacgcggcggcggcggcggcggtcgccgtggcggtggcggtggccatcggagagggtcggggttgggttgggttgtcgccgagtgggggaatccgccgcggtttatgccgttctcgtgatcgaatccacgggcggcgcgtgcgttgggccttgggccgcacaaggcttcactcagcccacgtatttttctcgtgggctctacggtgaagtccacgtattttaggaaggaatgaactatggaagaattttgtagaaagcttataggaattgtcagcatgaaaaaaattccaatggaaacctaattgtattttaggaattactgttcgagatgaacgtttcaaatctacaattttaaagaaaaaaattgcaaaaaaaaaacaccccaaatgtcatcccgagttgagtttaaggttatctccttgttgcatatactctttagaattcacattgatttgggattcctgctattgtttggtgttttttccctcttcatgcatactagtatgttgtattacctagcatattccttaatagaaatggccttaaacatatttatttcttagcaataccaatacttatattgaatctaacaaaaaaaacctaacaaatgtcgaaccctgcgaaacaaacgcaacaactcatctcttcgtcgcttcgatgtgtaagagtggagactcatgatcaccgtcgttcattgacgtgctgaacattatgacttttatgagtaggcatgcatctgcaacggcaatatcatcagccctgtctgatatgaatggcgaccacatctccttactcgtgagcgtatgtgggatttgcagctatgatgatgagctaagcatataggtaattgggtgaaaaagaagaaatagaaaaaacatagcatataaaaatgtacaacaaagaattacaaaagcacaggacaaccgttggaatgaccatttgattgggtcgcagaaaaaacattgaaatttgaggagagataaagaattaaaaaaaaatcttttcatgagattatacctcatgttaaatttcctctaaaatttgtatggaaagatacattccgaatttttatagggttcgtctctctttgattcaaaggactactagtctatcaaacaaaaaggcaaaggccctcttcgtttttgaattaaaatggcatatttttcaaactgctaaacggtatatttcgtgcgaaaactttctatatgaaagttattctaaaatataagattaatctatttttcaagtttgtaataattaaaactcaattaatcacatgttattaccatatcattttacgtgaaacacttaatcttcatcttcaggagattcaaacatcaccaaactctacctacgagttcgtagttaggattaaattttttttgggatggatagggtatgtaggaaaatttcatatagaaatgaaatcctctaaaattcatatgaatttcatttgaataaaggagcccgaattaggagagaacatttgtaacaaacggtcatataagagaaaataaactcagggttttttatgatttccccaaatttttgtaacgagattcgataaatttcgaaaaaaaatgtgtcgagccgcggctaggtgaaaattcgcatacatttcacattgccttacgaacacaaacaaaccctcccggcttgtttggcaacttgagagaagaggattgggaatttacacgagggaattgatggtgagattaagatgagaatttaattttttattacagtctcttgtttggtagaggtggtggaaattgatagggagtttagttgaagattagatcattaatgaaaacggatggctgagatttgtttagcgaagtaaatgagaaattccctcccaattacctgcccctacccagatattgaaaaagagggagttcatttctcaattccccatctctatcaaaaaaaatcctatatcctataaccaaacaaaatggttaatatagcatcatcctctgaaactcccaatccctcgtaaaaccccctccaaccgtcccaaaaccacaccaaaccacgccacgcccccctcctccgactctccggccaccgcccgccgccggccgccctagccggcgcaaatgccggagccgcaggccatcctcccgctccgcgcgctcccgccggacgcgccgctcccgcccccgctcccggcgccgttccactccccgtccacccccgccgccgccaccgccaccgccaccgccacgcccgccaccgccacagccacgccggccacgccccccaacccgcccgctccccccgccgcgccgccgcccaccttctcctcctcgcggcccccgcacccatgggagatcgccgcgcgcgcctggctcgagtccttccccgacggccgcccgcccaccgaggccgaggtcgacgcctacatcgacgtccaccgccccgagctcccctccctcccccgctcccagctccaccagcgcctcctcgccctccgcggcgaccaggtaacccccttctcctcgtgttacccacgggagattcgcacattgcttacgggattatcaggtgtatccatcgattttaagtcaaattggatcgattagcttgggcacttaaccataatggagattctggtagcgtctgggttgagcaattttttgtatcagtcaagtggagtctgtttgtgaatgttcagttgcttgattgctactagtcatggaacaggtctgtcaagtattaatgtatgttatcatgctagaaaggctgatggacttcagccctttgaaatggatctgttcagtgttgatatggctgatttgcctttctgaattgcagaatagctgaactgggacagattggaactgttagagctaattaaacatttgaactctttgcctctttggttaacgatgtttgtgagcttcctagggtttctatcatgtagaactgctgttcgccaggcctgttggatttagctgtttaccagatttttccaattgatcactgattcagactgacattttattttcacctatgcgtaggttttagatgcagaccaaagtgctttcccgtataggttccagcggactgatctttggaagcctgtgtacaagtggttggaatctcttgagctagagtcgctagttacatcaaaggagatatcggagtggcttacatcaaacccacagataatggacaggttggttgagaagcattcaaaatatcatttgatacactacacccagaggatgcacttgaagcttctgaagaagagggggaagataccgaaggtacataatttctgatccactttgatggggtagtgcaaaaaaatgttatattttcgctctatttcctaaaggtgttgctaagcaaaggataaaatatttatgattttttcataaaggcctatcaaaagttaattatattttctagtagttggtatcttcttattgctgaatgttctacccatatttagcacccgagtattcttccttttttcattttatctctgtttctattattattagcttacgatagcaattggaaagaacctatggcacaccgatatgcaatatagttatatggctgtaatgatacagtagtttccctaaagcaccaatttggcagttcagatgtatgtgtgtgtgtatttaaaagaaggaagttgataatgatgggtaagagttaagtgcagtcgataccgcacatgtaagattaaacattagtctgtaagtaggaaaaactgttccaatgttccatagagcatagcacaacttcacaaaccataacattatgcacctcaaagaaatagatatgtgcagtagtttgtgtctttggtgagggtggtggcagactggtggcttgagaatggtaattacagttagacactgggcctcaattagcgagattttatgtctattgtaccatatatttatatgctatttctacatacaaagatctggttatattgaggtgttgttatgtcactttggcggagcatttgtctatcatactaaggctgagttctttcccaaactttcccaattcacctccctcgttttccgcacgcacgcttttcaaactgctaaacggtgtgttttttgcaaaaattttctatacgaaagttgctttaaaaaatcatattattccactttttttaaaaaaaatagtaaataaattaatcataagaaaatgcgtcgctccgttttatgtgcgcccaacctcacctcccgaacacagcctaaagaatccagtctcctccaaaggagcacctattattattttacaatgaaggagcactaggtttttttttttcaattggattacttcagggctcaggcagttgcttttcaaggaattatttgaagtaattgtatctcatgtagcaatttgatgccagtttattgcatagactcatgcacactatattgcaatcatttttctattttcacaagtgtctcttttaaatatatcttgctacaccgttggttccttgcaaataattattttgtccttgctcttacaattcttgaattggcatctttgttgtcccttttctaagatgctaactttacattatttgcatttggtcaacagagtctacaactttctgcggctagagccacggtcccagcgagtgcttctccagttaccccacaagaaagcacaccaactgtgaggaaatctctacctccagtgacaggttatcctttcaatgattttgcatttgtttcttgaagtgacgttttctcatggtcttctaaataatacagcatcctatttgttttccaggtgttagtgcaagcagatttgtgggcggcgatgctcctataagggacaagaagatgtcactatccaaaaaaaaggaagctttccttaaatatgaactgtacgtcactcttagcttagctaaccctgggttatacctctgtttggtttttttaattgcttgcactaaaatattaatagtcgtgtttcagtttgacagacttgcagaatcagttgaccagtgtgttgttaaagaatcgccgcactgttgctattaaagaaacagattttcagaagccagagactaatgtaagtatgcaagaaggggctgctactgcaagcacatcaacccctacagaggtgacgaagatttattgcaacgaacagccaaaccaaggagcagcagacaatgaatttggccagaagagaaaaaggaaccctataattgtaacacctgcttggtgttatagtgaagctacaacaggtttgtcctttcgcttggtggaaagattaatcatctgttgttctatttgatacaagctgagaagtactacgtcctattggtccaacacattttctgtgaaagtttgatttgttattttgtgactatgctttcatatgtcctactggcatactgggatgcacctaggaattctggtgtgttgccattttcttttcacatgttcatccatggctacataaattgtattgaagctctgcattttcatcagctatatgattgcaatattttatatttgttgttaaaaaagaatctgtatcttcggtggtaacaggaactttgcagcaataacaaaaatatagtcaacatagaaatggtgcaacacgttacgatatgtggaaaggacatgttaatctgaaacagagagattgtattattcagcactcagcagttctctgttactttgaatctgtagttgtagtttccttatttttaatatcataattgatttttgttgattatttttattaggatggaattcacctgcggtccagtttgaaggtcctgctgtacatgtcgtgaaacaaagttacctatcttggtgtccgacttcatgtgcttatacgtcaagcgctccttctgctcagcctcatgacagggtatggatctcaaattaatttgcatggcactatgaagtccaaagagttgtcagctggcagtttgctctggtcttctttttggttatgcaatttcatttattcttttggtgtacatttacattgcattctccattatgcttttaagttttaattcaacacactattttctaatttttcttctagtatgcttccattggaaaaggtgaaaaaaacatactgtctacatctacatagcttggcaactttgacaggttgctatattgacatcatctggctggagttgtatgtatgtatgttgtgatgttgacaatattaacagtgctaaagttttatattggaaaatgcagaggtggggaaaattatttttgggttgtagtcttggatgcttccagaattgaaaaaacatttcaaaatgttgaatatccggtctacctttttcctatatctcattgaggccataaagaactcatatgcagctcacttagcatatttttgttggctctatacatgcattttcgtttaataccaaagcagaaagccaaaatctctttgcggaactaaattaacgtgattgatcgtctagctgtgcttgattatgataatttttttttaatctaacctatttatttgttttctattgtaatggctcagcaaggtgtacgcaaagttcttgatgtaaagtttcatccagaagggttgcctcagcttgtctcttgctctaatgaggttggtaatagaactgttcttggtgcattatctagtcaatattttctagcagagagcagaaatcttcgatccgaagaagaggcctggaaatgagtgtgatattctttctgcgtattttgatggttacctttgggacatcattacagtgtctccataattattggattgatttattcataaatcatagtgctattccattaattcaggcaccgaatgaattgttgcttttcaatcttctttctggaagagctactcaacttagaggccacaataccaaggtatgctgaatgagtaatttgtatatttactaaatattttctgggatactaaatccataaatacctttcctcctttttgcatttttgcttaaaaaatatatatgctatcctacctgtacctgggatagaaaaaactttatagagtttaagtccatgttcatggaaaatacaaatgatttgtttgtcaaatgttcaaccatgtctcttcaatccttacatcatgtctgtctgccctgcatatgtacttcagtaattaagtgaataatgatgtggtactactgcagcataagaaatttacagttacaataatcatgcacgtgcaacaaacatagctttcaattcacagaggctgattgtttgagagtttttttgtacttataggtttttatttgttgcttttgctatgctgattattttattttatttcctcagatccaggctaccgcatttgcggtgaaaggagcaagcatagtatcttgtggttctaatctattaaaggtaactcaagacttttattttctttcttcagttctaattgttgctgaaataattagcaggaaaacattatgttgattttttttttcatatatggactataggtatgggattgcattacagggtcttgcctctataccttaggtggtgacgatcacaattcagtgggacatactcaaaaaattaatgctatggctgttaataaatggcaatcctgtaagctaattcttttgtcagcctttctgtactgcatctagtagattcctacatctgttctgtttccgtatgacaggtgttagttttgaattgtgaactttctatgtgattgatctgataatacgtgggaaagaggcaaaaccttgacttaatgggttgtataggcca

SEQ ID NO: 79489 - DNA, 9716 bp, Oryza sativa
acgccttcctctgtgttaaccactaatagccatgcattatataattgaacacttaatgggtaactagagcacataatttttaagtaaacttcatggcaaaaaaatttgaatttcaataaaatgcattttttttctgtttaccaaacagagctttcattcagtatcaacacaaacagaggttgagcttaaacaacaactaaacaggtcgaacgtctaatatatgtaagcttataaacaagaagttgcatgtacctccatttagtacaataataacaagagtatgcttacgattactacatagtttcatgcaagattttctgaagaattattggaatgcattcatctgacagttaaaaatataagtctgtatgttgtagtgttactctgagtgatctctgttcatttccacaatacatcatggtgcaatatctctgaaccgagtgaaaggtaacattggagaacaggacaagcttttcggtgagagcaaagcacttgaattttagctgctgcagagggcaaatggctatctatctttggagacttcacctcctgctgtcttaattctgagaaacaacagcatgcatccgacaagaatcacattgtaattttgttgtaatgtacggcaatttgcagaaaaagaatggcagatagcatttctgaatcacacattcgtacaaaggctactctgggaattaacccccttttcttcattacttggggaatttcacagaattttgggggcaatgcataactcaagccacatggcatggaatgtctgccccccttgtcaacaattactggcttaaacaatccaggttgaataaagccaattaactaatgcttctaatcattggcacaaaatggcctcttagctagatgactggcatgtgtgggatttcaaagaagaaaaaaaaaagaaggaaatcccacactgcctcacagcacaagaaatttattctgtagcaatgcctgccatgttgaacaattccaggcatgctagactgctagtgctaggtgtgcagctctggagccaaaagaatgtccttccatgcctcatagaacatccaggtaatgccggaggtcggcatcaccttcagggagcttgcggcccatccgcggtaaagtcccttgatgccctcctcttggaacacctcagctaaggccgcgatcatgtggggcgggcatttcccttgcagggttccaaccataagccgcttcctcgccacttccagagggaagcttattgtacttgcagttagacctagaagatccaacatcaaaattgtgaaaagaggggtatactcaaatcaaatgctaaacttctcgtgaattatcccatttctcaggtttatcagaatttttgggaattaaattgttagctagtgaatttctaatcagcaggtgaagtggcactgaatgctaacctgaaagagctccaataatgagtagctcaggacggctcaaggacttctttttatgtgcacggcaataagaagtcttgatcgtctcatacatgaaatagtagcaggtgctataaggaagcatgccaactagtgttgggcagaggccagcatagagaccaccaataccatcagtttggtatatcttgttgaaggcaaggccgatacttggataagcctcacggttgacagtcaggcggtcctatgatagaacatcagagtatcagactgatgtacatggataaatggcttgccagcagaaagatataaaaaataatcagactcaagctacgtaaaactattttgaagtttgtcagtattttgcactactttgaacatagaactacaaaacctacagtttaattaaaaaggaaatatagcataaaacacatcatgaattccaattttcacagctggaaaagccaacagatagtttagaccattaatacgctgtagattatgaagtaccttaagaacctcaagaggatggcacactaaggtgctaactattccagcagccgcaccaccaacagcaattggagagagcaagtgaagtggtagctcaattttcaaattgccaatttgtatatttgggcacccatcttccttccatttctcttgtgcttctgtcatgctccttttgacacactcaaatgtgccaagctcaagtgcttgagttggaataatccgaagcatatttattgtattacctgcccagagtccttgccagccattttgttcgacgatctccacaaaactaccaaaaatgtgttttgatcctaccccaacaaccattcttgtcctgaaatcagacaccatgtaacataatgcataattcaacagcagtcgattgaaaatatttttttgtaaaacacacacacacacaaaaaaaatgaccactccttttttttattttgtgactaagcttaagcttatatgactatgagtactttgttagtaaatatccgttgttcataataaaagaaacaatcaagcaactactatattttgattctaacatttgaactaaatggtgcatacgactgttcaacaaagccgagaaacataatggtaaagaactgatctcaattatgtttataaggcataattctagaaatctcctcaagtgtaccaacaaaaaataagcaaagcaaaaaagaaaagcagctggtactccaagagcctacttaatcaccaagccaactaaaccatgtaatcagaaaagaagacaatgttacagaagtgagtaaatgaatgcagtgatggatgtaaagtgaatacctgatagtttctagaggagcaagaacagctttagtcatagcaccagctaatgccccactcacgaattctccaacttctctattcctcaggaaattctgcataagatatagtaatggttccaatgttaacaattaataacaacaccatgatttaaaacttacgaacaactttgggtagaatataaatcagtgaaagaactatttctggaagtgttaaccctgaatgcatccaaaaaaacacctacaagcgttttgatgtggtagagctgctatggagatgattgcaacgaacttttcatcacccactgcaaagctataaattcaatattttcccttttgaataggaaagaaagcggaagctatatgtccaattactgactgcacttgtttgtggatttctatgctataaacacctaaatggatctggaaggtacccgaggtattcaagtaattattttgtgttcggtcactacttcttgcctgtcatctgtatctaatccaaactacagcattaactttccaggacacatttccggtttgaaaatttgatcaaaattgtgagttcctaaactacagtgtgctgggtttgcctaattgtcagcacgaaagttcctccacagaggcaacatcactagtagtagggcaaatttgaattgttatttcacatgatccagtccaaattcggtgttggaaattggaaggagaaaaataagggataacaactaaaagaccactcttttctacacatggtagatttgagaagaccaagaaaaatctcaggtaccagatgacaaaattggtgtcttcgttgaaagaaacatctcatcctaccaaattctagaagactattctcaacccgatgaaaactaattgagttaatcagataacacacaaaaaaaagacttgccctactcacactaaaacagagctgatgatcgctgacagccagaagtttattgtcccacaatttccatatatatgaaatatataaaatactgtaaaactgtaaaagggttgttcaccgtgaataatgttttcggacagtttactcgtatttctatatgtggttgtcaagtatttggctcgacgtctatttctgaagaaatatctgcctacgatcaatacaaagaatactagtcagcagtcagcacgtgtcgtctactggcacatggcaatgggaaataggacgaacgcgttgaactaatcctaaataaatagtgccataataagtaacactagttcatcacttaactggataaacaagtagctaaagcaagctaaacaggggggcaaaaacgaggtcacagcttcctataacctgtacacttcagtacttcaccaaaacgagccaacagaaaccatttggaatgcgcctagatcaagaaaatactccaataagcatgaaagaaactttccgacaaaagcagatttttaacagtacattaactaataaaaattgcaacgtgtagctgagcctttatgtctttatcagaagtacacagatcaagattcaagagtacaccatcaacaaaattatccaaatagttaagcaattaaaaagttgaagtacttagacttgaaactggtacatcaaacagttaaaaagaagacttaaaatagagttgaaacgaataatgaaaatcaggagctgaaacttcaagaaagaaatatacggagtacttgacagcctgaaactgaagtactctgaacacagaaaagcatcaagccatcaacgaattagaactgttcgctagataaaacagctacagatcgaacatgaaaaaacccctccatgaatcagaacaaggtgtcccagttgcaaaatcctattccgacatcaacaatcaagcacagcaaatccagttttaaacaaaacaagcttgcaaatttgccgcccaaacagtctccaaaacgtccaatatcccactacccccagacgccaagatctgtgtccctccccttaccctgacggcggcgccgacgtccgggagcccgacggccacgtccccgacgaccttggcgacatcgaagtcgtcgtccttgggcaggcccacgactaacaagtcctccttgtacccgccgccggcgccggcgccgccgccgccagccacggcgccgacacggacgtccgcgaagccgatgctggcgagcgcgagcttcttgccgccgccgccgcgcgccaccccctcctcctccatgcccatggctactcgagaggaacgcaaatgcgcgaaaccgcagggggcaaaccgcaaaatggtggtggctcctctcctcgccgccgctcgtcgccgcttttggaggaaagggtggagaggagaggaaggaaggaaggaggaggatgctgacgtggcgaagcgcaagaatttttgtatagcggaatggagatcgaattcatactagtacgtatttatatactgtatttatcttgtatttttccctctttttctttcttgagtgaatattgctacgcgtgtttgtattgtgtgagatttttgcatgtttttgttgtgtttgttcatagtgggatgattcgaaatctcctgtattttttgggagtttctgacatcaatttgcacgtttgagaaatttgtgtggttgtatttttttttgtgtatttacaccaaggcttccttcttgaaactttcctgcattttggcattttggccgtttggaatggtggcctttttcttgagagagacctcgatgtcataaaaaaagtgttttttttcccttttcttttttttttgaaatgatttctcactcaccatgattgagagagaaaaaaataagggaaaaagcgagggctaaagtacaaaaaatgggtccttttcccgaggcgatgaccttttgggcccacaaattattattcccctgcaggatctagcttacacaggtgtgtgggcccaccacgcgtgctgggcccaccgtgatactggagtgataggcccatggacctatgttgtatgggccttacgtcagcacggcccagttgctggttttacctgcagatgcgagcagccgccggcggcggcggtcggagagcgagtggaggggaggatgctgtgccgccggcggcgcgtgggggcggcggtgcggtggctgtcgcggctggcgccgcccgcgccggcggaggcggacccggtggtggtccgcgtggacgggagcaacgtggcccgcctcgggaagcccaagcccggcccgaggccgcggcagctgctgtcgctgccgccgttcccgggcggcggggacggcgacccgctccccgggaggaaggcggcggcgccgcggcgggtgacggcggtcagctgggtgaagcactacctcgccgacgtgccgcaggaggtcgtgcaggcgcacttcaacaagaggctggtaaaatcgcacatggccttcaaactaatttttgacaaactctttgatgcaaagattgcaatctgttttcttcctagttagtgagacatattagaggaaaagattcatgttgttctcttgcttgaaatgctcttcgggagtgtggactctactactctagtggcgaaatgttgcttggttagtgctcatgtttaagtttttctgtgtttctgcccttgcaagaaaatagtatcatgatcttaatatgtcttattatgtatgattagtcacttttatttttctttaagttcacaattttccctcttgcaatcttttctctcagtttgatgtcatatgcagttggcactatatttagggattccttttttgtgtatgaagtgaaactatttgttccccgtttaccaggtttattccgagtgctcagatcatgaggtttcagttgagactattaagagccagaagcatcatctcaagaaggtatacaatagagatttcgttcctaaaatctgtttgtattctattgttctgcggtttgaatgaagtaaatatgctcagcagtttgttgcagatcaagcataatgatgtgatggagcctggcatgagaattcaccttcctgtgtcagtggcagagggcgagattaagaagcggtatgagaccattccaactgccacattgcatcccaataaagatgagattgaatacttgagaaggcttgtcatacacaaggtaaatttatggttgtgtgatgtattttcattggatgagttgtagcctacataattcatgtagtatgtgcggataaattatgtaggtcttctacctttgtaccattctataccacaacttggacatacagtattatgatatgaattaattaatggctgtttacatattatggtgcttttaaagtatcataagagtgctgttcacagttttattatgtctgtcaattattgaaaaatgtcagcttgacacaatttgagcactctgtttaattacgcagcttggcatgattttagtgtttattttttggagcttactgattttaattttcataattcagagtcataattgtatgcaaaattttgaaattacaggattctgccatacttgtacttaacaagcccccaaaagtgcccatgaagggaaatttgccagtgcataacagcatggatgtgcttgcagcagcagctctgtcatatggaaatgaagaaggtccaaaattggtgagctcaagagtctcttcatcattggtcagcatgtataaccataagcttgcactgaagatttttctcgatggattttgcgttttgaccacaggttcatcgactggacagagaaagtagtggtttgctgttgttcgggagaacaaaagaaagctttactcgattgcattggcttttcactagcgtcaatttagcaaaaacgaattctcaggtaatgaggcaaaatcaattcattgtgcttgtggttaagcaatttttttcatctaaacaacttttatttgctctctgttgttatttgcatgttaattccttaaattgttgacaaatattataggtatggaatgctgcctgtgaagcatacatgcagaggtattgggcattggtgattgggacccctaaagaaagagaagggattatttctgcacctctttcaaaggtgttcccatttacttagtattactctcagtaatgaaccacctaagcatgtaaaagaaaaaagaactgtttcctctctaagtctgagttttttagcttccaatctttttcacttaactttccactatgcagtaatcttagcacttgtgctacgagtaaccatggattggtcaagtcatatgtgccaagttacatgcataataacatatatttttcataaacaggtacttcttgatgatgggaaagccgagcgtgtcattctggcacatccatctggcatagatggtgcacaagaagctgtaacagcatatcgggtgatgggaccaaccattcatgggtgctcatggattgagctacgcccattgacaggccgaaagcatcaggtaccctcaactcaatattatgttctaatgtatcaagataattaagataatatatgttttgatattattagtggcttagtgctactgaatgcctgagttatttcacatgtatacatatgaaatgatgtttctttactgaaagaatcaatctttccgttttgctcctctgcagctccgagtacattgtgcagaagctctaggcacacccattgtcggagactacaagtacgggtggtttgtgcaccaaaggtggaagcagaatccccaaccagactttgaaccgtttactggggagccatacaagctgaggcgcccagaaggcttggaaatccagaagggcagtgttctctctaaagtccctctgctgcacctgcattgccgggaaatggtcatccccaacatcgcgaaattcctgagcagcaatggagaatggcatgaaaatggtgctccatggtccaaggagaagcccaatctcctcaggttcatcgcaccgatgcctgcacatatgaaaattagctggaatatcatgtcctcatatctggtgtaagagcatctccatgtgccattgttggtaacatcaagtttcattccatgtagttttactgagaagcagctaggcttctagttcattattttctagattctatagctacatcttctcacagtctgggtgagaatctgttctgcactgcttcgggagcctaagattttaggatataagctgccgctgctagaagctcagctcccccgaatagtgccatagctgtttttttcaggaatgccagattgtagcatctgaaccattgcaaaagaaacagttggtgtgaatatagatcaattttctaagagtatacatcctaccaaagttttaaatctttgtttcttttttgtaagcatgatgtaattctgaacaataattactgtacgttgcagcattttactactaatgaaatgccactgctagtctgctactaatctgatgagtaattccattccagtatcagtagttccaaaagatttggtttttcctgtgctgcttcctcaggtagacgccgagcaacttgtaatacgtccaccgccgctcgccgccggtggcctcgagcaacacctcggagctcgcgtggaatccccccttgccgaacgcctcgaacacgacggcgtccgtggtcacgacgggctcgccggcgcccaaccgatcgaacgcgaagttgaggttgcgggcgaggcggcgctccaggtaggcgtcgacgaagcaaccgtgcgtgacgaggtccggcgcgacgccgtcgcggcgcatgtggtcggcggtgaggtggaggtcccagaacatgcacatcttggagaaggcgacggcgcggaggttgaaggtggtgaggtccggcgtgaacccggcggcgaccatgtccaggaacgcgcgctgcagcgactttatcttgaagttggcggcgaaggagaggaggtagaggttccagagcaggttgccgccagcacggtggccgaggccgacgtcggtgacgaactccccgagcttgtagtacttgcggtgggagatgtac

SEQ ID NO: 79490 - DNA, 25675 bp, Oryza sativa
tatgcagcttcctagaggcatgccacatgggcctttgcttgtgtgtctttgacaaggttgcttccactaatatgagggccactttactaattgtgatttgccagaagtttttttttgcttttcaggagtgaaattagaagtagagaagattctattatctaacactattttgctgtcatgcatcatatatgtgctaaggttgatttcgtactttaatgaaagcttcggaagaaatgtatactaacatagaaagttttcgtaatgattgttcttctaaactagacattgttgtaatttaatatgattgtgcatggttgacaacttgatattatcaaatatttaccttattaggaaaatcatttgcacattacttcccagtctcaaggaaggttttccttttaaggaaacaaccttgttagttgttacttttataaatcggtgccaataaaggcattggttatcccagtaaaagataattctggccatttagattggttatggtaacaagtacatggtggcatactggcatatcaaacttgtaaaactgaaacagtttatggaagatttcatattagagtaacttctaaatcgaaatgtcttatgaaggatttcatgtttagtaattacgttttgagtcaaaggttcacacctcgtcgtagtagaaagaccttttccctctcttgttcccagatctctgtctttgccattaagagttctaccaggcctgcacttttatagttaatataacatatatgcactaacttttgactctattaggtagcttttatacttacctgggattttgttcacaatgattctagcacgctctgcacgcttcaaatgcttatgtgctcctctgcttatcgaataccttctctcatcctgcataaaacattgtagttagctcaacatgatgtagtcttggaattttggtatggcaggaggcaagtacggcaccctgctgtattcttctagccatctctcttcatcacatgaagccatccatttttcaaccttgtccattatttctttacgacttgttgcctcctcttttactttgtatatatattcatccattgtctttagtagatcatcatggtccacatcccctgttcatatttttcgcaagtactgttattagtcaatgttgtagaaagttctttgtactttaagattataatgaaatctaattggcatcacacacctgacattatcacatccattattttgttcatctctgtctggtaaggcatatccatgtgtgacttcttgcaaatttcctttatctcggtttgctttatcatgaagagctctttcattttgcttgcctttagatggtctagtcgctgaacttcagattcgatctgtttcatgcaatagtggaatgaaactactatatgagctttagacagtatattcttcagtatttcattttttggtttgtttaccttctgaattgtctcgagtgtgaggcttcctgggcctagcatactgcttcctgaagtcattgaatatatcttaatttcaccatatggcctgcgctcttccatgttagtatccagaatattccataattttgtcaatgctttcccaaggctatggagctgcatgttaatgcctacattagtgtaatatacatggtactgtagcagggtcaggcagctcggcttcctggcctaatgcccatgacatttgtgcaaacattttatgttcctgcgaccgttcatcgtatgcttgtaaattgtattaattgtaaccctgaaattttggtgtatatctattatatattattaaaactgggtgcaaaggagcccccatgcctgctagttcgaagcaaatatagctgcgcaaacatgtgatacattttgctaattctaaatttctaattattacatcggttcggtgcattatagaagtatttgcagaaggataagaaatcaccttgtccattctctggttcttctcttctttaagttgctggaccatggtgttgagcttgttaagaatgtcatcactgatgttttttgtttgttgatcatttgcgccatctaacaagcttgtgtggacattagagaggatctttgagggatccatccccataatctttgcgtagttgtgaatgagaaccttgtactcttcaactttgcacaggcgatcactctggagtaaataaaattccaataggtaaatcagataacagggagcctgaattgctctatatttgactctagaagaattcttctgtgcttctggtaccttttctcttttaagcctttgcagttcactttggtgctcctcgagtttctttagtgacagatcttcttgattcactgtgatggcttcattctcagggcgtcctgctatttcagaggcaattctttgtatctcagtttgaacctctctgaactgcttcagtctggcttcttttctcatctgcatttcttgcagggctggtgtgatggaattcagctgctcctttagcgtacctgtcattttctcaggctgcataaagaaatttcaggtcaggttcttgctgttttcttcaatttgattatacagtatggtctttgagatgagaatgatactcggcctgggaatgatctttctccaagagaaagaagtaggttggtaaattctgcctcggattcagccaacgcttgatgcagttgaatccgagacatatttgcactatttacttttctcctataaacttcctggcattcctgctctatctcttgaagtattctctctctttcattttcttcttgcccaacttcatcccatatcatctgaaatcgtttggagtatgataagccaaataatcttcagctgtcatgctacaaaactagatgttttgagaaagaggaatgtgtgcaccttcagttcttgaagcaggtaggcacatgaggactctggcagtgctgcacagggagcttttccagtcatcttgagtgatcccatcttctggaaatcccaaggcgaagattgctgggagcaatttagttggatgcactacttggttaggggatgcattggagcgcagagatgtgtgtaagtagtgagtgtgtggcagaaaaagctgggaaacacgttggtgctgcgagtggctttagatgctggatttgcttgcaagacaagtagcacatacgtggttggtgtcaccgagctgaaacacaaagcctgaagctttgtgaagaagagtcttgacagttgctttgctttgttgcttctttatcttttcattattagcccctatagtttcaagaagttgagcaggtatggtcttttcacgcattgtcatatagtataatgtaatggaaatgttaaacaaaaagatgagggttctaagtcattgtgatggctgctcttcatcttcagcaaattgaattctggagacgtccatctgtgctagagcttgcaactgaagcctgcagacaaatgggtgctactttattggacgtgtggattgtactgagaacgaaaccctacttcgtgaccgcttaaggtaacagatcaattgcttactggtaggcaattaactgcaggttaagaaataagaaggtaattctcgtctgcatgtgccagttattatttatagccacaggatatcagcttaagttgtttacgggaatttcagcttaggagcaattcggcgtcttgtgcattcgctaagtctaatggcgtggctttcattctcgtgttggtctgtcacatcgcattatgggactaattaatataagatgtataacaatgtcttatcatcatatcgtcaaatagcattaaggtgaaatagcataaatcatgagaataatatgtcagttgtgggctgccccggctatttcagggtttgcaagttgggcagttgagattggacaccccaagatcgcgaaaagaatttgcgccagtataatttgttttatgattacctttagcaagctcttaagatgaacttttgctacctttaaccagcacatgttttggtgctgaaatggtagtggtttttgctacataatgttgacatggtagcgaacttaacaaataaaaacaaaaaggggtaattgtgttcttgtccctatttacaactgcaattgtgattttacccttgtatttttaactttgtgattttaccctcactattttgaactgaagctcaggtatgctcctgttccgttagcagggcttaatggtgttaactgacaggtaaaaggacatctatgcccttgcagatttggcttgtgaggactttgtgttttggctgtgtttcacgattacagtagaaaacggaggtatgaacttgccctgcatgcttaattattttaacaacgaaatccaactttgtaactacacaagaaatgcgattctccagcatatgtttaaaaaaaatcaagggatttattaattaagaaacactatggaccgaggtatgaattcaatgcctcaatgcctgacgtatgaacttgccctgcatgtttaatcattttaacaatcaagggatttatgaatatgcaaacaagaaacactactctcatctctttctttcaacaacagaatagctttgttggtcctgtccagtttaggaaccaaccaatagtccaaggcagtaagaaaaataaaaactaaagggggagtgacaaagaagaaaaagtaaaagacaataaaactcaaatgttcctctcctcctctccttgctgttcttctcctccttgtcaccatcatgcctcaggcgagctcctcgcggccatgctaatggaggcaaggcagcctagctagctacgcatatgcagcagtacgtatgtactcgatcatctgctgtgcagcggttcgggcactatagccgaggccgatgccgacgagcccagtgaccaccacggcggacggcgacgggctagctcagcttgacatcgccatttcgcgccggcccagcctgcttcaccccgcgctcctccgcgacgaccgcgcgctcctcgctctcgctagcccgcgtgtgccgccaccgctcgcgagggttaggaatcggggacggaggtcggaatggggtacggggatcgggaggagtcagcagtggcttaggttgaaatttttgggatagagatgtctttttacattttgcaagtcaatttcttattttcttaaactcatttaatctgagtccacctaacagacgttaaacaggggcaaacagaccattcaacatcaaaaagtgagggcaaaatcacaaagtttaaaaagtaagggtaaaatcacaattgcaaataaaagtaggggcaagaatacaattgccctaaacaaaaaagtttgtgagaacaccatatcatcctgctacattcctcctcccttcccatctccatctcctgtgcagctaagcctgctaatgggttggatgggaatgggtctaatggattggttttcaatttggcttcacttggtatgggtgtaaacgggttgagatagctaatggattggatcggcttgggtgagggatggatgtgggttggattggattggtttttggacataagttttggattcaatttgtaggttagtctttttttttctcccttatagttgactgtttggttccacatatagatggccaaataggctgcctggcccggcatggcccatgcacgactaggcctgggttgaggctagtcgggccagtatggcctgaccaacacccaggccaggctgggactgcccatgggctgcacccctggcccaacaagactcgggctatgccgggctggcccaaaggcacgatagcccatcgtgcttctctattaaataaggatttttttctccctcatctctttgggctatgtgggccgggccgtcaagcctcgggccatatggccatctatagttccacgtatctgtcaatgcctaggtgcttactctctctgtttcattaaaaaaaaacttctaaatttaaatctggacatagggggtgtgcttgcacatatggacttcatattattgtcatttcaaccaaaatcaccttggttttaagtgattcggagggtgtccggcgtaaatagttgtttctataatttattcatttatgggcattgtgtggactcagaaattcagattgccaatcttattagacatttgtgcccgagcagctaagcaattttattgcacaacatcaccatccatgaggaagagaaacacgatcgagccaagcgatcgaccactaccacacctgatcgaaatggttgaagaagaagaaaaaaaataaaacccaactcgatcgaccgaccgatcactctttctcagctgccagcattttgacgatgaggcatcaactcatgcatcctaataatgatcctttcccttgtttcattcatcaggaggcgagcgtggtggggaggcagctgtcgtgcacgcagctgagcacgtcgcggtaatccctctccacggtgaaggagtcatacaccttcccatcgctgctcttcttgtactcgaacagcagcgacgagtggttgaacgcggtgagcttgacgaacccgaagtcccggtccctgaaaacgctccacttggggatcgccgaggtgtagtccgagaggtggctcccgccgccgccggcgacgacgaagatggtgccgttcatggtgccggagtagcggcgcctctcgccggagacgcactggctctggtacatcgggcacgtccgctcgtagttgtggacgtggccgaagaaggcgacgtcgacgcggtggcgctgccacagccgctgcaggctctccctcccttcgggctcctcgaaggagccctggtcggcgtaccaccagttggaggagtagcccagcacgcggtgcgccgcgaagatgagccacggctggtgcttccggtccaccgtcgacaggcactgctcgatgaacttgtactggtcggtaccctccctccagtcgtgctccgagtccgcgatgcagaaccggaacatcccgtagtccaccttgtacctgtgtcgtgttcgtgtatgcaccgaccagttcgacccaaaaagcttaatccgatagagcatatgatagaaaaaaaagtttaaactgataaagcatgatcgataaacaatttacaccagccagttcaaccaaaaaaagtttaagccgatggagcgatgatcaatatacaatttacatatgtcgagaattttgtggtctactcatcatacgtaaaatcgcaatcagtttacacaaaagcttaaactaatgaagcgggattggataaacaatttatcagcctcatcttttcacttatgcttatacttattagccaaaatttaaatttccaactttaaatttgaagttgattttagggtttttttcattggagtttatttttcagtttttacttttagatcgctaagaacacgtatataaaagttatattcacaaattaattttcttttgtaaatataccatttgacttattcacaggcttttgtggcctcctcaaacgtgaaatgaaatatatagaagtgggctacgaaacgtaccagaagttggctcgattctcggccgggtagtagtacatggtctctgccggaacgccgcactcgccgccggagtccttgacgtcgaagaaccctccggtgttgggccagtccctctcatggttaccgctgcatcaatcgacacgaaaatgccaaatgaatatgaacaaatgcctgaacatttgttgagtttgtctgaacattgcacaataacagatactaaccttgcaatcatgtagggcttcttggcggtgatgggggcgacctgggcggtgaactggtcccactgggagatgtagccattggcgtacggaagatcaccgatgtggaagacaatgtcgtagttgtccagatcctcgaccagcctgtccgtcgtgttcagagatcctggctggtagttggcgaactcgtttgatccgtctctctccgcctgaaattgcatatattcagatcaatcaattacggtattattacactatatatataacagctgtgcaatttgtcaaaatgcatgtcacataagaatttattccgttttatatggaggagtagtaatttctgattgatctagaggcaaatgttgatgaacggtttctgaacattcttgcaggctttgctccttcgtcagaaacgaaaattttcaccttgcccatgtcgccgaagacgatgatgcgttgcagcgagttctggccagggaagggtggcgcccggaaagtgtattgcttgccccagacaattgatccgtcagaaagttcatgcccaatcttgtagtagtacctgaaatcacatcatacgtacatacataccacagttctgaatatacaattgttcatcatgatttcacataattaattaactcttgctgctgcactaatcaccttgcaatgatcaaagattattttataatagtacatacaaaggtttcttttccctggatagaatagaatataaaagcataaaaaatatgcacgctttcctagctcctaaatagtaatgtgatttttcatatactttctacatataattttttaaaagtattattgtaaatcattttccaattttataatagtaaattcattcatttgtatacttaaatcattcatctatttcagcattccatactattcagtcctaaagatcgaacatgccacttactctttgttgggccacaggtctctcaggaaagctgtgtggatgaacccggggtctctccacccaacagtgcgtgccggctcacctgaaaagcatacaagctcactcacctttacaaatttctttttgttgatcgtttatttttgtacggcttaaccaataattcgtagaaagaaatggagcggtgtggtacataatgtgattatttttattatttattgaaatttttagttttaaattttaaaaataaactatcataatacttatttctaaaatctaaataatttttaccatgtcatctcgtctggcatgccactcgtagcagacatgacagctttataatgttattgtccatggtagcatgatgaaataatattaccacaccagccgaaccgatatggcgaaataacgatatcatgttagctagaccggcatgacagtattgtttcatcacgctaatctagttggcgtggctaaaagattttagtttggaaataagttttgagagagtttttcttagaaaaattaaaaagtttcagagagagagagagagagagagaaaatctaaatatgcgtgcgtgcgtaccgcacatgctgccgcggttgaaggtgagcgtgccggcggcggtgcgggttggagcggcggcgccggcgacgaccatgccccactcgacgaacgggtacgcctcgctgatgtcgtagccgctggtccatgtgacggtcatctcgtcgtacgacttgccctgcgccagccgagggtacaccggcgccttggggttcttgaacgatatcgcctccgacaccgccaccagcttaggctgcacatcaacaacaacgccgtcgatttcatctcatttcatcagagttcttcattacatatattgcgattaattgcatcaagattgattaattagttgcagttttaattagtttctttcttaattgggttaatcgatcataatatcacgtacgttttccaggccgccggtgaacagggcgaaggagaagtcgtagcgctggttgatgagctggaaccggatgctgcccttgccccagtacacgtagttcgccgagtagtttgcgaattgatactgcatgcgcaaatcaattgattcgttaatcatccataaacatgttcatcatcagttcatatgtgcagcaaccacttgttaagattcaggttcagagaaattgcagttaatccacctttattggtgcagtgcagagcagcggctcatccgggtatctggaaggattagggcaagaacccgagctgcacaagtgacacagatttaacagtttaaactaatttcacgatcaaaatgtgtccactgatgagtgaaggaaactaatttcacgatcaaatgtgtccactgatgagtaaaaggaactactttcacgatcaaaatgtggaaatttgaaaggattttgttgtaattagtagtacatgaaatcggccggagagaagacagcaatccagtcgtcagcggaagggtttgcccagccgtatttcaccgtgacccactctgtgtcttctccctgaagaacatgtagtgcattcagtatgccaaattgattgatgttgatgcaaatttgaaactcctatacttttatcaaaatttcacatgtttaattaccacttcttatttaaacttatttattgttcatcgtcttctttttttcaagtaagctagctgttacggagtagaatattatcaccggtggctaggggcggaggcaggcctagggtagctaaggcttaagcccttgaactgcctccaaaaacttgcttaaattttgttaattcaccatatagtatttttttttgaaaaattaatacttcattagtcgagttctatatttttagtcttctataattttttgactccgtcgccggtgacagtctgtacagcagacaaaaactccgaagggcccaactcgaagaattcatgctctatactcttttctcactaagcaacaggttacagtaggtaaaaaaaagttccatgctaaatgctcgttaattaaagaaacaaagtcaaggtgcgccacctctggttagttcttgcgtgacagcatcaaattaaaatgatcaaattaagtgtctcctacttgcacacgctgaccttgatgcttcatgctaagatgccttaatttattttttgctaagtgctaagataaatcacagagaaaataaacagaagtaccaaaaaaaatttatagtaaaatttccatatctttatatttttactggtttaaaaatcaatactgaaaaataaactacgattgagaaaaaaaaaactctattttacggaataaaaaattaatgaaaacttcttcaactcaactttaagttttaagatttaaattttggttgtggcctataaaccaacaacaaattaaatgatgagagatacggttagccgtgatctgtactacagtatacaacatacaatctgccgttagctgtacatgctgacaataactttttttcttaagaaaaaaataaacttttttttgtgccctactaggataataaatactatttgaacggtaggggtttgcatttaaaatgcaaaaaacaacgtgcacccgaccgttcccccatcgcgtgaattaacacaccacgacgaaatctatgctgttctgcatttctgctccggtggtcactcgtgtcgtctacctggcgatggcgaatccaccaacagtcgcacaactcagatattttcacttcttggtcagctacttcagttagctaaacacaccacgcatgcatatgaaatggggatataatatataggagtagatcgatttggattaatcagcttaacataatctgcgtgatctgagtgcaagaatttcgccagattctctgctccccggatctatatatttcaattcaggtctcaaattaaaacattaatgatctctctctctctctctctctctaaccgaccatggcggcggcggcggtggcgggcgtgtacctggtcgccgagcaacgccggcgtggcgctgacgaacgcggagccgtggaggtcgacggtggccttgtggacggcgatcttcgacagcggctggaacccttccagcgacgacgacggccgcgacgcgctcgccgccgccagcagcatcgccaccgccattgccacgcctcctcctcctcctctcttcctactaaccatggctagctttctacagctagctaatgcaatctaactacctctcctgcttccccagaagctggaatggatggatgattcgccatggccatgaccgtgtggtgatcatcttatacacgcacggcaggaagcagcttcagtgacaggtggggcccactcgtatggacctgcacgtcagtgacacacgttcccccttgacatgtgtgcatgtcagaggagcccgttacacacagtggactacactaaattatactaagccgttgattttttaattaacgtttgaccactcatcttatttaatttttttatgcaaatataaaattacttatatcatacttaaagaatatttgatgataaatcaagtcataataaaataaattataattacataaattttttgaataagacgaaaggtcaaacgtttatcaaaaagtcaaaggtgtcgtgcattaaaatacggatgtagtacttattaatcgtcggcgtggagcacgttacctgcttaatttggacattgatcgtcacctcttttgggattatttgtatttggggtctcttcaatcgtctcaacttgtcaatttgtttaaggctgctgaacaaacgcagatccaaatatggcataggcaggatctaaagtgggggaataggaatgatatttaactcttgcagcttacttggagtatgatatatactccctccgtttcaaaatatttgacaccgttgactttttagcacatgtttgaccgttcgtctaattaaaaaaaattgtaaaatatgtaaaactatatgtgtacatgaaagtatatttaacaatgaatcaaatgatataaaaagaataaataattacttaatttttttttgaataagacgaatggtcaaacatgtactaaaaagtcaacggtgtcaaacattttgaaacggaaggagtagttattattttattatacatcatgtgtagttgttttttaattacatgatgcacactcacagaaacaataaaaagcactcacatcatcacgagtgggacactttaccatacacttaggagtcgtacctaataataaactcgtgaatcacgctaaattcttattattagtccaagtagtatgttggaaaccgtgtctaaatgcatgtttatatttgtggatgcagacagtaatatataagtcatcaaataatatatctcaaaagcttacatcactagtatgtgcaagatattaatgttttacatgtataattgtataaatgatattaattggtttgaacgactagaaacgtgttaccacattaatcttagaaaaaaaaaggttcgcaccatttgcttctggtgagtctaaattatttttttttgcggggagtctaaattataatatttagatttgattggtatggttgtatatggaatataatcataattatgggaaaataagtaagaattgtcccaagagtttaatataaatctaatcatgtttttaaaatttagcttcacacaaaattgtgtgagaaaattcactagtttatatacatttgtgattaataacatataatgataaaatatctgtattaacaagttaatccgggttgatatctgaactataaatgaaaaggaagaaaacaaggagaaacaactttgacttctttgttactcctatagtttagtggtactaaatattttttaaaataacccacacaagatagtgcgaagttttatactgatatagcaggaaataaattataagattataatagtaacttaaaaaaaccaaacacgccaccaccacgagttgatagctcctagctcacacaacctagacctacaaggaggtcacaaacgcccgggcaaacaccggaactacacaacaccaacccaaccatcgctaagcgtgatcgattgtcgctagatctaaaaggaggtcgcaaacgccccactaaacaccgaaaccactcaaaaaattgtaaacgatctttcgattatccttttgcagaggggttgagaagaggaagtaggtgagagagaagattatcaagtcgttcctcgtgcgtaggtataaaatagtttgattctcttaattattatactttatatatattatccttatgtgctgaactcctcaattattgcagcaaatacgactgatttgggtcacttcaggtttggggcgttttttttgacaaattggtccttgcagaaaacttatttcgaaactagtccctaccaaaaactatatccagaaataggccgtcggatcagcgccaaagcggttggcgctgaggttgttcttatctgcgccaacgggactggcgctgacatcgcgccagcgtggcgggcgaggcgcgatgtggcagggcctcagcgccaatgcacttggcgctgacaccttgcacaccctaaatagaccgatgtgcgacaatgaattaacggtgtcgctcgtggtgcaacggtaagtttctttcttgctatatctgaggactagggttcgaatcccaggtcagccatttttgtttttttttaaaatcatcaatctacgtgcgtacatattaatgatgatctccattttcgtttttgtcttcaaatcttcaatgtactttttttgtttaaattaatttttattaaaaagaaatatcacatttagtacaaatttaaaaagtagaagaatggattaaaaaaagtttagagacaacttttaaaagaaatatcacttttttataaaaaagaaattagaagaatggatttaaaaaaacttgagttttttttttaaaaaataaacaacaagttgagaactaagggtaagttttattctaaaatgtcacgtgtttttttaaaattaaaacaacacttgagcttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaaaaagtttagtaaaaacataaaggagagggttcgaaccctggtcactgtaacgccaccgttcaaatacctaccactgagctaagccaaacctaattgttgcttttgcttttgcttttatttagccagtataaaggccagcgccgctgtagaacatatattctgatatttatatttatatatatttaaaaaacagagagcatcattaatcatttatatgtactaatgtacgcacgtagattgaagatttgaagaaaaaaaaagaacaaacaaggctgccgtgatagggagtcgaaccatggtgctagggtacacaagcaaatggtcataccattgtaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctcagcgccaaagaggttggcgctgagccgacggcctatttctagatatagtttttggtatggactagtttcgaaataagttttctataaggaccaatttgtcaaaaaaacggaggtttgggcgctcttttttgtgtagtttaattaatcgaaggtacagatcacgcctgcctttgttggtagtacaggcctatttagttcgcgaaataaaatttttttaagtgtcgcatcaatgtttgatcggatgtcggaaggagttttcggatacgaataaaaaactaatttcataacttgcctgaaaactgcgagacgaatcttttgagtctaagtaatctgtcattagcacatgtgggttactgtagcacttgtggctaatcatggactaattaggctcaaaagattcgtctcgtgatttcctccctaactgtgcaattagtttttttaatctatatttaatgctccatgcatgtgtcgaaagattcgatgtgatgtatttgggaaaaaaatttgggaactaaatcaggcctgcctccgtccgaaaataagtgcagtcgtgagtatctgtgtccaacgtttcactatccgtcttatttaataaaagtatgataaaattaaaaaaatcagtcacacataaaatattgttcatgcttttttatctaataaaaatattaatcataattttttttaaataaaacgaatagttaaatgttggatatgaattgaatagtgcaaaactgtagtacttatttggagggagggcgtactgctttatgcttcttgctagctcttgtcgttgttaaatgatgagagatacggttagctgatctgtactacatatacagcatacaatctgccgtacatgctgacaataactttttttcttaagaaaaaaaaagaaactattttttgtgcactactaggataataaatactatttgaacggtaagggtttaatttgttgcatttaaaatgcgaaacgacgtgccccatcgcgtgaattaacataccacgacgaaatctatgctgttatgcattctgctccgctaaaaaatgttcggtggtcattcgtcgtctacctggcgaaggcgaatcaaccaacagtcgcacaattcagatattattttcacttcttggtagtacttcagttagttgatttggattaatcagcttaatatagtctgtgtgctgtgagtgcaagaatttcgccagattctttgctccccggatcttcaggtctccaattaaaacaagtattttttcatgatctctctctgaaaccgaccatggcggcggcggcggtggcgggcgtgtacctggtcgccgagcaacgccggcgtggcgctgacgaacgcggagccgtggaggtcgacggtggccttgtggacggcgatcttcgacagcggctggaacccttccaacgacgacggctgcgacgcgctcgccgccgccgccgccgccgccagcagcatcgccaccgccattgccacggctcctcctcctctcttcctactacccatgggctagctttctacagctagctaatgcaatctaaccacctcgcctgcgtccccaagaagcaggaatggatggatgattcgccatggccatggccggagtgatcatcttatacacgcactgtaggaagcagcacaggtggggcccactcctgtggacccgcacgtcagtgtcacacgtcccccctcaacatatgtgcatgtcaggggagcacgttacacaccgtggactacacggtgagtttgaagaggtgattgagaagatacgtaaaacgagattaaccattagcgtatgattaattgagtactaactattttaaaaatggattaatatgattttttaaagcaactttcctataaaaattattttttacaaaaaacgtaccgtttagtagtttgggaagcgtgcatgcgaaaaacgaggtgttttctgacattggatacaggtatacacatttaaagtattaaacgtagactaataacaaaataaattatagattccgtatgtaaactgttatacgaatttattaagtataattaatccatcattagtaaatgtttacttagcaccacattatcaaatcatggcacaattaggcttaaaaaattcgtctcgcaatttacatataatctgtgtaattagtttttttatctatatttaatactccatgtatgtatccaaatatttgatgtgataggatgaaaagtttttgcgtgggaactaagcatgacctaaatctttataccgatttcaggattataattctagcatgttattgggccacgtggcaacctgataatttagctgaacaactccaaatatttttcacgtgtcaattatgtcgtgtcaataagatatctaccagaatctctcttagaaagctcctgtgatttgagagctccgggccaattgtcgaatggttaaccccggcacatgggattcacaaatttggttccctcttgcaagaggcagctgggtcatgccatacacgttgagtagggaggtgacgacccaatccgatagtatctgaaacggatggttgggctataaccttcctaagaaatacaagttctaagtaaaagatctaatctctgttttataacatgtagaagtagatttgttgtatcaacacatgaaaattatatcatttaattttaaaacaaaaaaaatgtacagatggatagcaaaccaaggatccatttctaaaataaaaaaaacataagaagatttaagcaccacatcggttatattaaagggtaatttaaaaccatgccattataattttgcaacctgcccccaattgtacctcccacaacgattttggagtcgcgtgttcgatcgccgtgctatccacgtcgccccgcgcgctggaaggcggaggggtttttcgagctggcaattttcaaaaaagaccttggttttatatataatttataataggtccctcactatatgtttctatgttctgtattcttatgtaaaagccctccacaacctactatatcttatacgaagaaggaaaaaatgggaaaatagggctgcgctctgataaacgaaaagtgaggggtttttctgaaaaaaagaaaatccctacccaccccaccccacccgaagccctagctgccactgttccctacctttcccctctccttctctcgctctctcctctttccttgcgacgggcgacagccgccgcccggtctttccctccacctggcttgcttctcctcgtcggcgatgatctctcccacaccacaacacgccatcctctgcttcctgctgtctcatcgcccctctcccactccgtcgcagcgtcgctgccccgacccgaggatgcaccaccttcagatctggcggtggctagggtttggcttggagtggtggcttgcagcaggccggacgcgggtgcgcagcggcggtgcagcagctggcgcagtcgcagcatgcgcaaggcagcaggtcgccggtgcggacgcgcggaggcagcgtcgacgcgcagcgtgcgggcgcagcagcagctagcaacagcccagtgcacgggcgcatggtcgcgtcctggtctgctactgctactctactcaagtgctcacatgctatttctaatcagctaatggcactaataagtgagtattccctatttctctgtagcatttaggtagactctggactctaatctatttatcttttgaatgagaaacagagccttctatttaatagttttttatttactgataaacttgcaagagagaagaaaacaacattgtttaactactttacaaacccaattgatgagagcacaaaccaaccaacaagattcgaatagattttgatcctaatgaaattcttttcagcacgatgaatgacaatggaggatatgttggtggatgcagttacatttgtttctttggtttaagatttgtttccgttgatttgtcactaatttgctactttgcatatatagctggctgctcacttgacttttggctaaggcctaaaagaatgcactttgtgctggcaaagtactccttttttttttcttttctatcatgtgaacatttaatttgacttgtaagaggaaggggaaaagaagggagtaagaggcagtttggtctcagaagaatgcacttttttctttaccctgcctcttacggtttgtggctgcaatggctagcagtgtatctggttcaagaagtcttatcgacgttgttccattcttctgatgaccacactggatctggtcatttgttgcatgatagaggatccatcatggtgtattcatgtagtcattatctccatgctttccttcatgctcagtgaatggagactgaagactgaaaactggttggtgctcttgcaggtgagattgaagatataaaattggtcagggctctggtaagctttgtaatggagaaattttgcagctctagctgtttgtttcatagcttctcaaattgctgggaaaaggtagagatgaaaacatgatggctagagctacagtgtggaccaatgatggcacttggagctgggtaaggaccattgatgatactagaatttagagatgtgtttgcgcatgctatactctacatgttttatatttccattgccttttttttccttttcttttttcatttcttcttgaaggtattgggtcagagagagccaacttaggttttagtgtacctttatattggtaaagtcacttggttattcaatctaggtccagagttcggaatctgaactacaccttatcttggctgtataattaatgggccccggtgagtaaatcgttgagttctgtaccgtgactaaagcgatgcagagtataagaaattcagaataaaaaattcagaaattccagtcataaattcagaatcagaaattcctaacctcgagacatggtcaaaactaattaacaagttttaaggaatcagtgttgaggttgtgttctgctcttaatgtttgttttaatccatttttgcagtacctgcgtgactattccatattttctgctactggatagaggcctttgcagagtacctccgtcggtatggaagaaaatgtattgttaccgagttatacggagtatttgttattccattggatatacggagtacaacttatctgtgactgtgaccacatgtgcataagttggtttaaaactttaaatgggcttccctgaagacatcgtgaggagtgctctgaagattgtcgacggcgacgagaacatgattcttgaaaagctctgctctgtctgaggccctatggtcgatatgaactgtaaattaaatccccatttgtaataagacaacagtgcttgctaatgctcattttctgtcttttcagtgtgccctttatgacacctgtaaaacctattagcttgaggcacacattatttttgttacaagtataatggttatgcccatgaataaatggaaatggtgtgaattgaggttaacaatatgatggttccaagagctttttgtttgtgattctttagccagctgatagggcgcgcaacgcgcgcggtaatgtctagtgtagactcaagaggcctcccactgtgctagattaccagtcacaaatccatttttggcatcaaagagaacatcacgtgatttttatttccctcgaaattgtagcattacaataggatagttaattgaaccaacgaaaaatatttattggtaaaaaaagggctactcaacgaagaaaaaaaatcaaatgaccatataaaagaaattaaatcacaaatcaatatagaaaaaaatattttttatatataatttagacatatgatgttgtgctctatgagctttggcattatcaaatattggcgcggtagataactgaaccaactgaaaagatatgccgttaaaaaaatgctagtagaatatataatgaaaaaagaaaatcaaatgacaatacaaacgaaatttaatcacaaatcaatatcgaaatcaaaatataatgacagtcttttgcaatttgcacagatggttgtatgctctataagctgattcatgcctttgcatgttctcaaatttctgtcatgccctaaataatattgacaaaagcaattgatttataattatctactaagggttaaaaaaatatttaattttcttcggttacacgaacaggctaactaaagacgtgtcaaatggctcgccaattttctactagtagttatacttaatcgtcggcgtagagcacgttacctgcttaatttggacattgattgtcacctctttttgggattatttgtatttggggtctcttcagtcgtctcaacttgtcaatttgttatggctcctgaacaaacgcagatccatatgtggcataggcaggatctattaagtggggagtagctaggaatctatactttctataacgttataatccactaactctaaaacttaacatgcaaccatgccacatcatcacccactaacaataattacatattcaacctcatacaaacacgcaagagcatcaacaatctatttaattctacaaattaacatgcaagcatattcaatcaccacctctcacatcatttccacaacaattttatgaatctctctatcatttttataatattgaatatatacttatcaacgtgttatacattaaagtgtgaatttcatttgtttcatgataaatattgataagccctgagatttgattattttttctttttactcctagctgaattgtaacaaaaaataatattaaaaattacttagtaattcccacagcaaagcgcggggaatcccctagtaatatttaactcttagggcatgttcaatggtagatattaatatagtttcttaaacaatacaagattatttagagaccgtgtctttacaattgttgagacgacaaaggttctaaccattaactcaaaaaatatttctcttgttaacattctttccatttttcttaccctcatgcaaccatattccatattatagtgattaagagtcgttgttaagctgttgttatgcataacgacgatattttatctctcctttttctctttcttccatgtcaacaagtattcctaattagcaatgctaagacaccactattgacaaccattgtacctggattcgccatcgccaggtagacgacgagtgaccaccggaccttttttttaagcaacgcggaatgcagaacattatatactccctccatcccaaaatataagcatttttggatttgacacagtcttcgagatgctactttgaccaacaatatctataaaactaagatgtaaataaaaagagctacatattatgatagtttgcttaatgataaatctagtaacattaatttaacatgattgatttttttcattttttattactccatctattccaaaatatagggtacaactacttttaaaaggtgtttcataatataaggcatacatgcatgcatgacaattaatagcacttcctctctcctaaattattatttttttaaatcctaaactcacaaaatgtttaaagagtaaattgcgtcgtggtacatgaacttgtgtggtgggtgcaaataggtacatcaacttataaattgttcatcctaatgtagtaacttgactagtccgtgcaaattgggccaaaattgtcaatgcaaaccaaatcgttgtaaaacatcacaaacagatggcataacagcttacatgtatgacatgttttggatatcttatttagaatgcaaagaaaaagataaattttatttttgatgcatagaatagaatttatttcatgtcttggaaaaaattatcctctgtataactcgtataatgtcgggaccatgaaaatttcgtccatgcgttagcctcctagaaaatttattttatttttcattgtcagacactccatttcaccgaaaacttattttaaaagtttatttccatggttggacactgataattatttcactttcatcaatctaaatattaaaaatatcaagtgaatagtgattacacattttatcattccaaattttgatgtgtaataaaatttactcgtcaatatgtaccatattagattaattttgcttgcagagatcgttttggcccaggttcgcacggacttggcaagttgttgtatcgaaatgagcaatttgtaaattgttgtacttatttacacccaccacgcaagtttatataccatgagcgcaatttactcatgtttaattttagggtttgttggaaccatgccaccctaattttgtaaaatttaagatatgccacacgtatttcaatgacacgtaggacccacatgagtcaatgacatgtgggtcagggtggcatatcacaaattttacaaaatttgtgtggcatggttcaaattttcccttaattttattgggtgcatgtattgtgttagttgagatgattaaaacacagaggtgataataattgtttcttagtctttgaatcaagggtggttgtgccttatattttaaaatggagggagtattaatagtcaaatttaaaaatgtttgacttgatactatattaaaaatacttagacagatgaagtagatttcgtcgtggtgtgttaatttacgggatgggggcacgatcgggtgcccgtcgttttgcactttaaatgcaacaacccctacagttcaaatactagtagtccacaaaggccctgattagattccaacttttccgtcacatcgaattttcctacacacacaaactttcaactttttcgtcacatagttctaatttcatcaaacttctaattttggcgtgaaactaaacacagcaaaaaaaaaaaagaagtttcttcttttttttaagaaaaaagttcttgtcagcatgtacggcagatcgtatgtgttggatctgtaggacagatcacggttaactgtatctctcatcatttgttgtgttggcttatactactccctacgccccggcccataacgtatgaagacgtcgtctacatcacagaaacaatcataagtactcacatcatcacgagtgggacactttaccatacacttagaagtcgtacctaataataaactcgtgaaccacgctaaatttttattaaaaacatacactcataatcagggccggctctgactttttggtggcctagtgcggaaaaaaaatgaaggccccattcaccataaaaatacaagataatatttaaaaactcattgttattaacgaatttcacactaataagtttaaaataccaaaaagaaatatctctagatcatttaaaacatttttttctaacagttctagatgcaaaatcagtaatgatactgttaataacaatctcatctagtagcatcttctcaatgcagaaaatagcatatcagacttggtaacatagtatacatattttggaggcccctaatttttggaggcccagtgtggtcgtaccgcccgcactgcctcagggccggccctgctcataatcattttatatgtatgtccttcattcataaatataaatatttttaaaataatgtcaagttaaacatttttagtcttaactaccaatggcaaaaagatcataaaggttgacaatataagaatgatattattagatttattgtgaaataaattattatcatatgcaacttttctatttaaaataatttatctttataaacattattagtcaaagtagtatattagaaaccgtgtctaaatgcatgtttatatttgtggatgcagacagtaatatatatatataagtcatcaaataatctcaaaagcttacatcactagctagtatatgcaagatattatgtgttacatgtataattgtataaatgacattaattgatttgaacgactagaaacctgttaccacattaatcgtagataaaaaaagttcacaccatttgcttctggtgagtctaaattataatatttagatttgattgatatggttgtatatggaatataatcataactatgggaaaataagtaagaattgtcccaagagtttaatataaaactaatcatgtttataaatttagcttcacacaaaattgtgcgagacagttcactagtttatatacattagtgattaataacatacaatgataaaatgtatgtattaacaaggagagaatcccttatataccactgaaaattagtctgatcccttatatgccattgaaaattggctcttcccttatatgccattgatccaaatttgcacaccctctcatgtcactcccgtcagttgaccgtgtgttgaccgttaattcttaaggaaaaaagacgtatttacccttctaagtatagggcatgcctaacaactcagagagggcaaatatatctttttttgatgaactactgta

SEQ ID NO: 79491 - DNA, 32031 bp, Oryza sativa
atactcgagatgatttacctaaaagatttgggatgtgtgggccaaaaggctagatttctgtcacactctggctcaaccttgagatgcagccgatcagaccaatccaggatctgatctttggtttgcacaggatcatttccatacccttctatctgaaaacgcttgccatcaatcaggttgctcagtttcttcttctcttcaactggctgccgaaaaaattccctcgcagcctcgatcacagcatcgatcagtgaggtctcaacgccatggttagaaacctaatcacacagactgttaattactttttttcgccgggtcggcaaacagccgacagagtatattaagatggaagagactgttaattactcgtcacaaaaagaataagagcttattccgtttataggattttgaataagatgtcacatgcactccattccttaggaattttttctcgagatctcacctcatgctaaaaattccatggaattaacttgtaagactacaatccttaggaatatggtagaatccattcctataaaacgaaagatgaatatagggaaaaaaatttctaaggattcgattcctacaataatcttatgaaaatattctaaaccgaatgagccctaaggtgcaagtgcaagttttttttaacccatcactagttcaaaatcatcatatactccgacaaaaaaataggtttaggctgtgtttagttcagcgtaaagtttgaattttggttaaaattagagatgatatgactgaaaagttatgtatgtatgacaggttgatgtgatgaaaaaggactgaagtttggatccaaactttggatctaaacacagccttagaatgaaagatgagaagctcaccaggaagaggccccagttctgcagagccgaccgcagcttggcagcctcgtcggcaccgtccgatcctgacagccggccgagatcgatggtcgggatgggctccggtatctcggcgccggcgagctggtcaccgccggcgaggtcttgcaggtaccggctcggtggctcctgcacgccggcggccagttcttgcactatgtttggcagcctccatggctcgtcagccattggaacttgttcgatcggttttgcttgctcacttgatggagcgaggtgatttcttgaattttggctttgcacgcttgcactaggcaagatggatagattgaaacagctagattttgaagtgtatatatatgtatagatgggattgtttcgtcattgtgtacatgatcatctatgaatagaccagctaccaaccacctgcactaacagaaaatatagtaaaagacaaatgcacatgatgagaaaatatattctttgacgaatcctttaaaggtcaacatattttggatgcaatggcttttttttttggtttttattcatatcgtaacactctgaattttcgtttcaaccaataaaatgacatcaaaatatagttataaaacattatagaaaatatctagtaccacggaagacattcgctagtcattactccgtaaaatttcacatcagaatttgatacacgaattaagggaaaaaagggataaattcaactgaaaaaatttctcagaaagacatgcaaaagaaaaggcaaaccgtttgcaaaattttttggagctacgcttgactcctagtggtgtgtgtggagtccacctcaagatcccgtttttgactcctagtcacgcacacacttattaattactccttctgtttttttaataagtgacaccattaacttatacatgtttaaccattcgtcttatttaaaaaatttatgtaaatgtataagatataaatcatgcttaaagtattttgagtggtaaaacaactaaaaaaataaattataattacgtattttttttaaataagacgaattgtcaaacatgtatccaaaagtcaacaacattgcctcttaaaaaacggagggagtagttaatgttttaagattaaaaaaatcaactaatgttttggcccattcaagctgattcttttcggcctaataggttttgggcctagaattttacacattttttaagcgaaaactaggcttccgcttccctccgaaagaaagagtagcccatttggtaaagctataacacctaaatttaactctaaactcatttatacctctcaagttcattttgtgagagcgctctagccagctccatatcttttttggtggtgttgaaaccgtttggttgggctccaactctaagagaggtggagctggaattggagctgtgccaaacagatccttaaaaaactatattccaaatcaaaacatgtttaaacataccaagttccattaccccttctttctataaagttaaaacccaaagctgcctcctcaattcgccacatcatcaacattatattagctgttcgatcaatatgtaaatcagatttacaccattggatccctcatctttttgcccagcatgcatggtaatcaccttgctccttccccttcccctcccttaatcacatgcattaatttacagcagaaaccgccaaatcaattgggacatgaggtgcgatggttaatacgattcatgtgcctcttgcgattctcttccaaaccttttaataagcccctttacaatccccactataaccaagtctcttcccctttgcatgaatcttttcatcatacgttcgattttatttggtaagcctgaatttaacagttattttgaccggattctatttgagtatacattatgattaatttgaaccaagcaggagcactatgaaagttttgtcaattggtttctctaaacttgaagaaagaatcactatcctatacatttactgttgtcttagtttcttaagaaaagattcatcatgcttgcagccaatacttatatgtcatatcactttaatttatttgaacaattaggaatgatacaaaggattgctatatagctgtcctgacatagcgagaagcagcttaacttgctcggtatgtattttgtttttaggttcaaacaatacaatctaattgttcatactaatatgcatatttacatatgttctcaaatgtgcccgcaacgaagctcggggtttcatctagttattagaaagctatattccaccgatccaacaccgttacgacaacaatctcattctgacatcttgacagtgtcgatgactcgtgtccctcttgcaaaagtctcgtagaagccacttaagtagtccttgatcttcatcttggcatactgcctcggcctcttctcatcgtccaccagctccggcgccggctccagctccttctccggatccagcgcgtagaacatcaccaccgacactcgctccctctcggcgttcgtcaccaccctatgcaccgggctctttaacaacccattgctcattatctgcatcccagaataggtgtctgttagtcatatctttttagataatggaaatgatttacatctccgacctctgctacttagtcggactaattccctaaaagatcaaatataatcagacgtgtaaatgatgatgtactcaaaattgaagctttacaggtctactttacgtgcaattcagattgttgttcagatctcccaaatctctgatccctccaaagatttcttcaggagaagataaaaggaatcatgatatactttaggaatcatggtagaatacttttggaacaccgtaatattttggtttgggttacatgggtgcagtatccttggataaacaaccactaacaagtactccctccgtttcacaatgtaagactttctagcattgcccacatacatatagatgttaatgaatctaaatacatacatatgtctagatatatgtgcgcaatgctagaaagttttacattgtgaaacggatggagtaaatgtatatatacctccattccatcccccatgttgatgagcagagcattggggacgacgggcacatcgtaccagacgccttgcctcagcacctgaagcccactgacggtgtcgtcgacggagacgacggtgatcaccgagccgtcggagtgtggcttcaggcccaacacatcctccggcctcaggcagcgagggtagtagttgaacctcgcgtacgtcgtggcgtcctcgtcgaacatgtcgacgaagtagccctctcgcaggccgagcagcctggccaatctggcgagcacaaggctggtgatctccctgcacctcatagtgtactcatgcagaacatctctgtataaaagaaacaggaaatttcagacaaatgtactggcagaacttgacagattttaagttcttaatcatgcgtgtagattgcagagtgaacaatggattaatcaaggttaggaagattcagtgcctgaaagaaggaggctgtgttggccagaggctatgggctatccgggactcaggctcaacgatgtggtagaaccggtcgcaccagttcaggatctgtttctctgacacgaccatgtcgttgccgtacccttcgatcctgaaatccttgccgttcaccaggttggagtacttctgcttctcttccagtgggagcttgtagaatcctcttgtcacattgatcatctcactgagaatgctcccctccattatagtaccaaataaccctgcaccttatagtaccataggtacccaaaaaaaaaaagtaatactcaatccgtttcagattataagtcattttgactttggttaaagaaaaacgtactccaaattaaactaaatttgtagaaaaaaatagtaatatattcaacacaagataactatattataaaaatatattcaattatagatttaatgaaaataatttgatgttataatattaccaaaattgtctataaatttaatcaaatttggaacagtttgactttaactaaagtcaaaataacttataatatgaaacgaatgcagtggtacttttatttaccaggaagaggccccagtcctctaaggcggagcgtagcttggcaagctcgccggcgctgtcttcaccattggaggcagacagccggctgaggtcgacgacggggatgggctcaggcatgtcggagccggcgatggcagggcggtctttctcgccgaccatgtactggctcggcggctcatggacgccggcggcgagctcctgcacaatcggcggtatcttgacaatgttccagtggtggccgtcagccatggttgtctgaacgcgcagtgcttctgttcagtcaggtgattcctagccagccggtttttatcttatttcggcattgttttgtggccatggatgatgacagagtgaaattggtcagggtttagtcaagatgaaagattttatgtaaacaagttggtaggtcagggatgtgggaagacatggtagtgccactcattagtcagagaggatcaaacacacggtccttgtcatgatagacacaggaacggacccatcgaataagcgaaacggtatatttgcaaacgaatagtaatttgtgaataaaacttttatatatgtatttttaacaatctaaaataaaagcaaaggttgaaaaataaacttcaataaaaaacctcaaaatcaactccaatttaagattgaaaaatttaaaatttggctaataagcataagcataagcataagaaaaagacactccggcagtaatatggtatgggtcgttgagctttacatcactgtcaaatgtttgtctgccgagcccattggccttgttcggcagccagttttgctgcagctgctgtggctgcagcagttgaaaatcgctgtagcgtgctgcgtgcagccgtagctgctgccaaaaaatctctttcgaacacacccattataaaaatctctttcgaacacacccattatcagcggggagattttgcagagacatgcaacaattactcccccctcccaattttattttacttactacctccgtcctaaattagtagtcgctttaacttttttttttgcaacgtttgactattcgtcttatttgaaaaattagtgcaaatgtaaaacatgataagtcattaaagtacttttgataataaagcaagtcacaaacaaaataaataataattccataatttttttgaataagacgaatgatcaaacattacaacaaaaactcaaagctaaactaggaatcacggcaaaatacattgctaccctcattatttacattctaattatctttcttaaagcaagcattaaaattttcttgtgagagtactggtactaatatggctatatcgataaaagtaggaaaaaaaacatatccaatgtagttaatagtgtaattacattacaattatacaataattacaatataataacactataatattaataatgtctaattacaataccattaataatattatagttacatttgaaagttttttgttaaaaaaaacttgcgacatgcttttagcaattccctcaaggaaaaaaacatatttattttcccaggaatacttgctactgaaagctgctgagcttgcaacaatcatgctactagtacaaatcagatcttcagggagtcgatgtatctctctcgtcgagagaattttccaatgatcccagccctgaactctccgacgctcactttcctgtatcttgcaggccgattctcatccagcaaaccagccgccggcccaatatctttctcatcattcacactgtaaaacatggccagtgagatcctctccctctcggcgtttgtcaccaccctgtgcactgggctcctgaagatgccattgcacaatacctgcacataaattttgcatccaaatatgcatcaggattcagaaacctgggtttatcatcatattacagatgtctctgcagattcagagagaaagtgttttggatgctagatgccaattacctccatggtgtcacctaagttgatcagcaatgtgttgggagtgacctgaacattgtaccacttgccatccctctgaatttgcaggccaccgacatcttcgtcgacgagaagaatcgtaaagagggagccgtcggagtgaggcctgacgccgaacacaaggtcaggccttggacagggagggtagtagttgaatcttgcaagtgcaggagctttgttgagtcggtcgaagaagtaatcctcatcaagcccaagaagcttggacatagcctgaacgatatcgtctcttattcttttggttcttgatgcgtactcgttcagaacatccctgcagaagaaaaggctctctaatagctcagtaaaaccatttctcgatacatcgtcaagttattctttctgaattcagacaacaattcttgttactttgttagtaatacatgaacaataaaaacaccatcttttgcaccaaaaaaaaagagtaggaagaaattcagacgtgtgtaaactggaaagtaaaacatcgatcactgtaaggtgagtaggtgacctgaaagattcaggatggtcaggccagaaggcaagatttcgctcctccttgggttcaactctgagaaacagccgatcagaccagtccaggatctgatcttgggttaccacccggtcagttccatacccttccacctggaagttcttgccgtcgatcaagttgctgaattttcgcttccgttcgatcggttggttgaagaactctcttgccaagttcaacacatcatccatcagagaggtttctactccatggttggtaagctggatcacacacagccaggaaaattggagaaattgatacaaagtagcaagttttttattaagcaaagtaggatcactgcgttagtagctgaccaggaagaagccccaattctgcagagccgccctgagcttggcagcctcgtcggcgccggctagccggctgagatcaacgacggggatgggctccggcagctcggcggcgaccagctcgtcagaacggtctttctccccaagcacgtaccgactcggtggctcctcgacgccggccgccgccagctcttgcactatcgccggcgtcctccatgactcgtcagccattagtgttcttgttcttggatctttctttgcttaattttcttcttgcctgaaaagaaaaaggagatctttcaactcatttatagcctgcaaatatgttgaattggatatacttggatgaaaatggattgacaaattaggcacgtgaatggaatctgcttctcagctactattcaacagtagaagaaaggatgcacaatgtacatggtggaaataaaagacacgttgtagataagatgtagatgtagattgagctgaataaagggataggtattcaaactgtttgacatcgtggaatcgagcacaagaaagggaaccttcaaattcattttttgaaattaaaccgaaggtattcaaactgtttaacattgtggaattgggcagaagaaagggactggtatttcaagtagtttgacattgtggaagtgagctagtcctgactcctgagttctgaatgcctgaatgggggaaaacaagttccattgcttaccttttcttatctccttctagatatttcaactggtgtaatatggtgacacaagatctgcaccagatcaactatctctcggtttctatcaatggttagtaacaggagtagtaacctggagagagctgctattctgctcgaaatcaacacaaagtcaattagtcactcatatcaatagacagaacacaattcctatcgaacaaaagaagatcaaacataataaaagaagataaagatgtattattttctaaaagaaaaaaaaaagatcaagatgtgtagatcaagggaaaaattgaaaaactctgaagctgtcaaatgattatgcttgccttttagatggtccaactgaagtactagaattcacaaggctcagctaaatgattcttgccttcactttcttgctgccttgcaaagtggtggatgcttctcaaatatcaagtactagcagtcttgtgtctggctcagtttctttccaaggatctagaaacaagcaaagaaaaaaagttagttgattagtcacaacccataacactgaccaactgtacttcaatgagttatcttccacaaggttagaattttaacctagcatgcagagctcatcaaactgtttggagtagtacaagtacaaaactcatcattcatcctcagcaaacacaaaatgaaacctcacaataatatttttcttttctgataaacgctacagatctggatggcataattacatgagtatgcgaccatgtgactcatactctacaatagttctttttttctgataaactttacagagtacatatcacaatcactatttattttaactggcatagtgactcagatcttcactgtgtcaatcactcttgtcccttgcaagaaatgttcaaagagccctgcaaggtagtccataatcttcaccctcttgtatcttgccgggtgcctttcatcgatcagctcaagtgctggctcaatctctttctcaagattcataaaataaaacaacaccactgatattctctccttttcaggatttgtcataaccctatgcaccgagctcttaaaaatcccattgctcattatctgtacaaaaaagaatgtgtagttcagtgaatcaagaacttggagatgcatcatggcacaacttgaacatactggtagagacaagctcacagtaagtttttttttttgccgggaaggccgaaggaggccaaccgagtatattaagaaggaataaaagttacaagagaaaaaacatcaaaatgcaccaaggtgcattgccacacaccacacactaccacccaagcacaaaccgctgagggtgaaacctagcaccaaacgacccccgctaaatgtggccgaacgccgctaggcctacggcaacaccacagagacgaggctccgaaaacgatgccaccatggtggtcacgacatccaggatgccgccatcgcccatctaaaaagatgtggttttcacccagagaagctcgccaagaaagggagagggtaaccctcgacaacgctccaaggaaattacgacgcccgaagacgtagccgctgtcggcccggtgaaccaccggactaggctttcgcttgggaccctacaaccttgactgcagatcgccgtccaccaactcagaaccaccacacagacaaatggcagcacgtggcatccaccacaccgcaccgacgcccctccatcggccgacttcaacgaaccaccacccctgagagctggcccaggactcctccgttccaccacccgccggccgcctcgccagatttggccgaaggagaacccgggactaggtggcattgcttcggcagcctgagcttcccccactgacaagctaccgcctcaatccaaactataaactccccgcaaagaaagggaggagctccatgaaggccgagggtgccgaccggcaacgaggaagacgacccaccgccgccagctccctttgcactgccatctggccgccggtggtgctgctgctccggaccggcaccacccgccggcgcccccgaagtccggccgccgcgcctcacctggccaccgcggcggcatcccggctgcccggccaccaagctgagccgccaccgaggcctggacgacccaccgcgccatgggctggcgccgagcggccaggccgagcgagtgagcgggggcgccgctgccgctccgggcaggctgcgctgcccgccgcctccgcgaccgggccggccacgacgagccgcagccatccgccgcgcgcgcccgccgctgacgagccgcctccgcgcgcctccacgccgagcctcagccgtccaccgcctccgcgcccgtgctgggccggcctagccgtagccggccgccacctcgccgccttgccgctggccgccatcacgaccgcatgccgtcgcgccgccccaggcctcctcgcgccgccgccgcgcagatccaggcaagggagggccggatccggccatgggggctccgaatccgctgtctcctccccacctcgccgccgtagctgccacggaccacgccggtggagagcttcgtcgtcttcgtccttcgcgccgaggagggagacgctacgaagagaagaaggcctcgctaccgccttccctgcccgctgccggattcgccgccggcgggctccagcgacagcgaggtggggggagggagggagagaaggcgcgggcggctagggtttttcgcccccgagccacccgacgcgaaagcgacgcggggggcttttttgctttttaactcccctcttccgctcacagtaagttcacccacacacaaaaaagggggaagctcacagtgagacagtgagttttagcaagagctaagatagcatgatgcaatggtgacaagaaaaacagcattcgtggacagatatatttacctccatgtgatctcctaagttgatcagcaaggtgtgaggtttagttgggacatcataccagacaccatctttaagaacttgtagcccaccaacgtcgttatcaaccataagaattgtaagaatggttgcatcagaatgaggcttcatgccatagacaagatcaggccttggacactgagggtagtagttgaatcgagcaatagtggtaggcctgtcagagaattgtctgacaaagtaatcctcgttgagtttcaagagctttgccattgatggaaggagactgtttttaactccatcacattttatgagaaactcatccagaacatccctacataagagtcaattcgcataatggattggtactggcgaaagtgttttattgacataatttgaactataaattttgggacagagggagtactaaatttttgtgacacgttgcaaccataaactaggccttataagttgtttaccatcgccgtaaacaaatcgtaaaacatctctgacactgtgtttgtgatattacctgaaagattcaggatgcttgggccaaacggaaagatttctctcgtctgctggatctactttcagatacaatcgatccaaccaatccaggatttgggtatcagatttcacctggtcatttccatacccttctagctggaaatgcttgccgtcaatcaagttggtgtatttttgcttctctccaagatgctgttgaaaaaactctcttgacacattcatcacgttatccatcagagcatcttctatgccatggttagttacctgagaacacaattgcagatatagaatataagccacgacatcatgttatttaaagaagccaaggcagttcaacaaaaatctatcaaaggtacactgactacttattaccatgaaaaggccccaagactccatcgcctgccggagtttcaccgcctcattggcatcaccatctggttgggacaggcgaccaaggtcaacaatggggaatgatgcagtggctgcaatggtcggttggtcttcttgttgcacaatgtactgtcttggcacagatttgcttctcatgccggcaagctcctgcacaagtagtgttgatctcacatcctccatgctcccttccatacggatgtagctcaggtactgtctcaggacttaggttgttcaatgctgttgagttgatacggagaagttactatatatgagtctgagaccatgtacgaaaaaagagtaaaaatactgccattgttgcacaagtggtcatgtaatgaaaacaatttatacctggtataaaaaaatgctgtaagttgcaaccaaattgctgaattaaccaaaaaaaaaaggcaatttgacatttatggagcagagttaggaactgcccaatagtggctgacaattaagatttaaattcaagctcaacatctgattccctaacttcaatataagcacctagagcgcagctgtgtactagcctggagttggcaggctgtttgttctatccttaggtagttgggctaatttctggtggcacagcaaccttgtttgtttatttattacttgtaacctctccttggtcttaatttgggcggcatacttttgccggacaatgaaaaatataagcacctagaagaataaagattcaatataccatgtgaatcagaaaaccactccatgtgttacacaacatacaacatgccaacttcaacttgagaggttgagcaaccgatgatgcacagcacaggcccttaaatttaagcttgtgataacgtcctttccagaataacttaacatcttgaaggagcatattaactgaacctggcaatatcgcttcttttttatttggaagtggcgtatttcacatcaaattctatgacatcttgtttctttttaatttgaaagtggtgtacttcatgacaatattgtttcttttttatttgaaagtggtatagttcatggcaatcttgttcatcttctactactttgaaagtggcatgcttcatatcaaattctatgcaaggaaccctaataccgtgtgctgttttttttttaaaaaaaaacgaacgattcttgttcctacgggatttttcttcctgttttttggattgcacaaaatcaatcctgaaaacattgcacattcgcacagtactaatcccaaataaatttcccccaaacttttcaaagaacaaaaaatttaaccgaagctgctttggcacaaacctatccgccccgattccctatctgcgtaagaagatgggatcgaggcaacccgcaggaagtagcctcgtcgcgcctcctcctccggtcaccgccgccattgccgcgaaatggaatcggttgctcgccgccgccgccgccgccgcctccatagtcccacacggccaccacctgccgccgccgccgaagccccccgacccgacctccatctccgacgaagctcctcattgccatcgcgcggcccaactgccgccgcggcgagcccgcgagagcccaataagtggtgggcttagatgggccgggccggaccatcagtggcggccttggaacgtgtggcccatgatcaaaactaggcctttttcacttttcagttcgatctctcccgttcttcaccggctccggtgagctttgatccaaccaaacctgaaattttccatctcgagtaagattttcatcaccatttgatattttgaattttgattgattgatttctctgctctgcaaagggacaaacaggagaagttgcagcatcaataatgaggcgtttgtacgcatccaatccacaacgatatatcttaatatctatatcccggctatgatgcatataagggagatcgagagagatcgatagcgatgcatagcttgtgatccatcacaacaaagagtggcggcggcggcgcactgatggacggacacggcggctcgccggacgaggacgtacgccggcgacgcgtcagtattggagcccctgctcatctgcaagctaggctggctcggcacgattctcttatattttaaactccttccgtattttgtattttaatgtatgatgttgttgactttttaaccaacatttaaacattcgtcttattttaaaattatgtgtaaatataaaactatttatataatacttaaaaacatttgatgataactcaagtcataataaaaataataataataatatatattttaaataagacgaatagtcaaacgttggtaaaaataaatgacgtcatatattaaaatacggagaaaatattaataatcatatataagaacaaaagatatggttttcacatcaaatgcggaatttagctttagcccaaacggcatgcatgattggagctcgaattttttaaattatttttgaggactcaagtgcgcgtgcgatatttgcttttggctcctcaaacaccactcaattaattataaaaaaaatccgaaaagatattacagtacaacattgatacagttgatctacacacaacgagaaaaaacaggaggacaaattcagttacaaatagtactataaccaaatttatgacttcaggttttcaaatattgcatattataacatatgtttagaaacattttgatgatatatatgcaaagcaaaaatatatatatatactccctccatttcaaaatatttgacaccgctgactttttagtacatgtttgaccattcgtcttattcaaaaaatttaagtaattatttattttttttcatatcatttgattcattgttaaatttactttcacgtacatacatagttttacatatttcataatttttttaataagacgaatggtcaaacatgtgctaaaaagttaacggtgtcaaacattttaaaacggagggagtactactttggttgtaaattgatttccccttcatgtggagagtaaaagatcgatctatttcttcacaccaaagtgaactttatttttcatcatcaacacagttcatgacacagtcgatacaacacattattgataattcatccgtttcacaatgtaagtcattctaacattttccacatttatattgatgctaatgaatctaaataagtatatatgtttagatttattagcatcaatatgaatatgagaaatgctagatgacttacattgtaaaacggagggagtagtagattattagactcacgtaatacgtctcaaccaacctagtaaacaccaacgtgaacatctatcattctatctattattccacatatttttttagtttaagcatgcaggccacgcgattaattagctagattcctccatcacatcacgcgctggtcgagacggccgccgccgccgccgcctccggctgctgctgctggtgctcgaccttgaccttgaggaagtcgatggtgcgctcgccggcggcgaatgcgtcccagaagccgtcgccgaaggccttggccttgagcttctagtacatcgccggccgctcctcgccgacgagctcctccgacggcgccagctccttgtgcggctccggctggtagaacatcaccaccgacatcctctccctctcgctcgtcaccaccctgtgcaccggcgccatgaacacttgctcatgatctgcaacaccaagcaatgcaaacaacttaaatttttattcaagcagatctatttttttactcaaatagctataaaaaattaagaaaatagtaatatcaaatgggatgacataaatttatagaaagactaaatttaatctagaactagaaaagagaaacaataaaatcagctagtaaatgtagatcgaatttaaacttccatgtttacgcatggagcctcactgtagggctatctactggtagtagaaatcaatttaaagtgttaatttcatttgattgaagagctcagatctatttatactaccagcctagttagcggtggtagaaacgtggaggagtattagaaaaaatagatgcgagggcataaacgttatttagcaatgactaaaccttttttttcttctctttttttttctttttcgatgaaatataagcgatgccaacacaatcaatgaatgatcatatatctatttagacaaggaaaacataaataacaaagtaacttttaatcattataatagtaaattactaattatcctttataatactgatggtataataccaccaatagaaagcaccgaagtatcactcttatgtattattattatcataatctatcttaccaactttttataactattacctcaatctcgtcgccggcgacgacgaggagctcgttggtgagcaccggaatgtcgagccagcggccgtccttgagcagctggaggccgccgacgtgcttgtcgaggaggaggacggtgaggacggagttgtccgtgtggggcttgaggccgtacacgagctccggccgcgggcatggcgggtagtaggtgaaccgcgcgtacgtcgtcaccttctcgccgaccttgtcgccgaagaactcctccccgaaccccagcgacctcgccgtggcggcgagcacccgccggaacacctgctcgctccgccgcgtgtactcctcgaggagtccccggagcgccgccgggtgctccggccagaactccagccgccgctcctcctccggctgcacctggaggtagagccggtcgcaccagtcgaggatctgctcgtcggtgtccacgcggtcgatgccgtagccctcgggctggaacctctcgccgccggcgccgacgccgtcggcgtcggcggcggcgaccacgttgctgtacctctccttctcctccggcgggaggtggaagaactcccgcgtcgcggcgaggatctcgtcgaggaacggctccggcatgccgtggccggtcaccgcgaagagcccccacgactggagcgccgaccggagcttggccgcctcgccgccgtcgtcgacgacgtcgtcaccgctctcggcggccagtcggctcacgtctatggtggggatggcggcgagctcccgctgcgccgcctgcacggcgccggccgccgccaccgggcggtccttctcccgcagcacgtacctgctcggcggcgccccgagctcgccgccggcggcgaggtcttgcaccatctggccctgagctgggtgcaccatggtctgtgactgtgtgtgtgtttgcttcactgtcagtagcctctactcattaagtatttaaatagtctggatttaactccgttatactacctccgtcacaaaatataaactacctccgttacaaaatataaacttctagctatgaatctagatagttatatatccatattcattgctagaaatgcttatattctggagggagtatagattttttttatttgacgcaatcgttaacatgcggtgtagacattggacaacaccacactgtatcttttataaaatcgagtgtggaaccatatgatattttgttaggaaaaaagcttatcatcagttcatcacccgtcaacttggtgatcatgcagattgtttcagctattttctagtgtagaataattgctaggtgatccgtgccatgatctattctgatcgtgatcgtcttgaataatttcaatggagcaaaggaaacatgtgcccaggatcgcattgtagtgactgaatcgtcagtctactttgggcttcaaatcaggatggattcggggatatacttgaacttcgggagttcatctacaaccccgaactttagttttaacaaatacatcaaattaaccatgagcttcaccgacaaataagctccatttttatagtttcaacaaggtggaatccatttggatttattagatttggaatccatatgtaaatgtgcttcattggatctcgcggatttgtcaatttgtttatggcctgcaccgctcacgttgatttctttctttaatatggtacgatgagattagcttgttaaaaaggttgagtgtggcctggtaattaagtaggactgatgatcaacttgttaaacacatgtaggttaggaatggatctgttggacaagcttactgtgagactccacttcaatggatagtttttgacgatggaacgatgttgcattgagaaagacccggaggtcttcaactgtcatatttttaaccggaaggatattctaaaaagttttattatcccatttcaggcgacttgtttaccctgcaaattgtttccgtcattttctagtctaaaaaatttgctgggcgatctgccatgatctgtatcgatagtgatcgtcttaaatcatttcaatggaaaggttgcacatgctgggattgtatttcagggacagtaaagcatctactttggctgcagcagacgcagcctgccctccatttgtttgccactgcccaagaatctaagatgacatgcattaaacttatgggttgaagtgacaaatggtgaaatggaggcctcaactcagggctggatttgaagatgttaatgagaaaaaaagttggagaagagaaggccagtatatcccctaaacttcgaacagaagttcatctatcaccctgaatttggtttcgactttcgacaaatatgtcaaacaggaagctccaccaaaaataagctcagcgcttttatagtttttgtcaactagttcccctacacttgtatttaagtatactgatcggataaagcagcgtttgaaatgatgtatctatttttcattccagaagccgcttggtgtatacaaaatggcaaaatatacagcgtcacctcttcatcaggacaccaccgtcataaccatgcgtgctgctaactcatgcgtgggaacatactttctctgcatacggcagcagaattacagcattagcatagaagtaccgccatgaattgtccagggtaggataatggattcaggaggcgagcttttaccttgtctagaactgccgcagcacaaacggtcgtcatcaacataagtagtattcagccccatcatccatgaacctactgatatgtcatcatgggcatagctctgtagcgatgcactgcatatcgaagagaaacaaattgctcaaatttcggtcaaattttgactgcatatactcctatattgactagagatatcaattggttactgttgtattattgattattgacaaagaacatctggacagtgttcctgcatcatcaagaccatcaaatagatggcagatggctaacatttatatatcagttagtcagaacagcatttcagtggccggttattaattcataaatgctaaagacagtattagtaacttatatgaaatccagcgaatatagcctgttttctgtaaatcacatatacaggagaagactcatgtaacaaaaaactaatttgtcgtttgaccaccaagaaaacatcatcctaattgcaacatttattctgtattaattgaactgatgcactgcaattgctcagaggggcctggttggtcaccaaaactggtttagcttagcatgactcaaagataaaacaggtggatgcgcaccacttacctgtttatgttaatgtagcgtgccaaattgttagagaggataaacaaagcaccggaagcatggcgaaaatacctgagaattaaaaatcacagtgaacggaaaaaaagtgatatactagaaagttgaaggagccagagaatgaaaacgctgaagaaacagcagagaacacttctcatagatactagtatcacccaggaaacacatctatttaaactaggcgtattccttcaccaaacaaatagaaattacaagcacaatgcaaattaagtctaaatataaaacagatgggcttcaccagatctttaagactcgtaaaccatttgtgaatcaaggagaaaccgctattagcatgaaaaagtagttataatgacatcatccgctgcaagccatgcaaggttatacgagtagttggtaatatgaaaaaaaaaatcattcttaggtttgcattgaaggctgaaactcactatcaggaggttgaaatgtttgtagcctcaatgtagcattagactcagaaatccaaatactaagaaagaacatgagatcggtgcttcattaataatgcccataaaacatgtaagaacaccactagacacagaattattgctaatcacccaacactaagatgaatattaggataatagacaaatggcaaggaccttgaatatgttagtttactcacgtttttgaatctccaaacttccaccattcaggttcataccattgttgacccctgaaattgaagttggtatcaagtggcttcaatgacgggttaacaaagggcaaagcaatccaatgtactgaatgaaatattatccctgaatatataaatgatgcaatgcaattaagagtgtgcaaggtacatgttttctcgatatcaagcaatggtagcacctaaggtaaataatgggactaagcaattcaaaagctatgattccttgattggaccaaacgtttcagatgctcaatgcattccactacatttacatagctttcaaagatggaaggatgtcagcatggaagcatcactgctaaatggatccgcaaggaaaacaaatggtacctcttatgaaatggatggtctagttggtgttaacatatgccatgcatgttgtctaaaatctaaataaataaaaacctactgatgatgggaatgaaagcacatactcttcacttacaacacctcctgatttcatgcaacccatgtacagtccttggctacctcgacgggcttcaagcatctcaattaatccagctaatatatagattgtaatgagtcaaaacattaagccgaaataagccataggtgtaatgtttcaacagaaaaggaattacccaggtcaaggttaatgttgtcatcgactttcacatagaactctgcgtcccaagcttcaattgctgcactgaagaaaaacttaactttgcttggtaactcctctgcagcttcctcatgactttcctgtgtgacaatttattgactatttatgtcacattctgttctccataaagtgcaagcagtttgttcaagatttgacaatgtcacaaaaatggttttgatctaagctgtatatccaaatgtcaaattaaaaaccgacatttagatgaatcaggacagtgagataacttaaaataggtactgaattgaaggcccaatacggacgagaatgtaagatagtcttccatgccagaaaacaaccaagcaaagccaaaagtcttctgcatgtactacagtactaattttttgtgaaggacaaattggaaaaatgatattaaatgttattagatccttacaagaatcaagaaatctttcgtccgacgattttcatcatcgatgttgcggtccaagctatcacctcgatttgcactgaaggaccaaacagaacaatttcagtaggaaaactaaacatgaagaaaagcctgagaatgatatggggcgaatgattgtctaaggtgctagagatgctacatataagagatatggatccagaataaaacctccgaccaatgacaaaacgaatgaccacacccttctcctcaagcttcttcagagcatcacctgaaatttacagtgaggtaaaagaacaattatactcctgtagttgaaaccttataagtaacatagtttgcatcagcaatagctattagaaaaaaaaatgaagctgcattccaaccaaatgttatcagggcgcacacattttatcgccgtaaactggaaactaaaagagcaagaacagcgaacctctcggcatccatgagccacggaaggtgttcctcttgagccgggaaccaaaaccagtgtaaactccaataacagcaaggagcttcttcttgtcagaactaccagtagcagttccattcccccacagatacccctcgctcttcgcctttgtaaggtccatttctgcctccgcaatcttcctcccaattccactgccaccaaacaacccatttcaaatcagcaactaaaattctgaattctgaattcctcttcagagagagagaggggggaattacatgcatcctagattcctcagcttgtcctccaccgacagcaccttcggaagctgcaatttaggcgataccatcacacgaactgacaaatcaagcggaaaaaaaaaacgagaagtgggtggagagggggagagatccgcacattgccggagctcttctcgaggagaccagacaggatcatccgcgtctgcgcgtcctgccacagcctgcaaaaaaaaaatccaatcaacgaaacaatcagaaaactccacggaaattccccccggatctgagcgcgcgggcgcgcgtacgtaccggccggcgacgtagagccacgcgaggcaggagaggaaggccatgacgagggggaccctccccgaggagagggcggcggaggcggaggcggaggaggaggaggggggcttgaagcggcggttctcccgccgcatggcgctcgccagcgtctccatggcgatctggtggcgatctcctcctccctaccagccgccgctgccgctggtagagaagaaaagcttcggacacactgcagctcgcctccaccactcgtaggccgacaagaagacgacgaattcggcccaaattcaactccatttttgcgaaggagataaaaacgggccgaattcagccccaaatcccacgccatacgcaaaattgggccgaaatcagagaaaattggagtaagtctaatttgtctccctgtcatgcttttgagtgaatcaccctcctcaaccgcaaaaccgggtataatgtctccgcttcaaaagccggtgcacatcaacataaaccacttcctaaacccccaaaatagtcaatttgcactggttttcgaagatgggagagacgttatcagacaaaaatagacttatccgcaaaagaatcgacttgcactggtttagatggaatagatgttatatccggttttgtagtcaaaaggacaaaatagacttattgtcaaaattctacgctgttcgctaatttgggccgaattaagccgaagcctgcgccgtttgggctagcccgttgaggcccaactcgccgaatgccctacgaaaccaaccacacgaagcccgcgagttttccgtcaccttctcagttcactcgacctcgccgccggcaatggcgctcctcctcctccgccgccgcatccaccgcggccacaaaaccctcctcccgcgcgccttctcctcttcctccggcgagggtatgttcccgcctccgacgtccgaccccgcatccgccgatcagcgcaccaccaagctctcctcccacttcgccgaaatccgcggccacctcaacgccacccctccctcctccccgccgcgccgcatccccgaatcaccgccgcccgacgatgtccgccgcagcctccacctcttccgcaacccccatccctcatccggcgcgacctccgccgccgccgcgaaccccagcccctccttcgccgacgtcttccgcgccaggcccgcccctccgaccagccgcgccaccggagcggacgcctttcccttcagcgcgctccgcgagagcttgaacaagaacctgggaacgagccccacggcgtcggcggtgcccctccccggcgccaccgccagttcgccggactggagctccatcctctcctcgcggcagagacacgacgggaagccgctgccggagtcggtgttcgggagggaaacgaggggggaggcgaggagaggccgtgacggcaaagtggaggagcagcagttcatccggttgtacagcgacaatgagctcggcaagaagctcagtgaactgcggccaccggtgggtaaggatgggaaggagtggttctccgtggaggagctgagccggcgactcaagaagctgcgagagatggacagggaggaaagggctctgcagtccgggctgggcaccgacgtgctgcgggatgcgatcgtgacgctgcagaccaaagatctgaagacgaacaactgtaatgatacatcgtgattttgctgttcttgtttagtcgccattggtgaatgcctgatgaaactgatggataacctttttgttactgatgatgctgtggttacatttggtttgctagtggctgcagcacagagtatgtcggctttgatggcctttggctctcaggccacaccggcgtacttgctggggaaaccgcaacaggagttggtggagagggtgagctggaagtgttgtgcatttgatgcattttgttgtttagattggatgatgtggtgttgagaattgtcagttggatctttgcagtacttccatcccgatcatatgtcatcagcggagaagatgaagcaggagctccagagtgtaagggatgagttcaaaatgtctgagaatgactgtggttctgcacgggttcaaggtattttttgtttcttctgtaaccatagagttgtgagaaactgacatcttagttatgaggagctttatatgtgatcatgttcaggtctttatggtcttacgtgagaatttgttctcatatcaaacactcacttgctatctattaaaattcattacttaaaaggtacacggtaaagcactgatatgtgttaactggtgcaaatttatgagtaagtttcttttgacatgtattgcactcatatgtgttgactgctgcaagtttatgagtaagtttcttttgacgtgtatttgttccccatgagaaatgacaacgtggtgtatacttttacagtaggggtagttttaaggctcaattttgtgtattgaagatgtcgtgcaataagagttatttgttaatactgatatttaggccatttctgtttgacaatttttgaactttttgttgcaaacttctgctgccatttatttagtcaccatctaagtcatgttccacgcttgggtatgttatgttgagtgttgagtgtgtgaataagctatgtaatatgcacgtcacgttttaaaaccctgaacccagtggtttagttattacgagtttagttaagatttggctttatatccaaactagctaatcttgtcctctaaatttgaagttctcttttccaagcttctttttagctcccaatctgtaatatagtttttcttgattcaaagaaagttcaggttcatgattttttatgatgcttccataatagatagatttgctcggtaattgcatgtgactttgaggtgtttacattggcttgaaaagttcaggcatacgaccaaagcaacacactaggacaattgcatctctttaagatttcacattccttctcttttttacccagaaaaacttcctttgttgtaattggtttcagaaaaagggaaactctgtcagcaaggctttagatgagcttttatctccatgcatgtttatgactttatgtaaaatttcctcttcccttccacctttctggcttgtaagtacatattttaggcttgtatatctgcaattgatgcccgtctatgttttgcagtggcacaacttaccacaaaaatcaagcatttgtcaactactctgcataagaaggtgatcttacatgaccattttcatacagcatcacggtttaccttgccatagaatttgccgggctcgcctgattttcttctggtgaagtgaaagtaatatgtgaacttgacgtgtaattcaggacaagcattccagaaagggacttcaagagatggtgcaaaggaggaagaaatacctcaaatacttgcgcagaaccgactgggattcatactgccttgttttgtcaaaactgggacttcgtgatgtgccggagtacaagcctccagattacaagagcaagagaagcagcagcggcaagaccaaagccaagagaaagatgaagagaaaaatgaaggcataagatctaatggtagatttttcttcccgttgatttggatttcgtgaccagaaaccgatagatagattagaagcccaggataagtgtagattggtctcctggtcactgggagtaactgtgttttattttggagctgagcaaataataccaacaatcaaggttgcgttttacggatcatattttatagaagaaaaatgtttgaaatactaagaatgctcctgatctactgacgatgattcgtgatctcaaatactaattttttgttgattcactcgtgtactttacttctactcacctttttgtctcatggtaacttatcaagggccatcaatgtagagagcttgtttattttgttaccaattctaacattaccaaattttgacaatatcaaattttggtaagttttacattgctaaattttagtagctggatgtatttagcttgatgtcttccaaattttgttagtgtttttgtttgaggaaagtttcagaactaccatattttagtacgatggaattggtaaggtgatggttagtttgttaacatatcaaaatttggtagtgaatttgttaggcaaggtttgggtggagaaactcccaggggtctttcggctagctccacgaggtgtggtgggctagacgacttgggttcgaagcttcaccccttctaattatttgatattatgtcattctctaatatttgtgtcttttttaggcaaggtttgggtgaaagaattgggtgaacaatctagttacttgcaacttaaacccaacatcctgtgagtcacctgcttccctgctaacttcatcccgcttgctgaaccgcatatgctatgcacgccgccttgatccggtatccttgtcgagctccgccgcggcgccgccggcgccgtgcatcctcggcggcgatcgacggagatggcgcctcggctcagcgtgaagaagtgcctgatcatcctcgccctcgccgccgccgcggccatcgccggcttcttgtccgtcgccggcgcgggtcgcggccgttcttcctcctcttctccggcgcgtcggctgtcgaatggtctcgccgcggtgcgtgtggttttcgtgtacgccatggtggagagtacgttagtgtgatgagctttgtgcttgtcttttttttttcgtgtgtcatcaggagagggcccggatggcgatggcgagggcggcgtcgccgaccgtggagcgggagctcgacgcggcgcgagcagcgatacgccgggcggcgcggcggcgtcgacatggtgatctcgccggcggcgagggacgaagcagcagcaacgtcagctcggcgaagtggctgagcttcttcggcgacgcggaccacgctcgcctggagcgcgtctaccgcaacccggcggcgttctacaggtagtacataactgaaatctgtccgtacgccggcgacggcgactcgctgacatgtacgccgccgtgttctctccggtgagggggaagcaggagctacgtggagatggagaggcggttcaaggtgtacgtgtacgaggaaggcgagccgccgatcgcgcacgagggcccgtgcaagaacatctacgccgtcgagggccgcttcatcgaggagctcgagctcatggcgccgccgctcggcggcgtacggacgtgggacccggcgcgcgcgcacgccttattcctgccgctgagcgtgtcgcagatggtgcagctcgcgtaccggccgctgtcgtacgacctctcgccgctccgcgccatcgtcgccgactacgtcgccgtcgtcgcctcccgccaccgcttctggaaccgatccgccggcgccgaccacttcatgctctcctgccacgactgggcaagtacaaatcatttttttcccttattttttcagagaaaaatattttcccaacaccaaatgatttccatacaaatttcgaaacgagtgcaaataataaattcagtacatactccctccgttcaacgagactcaatttctgggtttccgactttccgcgtccaacgtttgatcgtccgttttatatgaaatttttttattagtatttttattattgttagataataaaacatgaataatattttattcatgacttatctttttaattttttaatatttttttaaataaaacggacggtcaaacgttagacatggaaacccaaaaattgagtttttttcgaacggagggagtagtgtggaaagaaaaatagaatgaaatgagggggcatcgaaagatccgaaattctggaaattttcatccgtgaacatttcaaatttgaaaaaaagatctgccaagttcaaaaataaaagaacttccctcgaaataatgtcatatcgggggcacaaaattctccgaatttcgaaattttcaaaccgaattttatgttgcacgtgcgtgcgtagggtccgcacgcgtcgagggggcacccggagctgtacgcgaacgccatccgcgcgctgtgcaacgccaacacgtcggagggattccggccggacaaggacgtcagcatcccggagatcaacctctacgacggcgacatgccgccggagctcctgtccccggcgccgccgccgccacggccgttcctggcattcttcgccggcggccggcacggccacgtccgcgacctcctcctccgccactggaaaggccgcgacccggccgtcttccccgtctacgagtacgacctcccctccatccccgtctccgtctccggcgacggcgacaccgacgccggcggcgagggcggcaacccgtactactggtacatgcggcggagcaggttctgcctgtgcccgagcgggcacgaggtggcgagcccgcgggtggtggaggcgatccacgccgggtgcgtgccggtggtagtcgccgacgggtacgcgccgccgttcgccgacgtgctgcggtgggaggcgttctcggtggcggtggcggtcgccgatgtgccgaggctgagggagctgctggagcggatcccggcaccggaggtggagcgcctccgcgacggcgtgcggctggtgaagcgccatttcatgctgcaccagccgccggagaggctcgacatgttccacatgatcctgcactctgtctggctcaggaggctcaaccttaggctgaacagtcactaacaatctcatgatcagtaaccaaagtaaaaatgccatgaaaaaatataggtctagaattatcagttgcattagcactccatttttactgaatacaacttcattaactagttcttaacatgtttcttggctttcacatctcagagttcagaagaaaaaaacttggtatactcctgtaaatcattttgaccacgaagtgtctgaaaacttccacaaaccatattggtaacccccttactggtagaaatataagagggagtagataaaagagtataagatgtacaaaaacacaagattatgttgaacttgacagaatgtaacacggctcaaaagaggttcatcagtaagcatctcctataccaaatgcaaatgtcttcagttatcattgtagggaatgtaccaaatcagaaaggagccaaggatggttagcgcaaaccacagtaacagcacatataatgtataaaaggtattgaaatcaggaaattccatcaaacacaaggggaaactcctcttgtcctgaaatctgcaagttccagtctttttgccttctcatccgatcccccaaacatctgttctcggagggattgtgtggtcatcttatgctgtgaaataggacatgacggttctagccttctagcctaactatgatacccagattcacagtattgacaaggctgactttgctaatctgaagaactagatagatggtgctggaagattgcttgctatttcagcagctcaccaccttctcatctctccataatagtgttcttgattcactgggttaccggatggaaaaccagtggcagctaatacagtaagcccaacaatttggccagtcaattcaaacctataaatcttcagcctattgtgatatagacaattctacaaaacaacaatcatctttttctaggtaatctaaatgctgaatatgatatatcaatggtagttcgacacttccactgtataacagttgcaggttatcttgctaatactagatagaaaaattacacggcaatttgggttgattctcaaattgaaccatggttggaaaccactgtcagcaattctgccaaactataatggtgaactctatcaggatcacaactcgaaccaataaattctagggatagagaaatacaccatatcccaatacacaaagattagccatttgtgtttctgtcaaaagctgcatactgaattggatatgtccaaggtatttgggctctataaatatactcaatataaccatataatcactaagaagggttcttgctgataagaaataggacgataacacacaacaatctggattgatttcaaaccatagctgatggcaactcttaaaagaaaatttatactaaattcatcaactgtttaccatcacatggattaaacaccaaccgaattgcgagaacaagaagcaaaccatctcagtagatcaagcctcaggcgccggctgcgagaggccggccttggcgagcagcttccccatcgcctcaggcgagcacacctggtactgcacctccccggtgccgggctgcaagaacacctcggcgagctccagcttctcggcggtcaagctggtcgaatccatggtcttgctaagcaccttgagggcgagggcgacggcctcctcccgtgtcatcccgtcgcggtagtcctgcttgagcatggactgcgccgcctggctgttggccccgacggcggcggccttccagccgctgtagttgccggaggggtcgctcatgtagagctggaagccatggtgcttgtcccagccggcgaagaggaaggagacgccgaaggggcggaggccgccgaactgggtgtacccctgcttggtgtcgcagagggattggacgagctgctcgacggggatgggctcctggtaggagagggcgtagcgctgggcgtggaggcgcgccgtgttgaggaggatgttggcgtccgacatgatcccggcgacggcgcaggcgaggtgggagtcgatcttgtacatcttctcggcggagcgcgaggtctggaggagcttggaggtgaccttcttctcgccgacgaggaccacgccgtcggccgccaggacgcccagggccgaccctgcgttcccgatcgcctccatcgcgtactccacctggtagagccgcccctccggcgagaagatcgtcgtgcggctgtcgtaccggcgagacatcgcggcggcgggttgttgctggggattccggcggcggaggcggaggcggcgacggcgagagatctactattactaattcagttgagatgtgaggaggttgtaggttgcaaaggttaaaaaatgatttcttcaggggtccaagtagaaaaacgacagcccagatgggccgtctgactctgaaaatgggccaggcccagagattgtaccatgccagcagggcctgccaaatcggcccattatcgtgagggccaagagaaggaataagttcatctaaggtctcttaacttgtcaacgaatccgattttcgtccttcaaccgcaaaactagatacaacaggtccctcaactatcaaaaccggtgcagattaggtccctcggcggttttaaaggctgttttggctgacgtggcacctacgtggctagtttgacttggtctcgatctgacgtggcattgacgtggcgcttacgtggcaattcgatccgaaaaaatataaagctcgtgggacccacatgtcagttt

SEQ ID NO: 79492 - DNA, 12378 bp, Oryza sativa
  unsure (1)..(12378): unsure at all n locations
ccacttgtgcaaaccattggcttttatgtattgccaatgcatgaaaaaaaaggagaaattgccaatcttttgagctgtcaaaagccggctggcccccctttgattttaggattttgctaaatatttgtcatcaaatttctccccctaatatttgtcagatgaaattacagtacaatcgtagtgtaattacactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatacaagttacactgtagttacatgcaagttacagtgtaattacatacaagttacattgtaattacactacgattgtactataattacatctgtcaaatttttagtagaaaatttgtcgacaaatgtataggtggtcccttgattttatgtctagctccgccactggcgtgagcggctaccgagaaatttgataatttaacatttttccgtcgtccactagctttaatcgatacttttgaggctggcatgtaagaccaccgaaatgaatgaaagtgtgtctaagtcactcaattcagcccaacccaatacacccaattcaaacttgagaattggacttgacatgattgtgctttgtgatgtaatgttgaaatttgaaatttgagaattggatttgacatagtttaaagcttagtttgagacttgtatttcgataaatttttgttaccgtatcagcaccggtccgtttttggtttcgacaatatttgattccgttttcgtatctggggtttccgattccgattccgtaaaaaatatgaaaacgaaaagataaaggtagtttccatccgatttcgtatcattttcatccctagtacggagcagttacaacagcagactataagccagctataaatacatttcgagaagataaaagagaagagagaaaagcaatagactacatatttgtagccagttgcagcacagactacaagatacatgtgtgtatgacaagtgggaccagttattaattgtgtatttgttaacgaaaaaatcgaacacactggcctgggagatctgcttagctccagtgcaggtccaaatataatgagatgcgggcgtgccagtcagtttgatcctgcaactgacaagatatgtaaacagtagataaaacagcctatcggctgacaagccgatggagtagttccagccgatagccgataatagccgatagcgatagggtttaagcaatcggctatatgtccaatgtagataatgatataaaggcaatcagatgatgatgatgatgtaataaaataacaatataatccagtataaaccaatcggctagcattgatatgatagaataagcatcgatccaaaggttaaagcacacatcggctggaggtccgatgtcatgaaatccacaagattagattaaacagtgaaacctttgttgtcatcggctaaatctaacttatatgtatatgcaatccttatgagctgatgcaacgtccagataactcaccggctgaaaccccgatgaaacccttattgacaatcaagaagcaagctagagattatggttctaagcacgacttagtagatcaaacttaactgatgcagcactaagtatgaaaagaaacataatatctagacaatcaagccgttgactgagttttcagggtggtagatgtctaagctaatctaatctagcaacgcaatttagccgataccagcagaaaccctaaaacgagaagcagccgatagagctaaattgatatgctaagactagattaacagagacatatgataaataggtaggcaaatatattatccaaagcagagtaatccaagaggtcgaatgtactgatgtagccttgaacgacgccgacgtagatgatacaattgcttggaccgatggaacattggacttatcccttcgccggagatcgaagacgatgcagcctcgcgtcgggtgccaagtcccgccggacgataaaataaagtagaaaaggtaaaaggtggcgatgtgcggaattgtattgatcgtgaagaagattacatagatcccaggtgtacatatttatacccatgggttgatacaagtccttgtcggacaagaaataaactttcctaaagataaaaggaaaagataaagtccttataggacactaaacacactttactaaagataaaaggaaactaacaaactattcctaattaatagataacttgccatgccacattctctttgaactcggtttcttctagataagcttcctttagtagatcaatttccttaaccgaatatagtaagaatccgacaattgacgacttgacaactctcatcggctaatctcaagacttcgaagccgatgctgactctaagccgatgactactccgggcttaccaaatttcactgttaacagtattatatgtttagggttaattggattcatgccatattataaatttgactgttttaaaaaataccattataattcgtctaattggaacgatgtcattaaaactcttctaaaatcagattcatgctatcctatacacttgataagctatttgaatccttttttaactaacatattttcgtatggaccaaattgcccatttcttcttccttcatctcttctcctctctctcctgttcatccttcccatctgttagatcctatcgatctcatcttaatttctttttcccttactttgggcctcatctctaactgaccaacaacaacaagaaacaagccccccgacccccccccccccctctcctctttcggtgagcaagtagcaacagcagcaagggagcaagcggcggcggtgacgtaagcagcagcaggggagcaagcggcggcgagcaaacacgacgggtctccggcgccggtttctggtactcacctcgctcggccgaagttcgccgctacattgagttgagctcggtgctgcagtgggagggcagctcgtgtggtggtcgtcgccggcgagctattgaccattccatgccgggtgggcagctcgtgtggtgggcatgtgtaatttttttctaatgtatatttagccaaaaactaccacaaccaaaattttggggaagcagaggtggtgtagtggtggagttgtgacttgtgagtgcatgacttcacccacaaggattaaattttggtgtccaccaatattacgcacatgcgagtagaccttcaatattactttggtgagatcaaggatgtaccattggtttccgtctcttagagcatgtgttaggcgacgcgttcgtaagatgtgaggtgtggtgttgcgagtgtagtggtttatgtgcgcgtctgccatataatcttaaaacactaccataattttaaatctggtttaaaaatttaagctgaaatcaacgaagtatttgaaattctcgaaagtccagacacactatcaaactattgttacactgcacgaactttgtagtgatgtcatataaaaatggttagcggtactacgaatatatattgacaaaatgttcagtcgaaaaaaatagaagaccatttaacatttatggtccaaaatagatcacagaccgctacactcaagcacaagacaacaatccataattctcccagtatatgtaccatgaggtcataaattaatcaatattctcaacttcgaaaactatgaatcggcagcttgtgttctcaactacatctcttcatttttcgcacgcatatatttctcagactactaaatggtatgtttgatgaaaaaaaattctacgaaagttgctttaaaagtttatattaatatatttttcagaaaaaaaatactaatacttaattaatcacgtgctaataaatcaccttgttttacgtgtttgacctaccgaacacagccttaaaacaaaagcaaaccaaacggatttacctcacattaatccctggaatttctatttctaatttaaatccagccaccacatcgatccgcactaactgtctcatctctcaatcacagctcgtatttcatccatgagggaagggaaatcctgcaacaatcgaaggtacccctgcgtcgtcgccgccttcctgaagtgttcgtcctcgcgcgcgaggtagtcgaggcacttcttcttcagctccgggcagccgtacgtctcggcgcagacgatgatcccggcgacgttctccggcgtgacgttgtcgagcagcttcttggtggacagcagcttcagcccgccgagctcgtaccgctccgccgcggcgagcaggtgctggaacatgtccaccggggagaatccggcgagctcgtcgatgtcgtcgggcagcgcgtccgtgtagatgaagtggagcaccgcgcggaacgccgccgggtccatgtcccggagcgcgaccgacggcgcggtggcctccgccatggagccgaagagggcggccttgaagaccggcgagcgcgcggcgagcacggcgcggtgcgcgcggaacgtctcgccgccgacgacgagcgcgacgtccgcggtgtcgtcggcggcgccgtagagcaggcggccgatgtgcccgcctcctccaccggacgacggaggcggcggcggcggcggggacagcgcctgtgggctgtcgctcgggatcaggacgccgcagacgacggtgacccagccgtcgccggacacgaacttcttctcgagctcgctccgcgacgcgaagtacatccacccggcggcggccttgccgccgccgcggccgccggcgccgagagggtagacggcgacgaagctcttggcgtggaccggggacgggtggccgtcgaggtggacgaggaacgcggcgaagatggccctgacattggtggaccgggtgacgaggtcgagcttgatggagaggtactcgccgccgatccgctggccattgctgttcatcgcgccgccgccgcgagggtagcagaggacacgccacgtgtggccgccggcgtagatgtcgtcggagcggacgaagtcgccggcggcgaggtcctcgtaccggagcttcagctcgatgaagccgccgtccaacatggcgatcgaatcgtgtttcgtgctagatggaacgcgattaacgagaagaggataacgatggtttacgtcattttaaaccatgtcattttttaaaagttaccaaatatttacatacatttttttccaaattttgataaatacataagaaattctacaatattgtcaacttaacaaaatttggtaaggtttattttagctataatatggacaacgcttaaatctaaaaaaaaaaaaccctgcttattctgttgcgtatgttgcctcttcagcatccgtgggcttcttggccttctcccataaattttacaaatattttgacagaaatttgttaaagaaacaaatgtctggcagaaatagttttttctttcaaatttgccatacgtttatcaataaattttattaaaaaattgataaatgtaaaaaaatgtagagtaaatatattgtaacttatatatctacactaaaatataagtttaccaaacattgtttaagtttttcataccttatactccgtattaggtaaatttgaccgagttcgcccccttttttatgtatagacgcacttgtggcaagatctcatttctcatggttcacatattatcaactgaaaaatcttatttcctagaggaatttcacagttgttaaaaaaatatctcaagatacctaaattaacttgaaatatttagtacttagatataccaaattttgaactagaaaatatctcatttcttatggatgataaaattatctcatttcttatggttcacatatcatatggctaatgtatggctcactttttgctagctataacttgaacaagtgtgataaatgatactactagcaaacttagagcaagtttaatagtatagccaactactagctccaattcatctatagccaatctaatagctcattcatacaatagttatatactacgctattaatacctggtcccacatgtcatacacaccctgcatcttggagtccgtgctacagctggctacaaatctgtagtctgcttctcttctctctccttatttatcttcttaaaatatgtttgcagctggcttatagcctgctattgtacccgctcttagaatactccctagcattcaaacagccccttcataccaaggcttgttctccgggacgccgatggggtagaaggtccccttgcatctggtgaaatgtcgcttgccatctgttgtggtcgccgaaaaactcgaggtgcccctgcacaagcatcatcttgcgaggggtacccgtgtttgcaatgccggtgttcataatttgatccggagagagatcttgtttaaatacaagtcgtatagcttagcaaggcgagagtctgataaacgttaaagagttcaggcctccagggcaagcataatacaccataatataatattaagacggtcatgcatgccaagaggcaagagcaatgtgtctgttaagagttagcaacgaaaagttaagttcaactgaatgtccgatgctttcctttcaagaaaatgttgaaatttctcacacgcatgaatggaatgaagcagatgcagatgagatgatgaaggttttccttcttccatcaggaaaatcagtctccgcttagatgacaattttgaacgaatacaaactctattctgtaaaggtccgacaactctaaggcctaagctttcacatactcacgaatgaactcctcaaccgctgaaacattaccggtcagaccagcaccttcagtaactgtcaccttgttctggcattggctgaaattaaatgcttctccagggttcccaagcttgacttcatcagtgatgtcagcagatgatatggcgttccttgattcccggagcttgtttctacacaacagtaaaatcagcacacaagtagtttaagttaaatgagttgctgattatagtgacctcggttatttcaagtatgtaaacatgtgtactctagagacttgtattgcagaataatttattgtatccactaaagctacatcataagttataggtggacgcattaaaattgtagaaatttaatataaacaccatcacaatctgatgcactatagttatactaatatgatatgttagaagaaaaaacatacaattccttttccaattgcttcttgatgaattcttttgagtgagctgtaactttatctgtcttgttgcagaatatcagaacaggaaccctcttcttcactacagttgcctttgtcaggatgtcatacaagtacctgcggaaagagaatattgtaagaccatagcaactgcaacaaaaggctgacacagcacacaatttattactccgtatttgtctcggcatgacaagacggaagctcctagtcacacttctaatctcattccagtaagagatggatttcaatttaagctaaaataaacaccacatatttttactaagaacaggatgtaagtcagcgaaattactctgcagcagcatgcatggtagacaagaaatcttgagcatcaacaacataaactattccagctgcttgaggcaggacttcatcaagtttgggtttgagccttgcatgaccaggaacgtcaacaacatgaacaggttttactttgcctctctgcagagcgaacaagaacatgcatcaatatattgtagtcagcaaatgcatggttctatataacaggatagtcttcctttcatttcatatcaagatgtttaaaatatttgtctctaagaagttgccttaccctctccagctcagaatgaagcacgaaagtatcgttgttttgttccattgaagtcacagttccttgatgtgttgatccatcccgaagctagagaaagggagaattagcacagaccacagagacaaaagatactcaactcaaattaacatgaaaagggaacagtggtgatgtatgatgttgcgattcaatatatcatggaaagaatacagacaggagcatattaagtcgaagcaaggtaagctgaagagatacccatagattacaacatcaaaatcagattgagtaggttatttaaaatggtcatttcctaagctactgaactgtacatgtatagaggttgaaacaatagaaagaaaaacgagttcagaattgaagaccattaaatgtttagccattattcatcaatttgatacaatttcatttctccgctttaatccatcaaaaataaaaaataactgtcactgaaggagtgagaaacacacataaaaaggaaccatatatgggcattgaatgattgaaacagaaaattacctggtagaagagaatagttttgccactaccactgagcccagatagcactatggtgtttgctttcgaggatttcaggcacgaaactgaaataaaacagaagccaggaattgcatattaattactgcacatgcagctccatcaaaataatgtagcaaaatgactactttagaagttccactttttggtgatggtggactcacttataccatactgaggaatttgtgtgtgcgcttgtgccacaaattaaacagatacacatatgcaattgatcagatggattgaaggcaaactaggtaatatgagttactcaaacattatcgcaacatgtaacagcgacaagggtacaaaaggtaagctcaggcttcagaatgtaaccttatttgagcttggcaacaatatactgtattatggctggctattgagctacgcgatcagatgcacaaactagttcattaattcgcaattatggctatgaaacaaactgctggattatggagttgcactggaaacaactctagccagttgctaaattctcgaagcctaagcaatttcagtatcacttgtgcccacgcttcctagctcttccataaaccagtactctcgtatgcaagatttgaagcaaccaaaaaaaaaaactaggcaggcttgaatagttgaattgatacatcacctgcgaccagcaacagaaccgtcacggcgaccaccgcgacggcgacgtaaacctgctcgggaggctgctgccggatccacctctcggcttgtcccacccacacctcggcctggcgaacccactcgtccatccctgcacgaaacgaggcgacggaggtgggggtgagcaagcggcgagcggagcgcgtgggctggaagaagacgatcagatctgaaggagcagcggagatgcgcgttacctcgctgcacgcggaagttcccagagcaggacgacggcgcaggcctgcgcgtgttacaccctccctctccgtacgccggcggcgagccggcgcgaaaccctaggatgctccgccgccgcggaggtggccggagtcggaggggagaaggcgggggttgggggggaagccgagcaggagaggaaagaatagaaggatgaggagaattttctagaggaacacgagattctcgagttaagcccaatatgcacgaaggagtacggcccagtatgggatttcggcccaattcctccggagaggtcgagatccatatattgggctggatttccttgggcctcaggatttaaatgggccctgattttatcactgcattgaaactattgttttttttttgtttttcatgcgaccgagttcaaattcaaatcgttacttagcgatgcttgtatcatttgtatccaccacaaccaataatcccaaacaccaaatgaaaaattcgtggtggctcccataatggtttccagttatgatatcatttgcaaaaaaaatactattaactccgttttttaatagatgacgctgttgactttttctcacatgtttgaccattcgtcttattcaaaaaatttatgtaattataatttattttgttatgagttattttatcactcatagtactttaagtgtgatttatatcttatacatttacataaaagaatttaataagncgnatggtcncacatgtnaganacagcnncccgcgtcatctattaaaaaacggaggtagtatatagctgagatcgcaaacttgcaacagatgaagagagaagaagaatgacagcatagattccatggaacagtgccaggtagctccaaccattgccatggaggtaggtgtcagggttacggataccacatacctaatattagttgactaaatctcgacaggatccaccacataccatgtcttatacggaaacaaccttcggatataagaggagtttcgcataaggaaggatgactagagttctacattgaaacgacaaggactactcggattgtatccatattgatttccctagttctacttggacaagaggacacctatgggtataaatataaggccccctaggaggagaagggacagacccaccatagaagatacggaacaacagaagccacaacatacaagccaacatacgccaagacaagacgccggatatcgacttcagagataggcatggctagtcccctacggtgcctacagataccgttaggagagatatagagttgtctctaatctcgccggatacggattcgaggaggaaggctaccctgttgtcgactacgagccagtactacataccgccaagtcgacaacagttagataggctaccccaaatattgtactagtttgattatggtgaataagagcgataccggcttcggccaacaggatgtagggttattacctgacaattcaggggcccgaacctgtataaaaatccctatctccatctcttttacctcaatctcgcatataccctagtaccaatgatccccatgctatgcaaataccggaatcgcgacatcaaacatcgacagtagggctatcaaaaaagctcgaagctcgcaagctgctcgagcttgattcgttacaggcttgattcaagctcggctcgaatactagacaagtcaagctcaagcctaggttgaggctcgcaagcctagcaagctcgagctcgaatagctcgacagggcttgattaacataagatgtattgcatgtaagaagatattcttgatgggacaatatatactggtcatcgtgcttgacctgctcaagtctcaagacctcatcaatgcttctcaataaagcacttatccggctgctagtaatagtactacattcctattagatgtagtagctagcttttgttaattgcaacatttcaaagtcatgaattcatgagaaaaactacagaggcttcattcaatacaagtagcatccattaattttgactaccaataatttgtattaatatctcttatacaaaagtaagttctttggagtttcaccaagtcaagctgtcaagctcgagtaggctcgaagctcgctcgagcttgaactcgagctcactcccaagctcaatcagtatccaggctcggctcgagctcagctcgagttcatgtcaagctcaagcctacatagccaaactcgctcgagcttagctcgttgatagccctacatgaaggaggaagaaggagctccatacctatgcctacctgccaatatatcaaatccactccaagaaatttaaaagaaccctgtgatggagcgtggggctccttaccgggagaccgcgcaggcccccctttgccggttcggccgggagccctgggtgagattctaagctcctggtctgtggaaagttcgcgagagtggaaacacaagacacgggcgatgtatacaggttcgggccgctgagaagcgtaataccctactcctgtgttttggtggatctgtgtatgaagaagctacaaagtgcgagccagcccccgatcgttctgggatccgaaaaaattttccttctaagtgggcaaggtcctccttttatacctcaaggggataccacatgcaccatctctctcttttttgtggggacttatcctatctattcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccatgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccac

SEQ ID NO: 79493 - DNA, 31727 bp, Oryza sativa
cggtgcccgacgccgcgtagtggcacacgaaggcgttgccggtggcggagtcgacggggaggccgtggcgggccatctcccggacggcgtcctccatgagggcgagctcccccgcggcgccgaagcaggtgacggcgagcgggtagagcgcccgcgccgcgccggggtcgcgcgcgcagagctcccgcaccacgaggagcgcctcgtcgcaccggccgagccgcgcgtacgccgggaggagccgcggcgccgcggcgcggaggcgcggcgcggcggagctgtgcaggagctgcgcccacatggaccgcgccgacgcgaagtcgccggcctccgcgtgggcgagcatgagcgccgccgccgcgtcggcgtgcggcggcgcggcccttgggcagtaggcgccgtctcgccgcggcggccgcgcagccgacggcgaggacgggaaggcgagcctcgccggcgagtggagctcgggaaggaggaggcgagcggagggagaggcaggcgagggcagcggccatggtggaagcaggagagaacccatggtgatgatgacgtcacctctttttcttagcttggcttctgctttctgaactgcctcacaaaaagggcagggagaaatggaagcaagatttttgagaggaaaaaaaattcctgggaattggcaattcatgttttcaactttgggttaactgaatccatattattatcaataataatttattcattttcgaaacatgctatattaaaattcgcaatgtttaagttgtgccattacaatttggtttagaagtcttgataaatgcatatacatcgaaggggcaatagtagtggcactgacatgtcccgaatacctgctaaattttaatagcacagcttgaatatcacgaaattataattagcatatttcaaagatggagaaattataatggcggattcaattataatagcgtgccaatcctgtctgcagaatcatcaagatggtgacaaacccagtgtaacaagtttcagtaaaaaaaatgcaggatttggatcatccagcagttcagaattcagagctaacatctcttttcttctgcgctgataatctgatatggcaaaaaatggtcatcttagcctccatattgcaacaaactcaatctgttcatcactgacggcacaaataatcaccaaagataagcagaggatagcagcaggaagctgcaaaacacaaacctttggctacatgataagactagccctctttgcccaaggtgaataatcaatactcagatgggcatcaggagagttacattgatcaatcgcaaattcacattccatcaaatacatctgttactctgttaaggcgagaactacttcgaccaaattagaaaagaaaatggtcaatagtacaacaataataagaagataataacacaattccgcgacaagcagtgaaccggaagaggagcactcactcaaatagtacagaaaccagaaaataggaaccgaaagaggaaggccaggcttgcgccgaacaagccgaacactacaaatgccttcctcctccttaagcacctagttgtagtacataagctgttgcgctgatgactggttcgggtacccgtcgtagagggcctgggagccagcagcaagaagccctgcggatacctgacctgcaaggccatgctggccagcaatctgcccagctgcgacctggcttaaggtaagttgcctctgatatgctacgatatcagctgccgagaaaccttgtggcacacctgccattggtacgggttgatatgaaggaagtggcggtggcaatggcttggaggatgtaccaggtggggtaggtttgttgccccatgagcactaagaaagaacatgggaaattgcataagtaatcatgcaaaaaattgaaagaacagacgaaataatatttatttgaattggacaataccttgatcggcttcccacgcactaccaatccattggccatctgaatagccaatgctgcttcgccatggttactgtatctcacaaacccaaatcctttatcctgttgaacgcgaacttcctcaatagccccaacacctaaattatagaagtggcggtgaagctcatctcggttaacctgacaagttagataagtaaatgatcaatttaaggtgtcctaaaattcgagatgagaagtaattgcagcacactgaggaaagaggaacggtctagcaccaattccagggtaggatatggaataggaaataattagaacataggaagaaagaaaactgggctagcaccagttaatttctacctcatgtccaaggttgccaacatacaccgtagtacaatcagggttgttctctggattctctttacttccggtgtcctgacttgcctccattcctgcagaataaagttgaaaacaattcagaattagcagcgaggactatgtacgtcagtagctcaaattgctattgttaaagagcagctagatatgagtgtatttgctatggatgaaaataatcgtaacaaatgaatgtggttatgcagaaaatacaagttgcagcatcttttcacttcttttgttacaggaagcacttacaagttgcagcagcgtatgcagaaaatacaaatatacatggaaatccggtcatctcagatctttgtgtgttaaatttgatctttctaaggattaacataaaaatacaatgtgggaggtccattgtgtaatattgaagaacatcagggggctcaaaatgcagtgtaagtaaaggtgggataccagattcagaacaataaccaccagcttcggtcttttagaggttgactcaaaagtttatggccatggtgtaccccacatgctatttattcagctgaatataaatataatagtgccttttggtcatgaaactagtaaaacaactaacctggattactagaactaccatttgttagtacaactgcattatggttgtcagtttcttgtttctcttctgcattgttctttgttgcccaattacaccttatttgtctgcttccaagccatttccctattaaagcatattagtttgcaaaagtcaggaagttacaacactggaatgccagtaggttataagaaaaaaaatatattatgagctctgcttgcatgtttaccagtcatttcagttatagcagtctcagcttcctgcattgagaaaaatatcatgagtgataataggacaaaacactaggtgcaactgtaggactggacatcagtttacaaatgaaacttcaggtgataatcaaatttatgttcaagctatgataaatcataaataaaaaagcaaaagaaaaaaaactgacacttggaatttgcataaccttcatacaacagcaaagatcacctatgatacagtttgaatttttggctatggatgaattacataaggaacccgaagagctaaaattagatatacaacaagtaccataaaaaactatttgaatattaaagaatatggaatcataacataaaaagtaatcaaacctaccaataccaaacatgagaacataatattatatctcatctgaaactaacagtaactggtacacaggtggagaatagttcactgaattaaactacaacagcaatagctctaagcctctaacagaacactggttgccaggaaataaaagaaagaacgcaaataggttgtcactcgtcactgtagtatagctaaaacaccagaataataggtagagaataagctgtggaacacacatcacccacgggacaaaaattggtaaacatctgcgaaatggaaaaaggtctgagttgttcatgcctgttgattacggaaggagacaaaaccataacctctggagcgtccggttttgttatcccacatgactcgagcatcactgatcataaatgacacaaatgaaaaactgaaaagctacagcaaaaacaaaaaaaaaaaggtagaaacaaagaaaaagcatgtagtccaaaacgcaacattctaacatgtaatatcatcaattttacaatgggataaagtttatatagaaaattgagccacttgaaatcaagtcagaattacaaggcataagctgcagaatgcagataaaaattatcatatagtttatcatgtcacaaagaactaaggacttacgaacaagaaggatatgctgagaaacaggcataaagagttgcatcattcacttcagaacttaaatcaccaacaaaaatatggaaatgccctggaaatagttcagtgggcacagttaaccaaataagaattaaaattagaaacaaatgaaagacatgtgaggtttttctttaataatatctcaccagatgtatcctccctctgtgtacttgcataagcccagttcaccttgattgcttggccacatctgtgcaaaaaaaagtccataatgaagaaaccctaaaagaaacttgaggctctgaaacctgtgctgttgaagttaatggaacacgggaacttacatgtgacgaccatgaagggtcattattgcaagagccgctgacctccgatcataatagtcaacaaaaccaaaggaagactgtaacgaaaaagtgaattctcatcaaacagatgaatattaacaaaatgcagtaggttctagttattggccctgttcttttcagctacttcattggattgttacggtggattatttgctccaacgactctaaaaatatattttctcaaaaaactttcttctactgtattgcttaaaccacttgctctaagctactacctccatcccaaaatataaggagttttggggttggacatgggtattaagaaagtaggtaaaattcaatgtgtgatggttgtgattggttgagaagagaaggtaggtgaggattttaagaggtggaaggttgtgattggttaagaagggaataaattgttatattttgggacagatgttggaggctagaagttgttatattttgggatggatggagtatttcttaagtttatttctacaaatctttatttgatccctacaatcacgtagataattcactgactaatctgttacaaactgtgccaaaatgtttgatgacatttgaaccaaaatcacaccaagattgttagaaaattaaaactaaaattaggtcgggaatgttgtagtgttagaacgtggcgtttctcaaactttcatcaaaccttgggcacagcctttggatgcatgagcaggatgcataaacataccttctccttccggatgagcttgcatctttccacaaggccagaactctggaaaacttcgattagaaggctctcagtaacattagggtgcacattcccaacatacctagttgacacagcatcgttaattagaaaaataaacaaaacttcaaagtagttaactagcaaccatatattatacaaatttctaccaaagaaaaaatcagcatcagccttgatggaagactgtgcataacctaattatgcacgcatgcgtcaccttgtggaattccacattggtcataaaacaaaataagttggcagataagggggaaaatattaaaaaaaaaaggaagttgtataatatatgaaggtgaaagcaggaaaagactgaaagcactcacacactgcgacatgtggatggatcaaaccctggtggaagattgccatttgaaataggctccatctgcaaaacataaaatgtcaaaagaaaaaaaaaacaagactgacgcgaagcaagcacggcaaaacaagatagaaaacaaataagtacaatgaggaaagctaaacttggtaccaaataacataagaagaataggcacccaacattcaaactaaagaggaatcacaccagtagtgcagataagatatacacccacaaagcccatctagcaaaacatagtttctaagtcatctgttatccattaacatcgccatggtgatgtggattgttaagccagccttccaaacctatgttcttcgtgcagcaggtgatgtcgcacaaaaccaggctatttggtgggtcttataagatcgtgccattaggaaccttgaataattggagagtggaagcactagcctaaggagatacggaaagcattttgattaaacagattttagtatgcaccaagaatgtacactgagccaatgaggtaagggggacagcttacaaaaagttaaactctcccagattcataacaaatgcaataattttatacaataattacattcgatgtgaatatgaatagcatataggcaagtaaacatgatatgatcactttccccagaaattgtaaaggaagtgaaaacccaattcttccaagccatgtttcatcacggccaactcaaagtttgtctctcttttttcaccaaactaacctaacaattagcagttagcacgacatttgccatgaataatgacatgcaccttttatgcaactaaagacaacacatcacttgctcaattccaaataacaaagaaactctagttttcaagtgagagcctcctctaactactcaatcaatcaagatgcaacctaaaaaaaaggaggaggaatgcacaaagcaaaacaacaatcctcctggggctcgcgcggcagatcggcgcgcattactgctccccgacacgcgcacgcaatggcacgaacaaacagatcaagaagagagggggggaaacgggagaggggctgacctgggtcatggccgccgcggcggcggcggcgaggacgccggactggtactgctgctgctgctgcagcgcctgctgcatcaggagggcctgctgctgctgctgctgcctgagccgctgctgctgctgctgctgctgctggtggttcccgccggcgccgttcatctcctccccctccgactccgactccgactccggcggcgacggcgacgcggcgaagaccggatcgggaccccgggaaccgagggttcgcaaggaacgatcgacagatcgggggaatggatcgagcggatcgagagattccggggcgaatttcttgcggggatcgagctagataacggaggaagaggaaggtgagatttttctcgttttcttcctctctttttttcttttcttttttttttcgctcgcctctgttttttttctcctcctcgtcgagctccaatggaggttagagagggggagggtaagttggggattttcccctgtgtaggagtctaggagatggcatggaccttacactgacaggtgggcccggtttttttcccctggctctgaagcctgaatctgcatggtcacttgtggtcaggtggtcaggttaagacttaagaatatggatgtggtattgtggataggtttcaaaaattttaaaaggaattcgctatagtaggtaatatttgttttgtccaaatattacatatttggttcatatttatcttaagatttatatacccacggtggatagggtttgatgtttggttagacggatgtgacatacctgtggtagatctcagctcaaattgggccagagaatgagattttacgaaagaaattatattggaatttacttagggaaagataaatttttaagtcccattaaaagatgcttgagatgaaccatggctctggttttcaaacgattcggaaaaatttggtcttttgcttttcacgggaattagagccaaattattacatgatttacagcacattcgtttacattacaaagaaaagagaaagccaacatagttcgaatgataagacgttgttaaaagcaaatgctattgctaaatccccatccataattagcaaaaggttgcataatcatcatatttaggtaacagcacaagtccgatatcatttgtttgtcattttcgcacttttgcaacatggcccaaaaccaaagacaatgtgtgtctcttgtaaagtatctacatataaaatttaatagaaaagttatccgaaatcatctcattgcgacttaaccatatagcctagcatattccagatgtcccggctaatattgtctctaatgatggtgatatctaaggtaggattacagtgtatgattgcttatttttgggaccaacttcataaacataggttaatagattgcattaatgatttaaagaagaatgtcaaattacttaaacatacatttactcacaaatactctatgtctttttcatgtagctatatgtcttttaagtctagcggatgaacgcaacaaaagatgttatcatcccataaatgtgatgcatatgcatacatttttatcagtactaagggcctgtttagatcccctggcaaaattttcaccccgtcacatcgaaatgtttggacacatacatggagtattaaatataaacgaaaaaataactaattacacagattgcgtgtaaattgcgagacgaatcttttaagcctaattgctctatgatttgacaatatggtactacagtaaatatttgctaatgacggattaattaggcttaataaattcatctcacagtttacatgcgaaatctgtaatttgttttgttattagtctacgtttaatatttcaaatgtgtgtccatatattcgatgtgacacgccaaaactttacacccatggatctaaacaccccctaaactttttatatgccatgttataacctcaatacatatttatccaaataataccttaaatattccttaaaaaaattatccaacgtcccaaataacggaactaggtattttaatgtcgaaattttaccatttggttcaaataacaacctccttactagtgtcttgcggcattgtccatgtgatgaatgagtggtttttccataatattagccagtttggagatagggcatcctttggaatggaaaagctcaactggttaggttcattgtggtggaacctgtccacccgtgttcaagttctagatttgctcgcatttatgactatttattcttcagtgatagatgatatactcatcgacaacaagacacccgtagtgacttcgtcaatctcaagatatgtcagcctagtcttccagaggttctcaagatattacggtcttgtttttcggtgatgctcatagcaataggatgtgcgttcgtaggggtgttctcattatatgacgacctagtttttcggagatgctcgtagcgatagggtgtgcgtttattggggtgagtgtgcgagcgttgtgagcgtctacgtatgtaccgtatttcaaaaaaaaaaaggaattttctaagagcaattttatgggaatcaatccagattatgtaaaattcatgcctcccaaataagctctaaaatttgaagtcacacctctcccgcgattcatggatccatccaatatagtcaccaaaaaacgaagtataatcttccaattccaattccactcttgtcattgttggtattaacaagaaaagtacatggcaccaacacgaaaatggcgatcgaatatacctctacaaactttaaatgaacaaacaatgatttagatagctcacaacatgaaaacggcgatccaatatacctctacaaactctaaatgaacagataaataattcatctggatggctcaccaggggcctattttacaacgaaacgctaacaatcagtgcatcctggtgatgatgttctgatcgacaggtgaaacaattgtttccatgattctgggcttacttgcttcacatgcttctccataacatcacagcagataccagtaagccatattatgttttcaatacaaaatattgacactcaaacaataattgctgctgctccacacatgaacaaaagtgaaattacacaacagataaccagagaagaagaatgtactcctgcccagtatgtttgggacaaccagttttcctcttggctgctgatacgccatatttccaccttaagcttaaagtctttttaaaaagaagggaaagcaggtccgttccatatggtgcagataaataatgtagtgaacaagggaaccttaggaaaacaacggcacagtgcttaccccatattaaccttggaaagatatattttgcaggacaatgcatcgacaataccttttcttttctcgaaaacatcagcaggactcatatggaacatgttaagcgaaagatgatctgtagtatatatttttattttgaaggtattaccaccaatgtcaaagaccagtagacgtcataatgtttcagaggcatgaaaacaaaattattggttgaagtggtgtacaacaaaatgtaccgtgaaaagaaattcaatagctaacataagaagtctagcatcaattttgttttttgagaagaattcagacattaaggctaaattgatctaggacatgacaaggtttctagtgtcttcatgagactgtttacgtcgcataatgtttaaaaggacagaaaaatcttcatgcacatatatacctgtaatatgataaatatcaagaggaaaccatatcgttttagctgttattgttgtactcagatgctctcttcttttagatgtcagatgtatcattttgcattgcattgacattaacaagatctgtttggcagaggtgtgctacatatatcacgacaaaatattcatcttgggaagcaagcgattttgtaatgatatctcaattgttgctattacctgttcagttaaataagatctgaaatacagcagtaaatactcaggaagagctgaggaatctggggtatcaaatccagtggctggctcaaatggacttcttcatttgagataagaacagtgaaatactatagccgtctgaatagtatgcaaacaaatccaaacaaaataacttctggacagatgttgtggaggccaattggagcaacaatacagtgacttggaatgtcagattctcgttatgtgttccaaaaaatccccagctaatttcctcaattttgtcagaacgcttcctgaactatcagcaaggatagtttcaactggtgacactgtggcaacaaggacaaaattttcaccattactgacatttatttcatacaactcagagaagacatggcgaagaacatcaatcaaccctttgtagaaggatccatctgcagcaggagggataacattcaatatgaaagccccatcacgatgtaggatcgtgcgtgaagcaagaagaatgctttcctttgtcatctccaacggtggtgcactgactccacatatagcatcagatgaatcaagatccaccataatcgcactgaaattcatatcagggtccccttgatgagcaaaatcctggatcatttgaatagcatcaccaacacggacttgaaggaactcatcctctaccaatccaaaatggctccttgcaacatccagcacaacaccatcagcctctatccctagtacatcacactgaagccccattctgattgacatcagaagagcgccgccaccgataccagcacaaagacacctcggcttgccacccaaccgaaagctctcatccatggaaggggcgatcaccgcaagaccagcggccattgcctgtaggtaaggctggaccagctctccacccacctcaggctgcaatgaaccacctccaacctcatccaatgcatctaacatcaaagaatcacccggcgataattgccgcacaaggcgcacctgcgtctgaacaaggaacggcatccgcttgaaccgcaatcggcggcgcaattcagccgaacgtggcgcgcagtcgacggccacatcctcaacaaccatctcaccaaccacaggaccagcgacaaccttgacaggagcaagccggaggaggtcatcatggaaggagagcaatggcacgtcagggatagcatcgcccccaaacgcggcacgggggcatagagccaggaggagtgggagcagccgcgcgtgagcaggatccgggtccgggcgagcggcggcggcgacgaccaccacccgagaaggagacggcgcggagagctcggggccgacgaggatgaggcgggagaggtggctgcactgggagcgggaggcgaggaggaggtgcaggtggccggcgcgggtggagaagatccagtcgcggtgccgccccgccggcacgagcatcgccgccgtgcgcggcgacgggtggggtgaggagtggtcgagaaccgccacgcggaggaactcatggccgccatgggcgtacgggtcggaggcgtggtcgaggaggaggagagggtttgggaaggagaaggcgatgaagcgggagggctccacgtcctgcaagccctccagctccgagctgaccgccattgcagagagagagatctcgagcaaccaagaaacccaagcaggaggagcaatcgcgcgcgtccaaatttctcgacgagggtttcgtttctcctccgattgggggagtatcgcgaagattctaatggcggggagagagggttgacctgagattccgtcccgtccagccgccgccggcgagggagtcgacggggctcgcggcggcgccggcgccggcggcgacgaaaaatcgcctggagctgtgagctgagggtttcctctgtcactgtgttgtgggaccactaggtcagtgagaaacaaatatcatatgatatatttaccgttcttaaattaggtgtatttgaccccatgttttgagtattttctatgttcagtttaaaattatgttcccgttgatggaattggtacagtatcttccaaaatccattcttcggaagaagattgtaagcagtaatgcttattaacaacaacaaaggaaaattatgtaaaacttagtgtatgtgatcttagcgatttaaaaattaatgctggaaaatgaactacgataaaagaaacaaacaaatctaaaattaagttttaaacttcaaatattggttgtggctcataagatgaagagcaaatgataaagctgttggtcatctcatataacgaatgaagtcaggcagcatatgatagaaagaatttagagaaatgacatgatgaaaagtcccttagcaatatttgcaataagaatttggtactaatttattgaaatatttcgtatccccaaatgtacaactcaacactagctcccaaagactgtagaaaactctcatacaaatacatgatcagcgattcctcatgtataaaatgttgtttttttttacccatttagatctgtaacagcttacagatggtgatatctgacaatctccattctgcagcttatacagcagcaatatatacactgtagtatagacatatggacgggctatacaagagggtaacaaggccataaaaacatacagagaattagcacatctacaagactgcaacagagacaatagtctgaataatggagtaaacttataaatggaggcttctgggcactccaacacagccttcctcttgtatccatatttattgagttttcttgtcgataaatttactgtaagctcaaagtttcgaagccaaaattatcattgcctactaccatcctttgcactgtcatgagactaacagtcaaaaaaaagtcggtcttgaggcgacagcaactacagtatgtatgtaaagtgggttttgatcagtttctacattctagtcgccggttatcctccagggatgacccccatcagagctgctgcaagcttggttgggtagaaagctgtctccaaagtcgccgactaatctcatctgcatttcttcctgtggagaaagaatcctgatacatcgtacacatttcacaaagtccctgcacatgcaaagccatcggttcttagttatcaccgtgatacaattagaaatagctatactttgataggtgaataagtatgatcagttgaaaaaaatggagcctcgttatatttcccaatcaggtaagtggtgagatcactgcagaaaatatgcttgattggttttacgtaacacagagttgcttttagagtctctctacatgttttaacaggtaaagtaaatattcagctggagttagaaaacattctatggcatgtgaaactaacaagcagggatgtacagatctttgcgtgttagtgaaactaagctcacaaacaataaatccagaatctatatgaagttgctccaagatcatgttcactcaaatcagctaaccccatccatgggtttatcttcggtaaaaaaaaagatccacgcctccagaaagatattattgttagttttgtatgtgcagatgaaaaataagtttatgggatttgacttactcccatggatcatcaccaactagtagaacatccttctcgtgatcttcatatactagcttccagccaactctattttgatcaccaagctgcccctcaataccaaacatccgagcaacgtcatgtttcagctcatcatatccagaatatcgattgatgtcaattgatcttcccaccgcaccacgcttgtgtacctgtagataattattttggtcagcacaggtgtccactgcaataatcatcaacatgtgcaattatttcatgaatcttagttaagagtcatcctaagattgtaacttaactcgaaatttttttctaaaaaagatggtgtaaagtaacaagttgaggctaagctagataacaaaccttggtgtaggttctcatccgttgatgtgcaggacctgctgcagaccgggaatttctatttaagaatggggtatcattgattgcagaatctatagaattgaatgccatatcagcaactccaaatgaatgtgaaatcattgaagatgataactcttgttgagaatcctttgatgaaatgaagttagaaatgccatttcctggcaactgatccatgtatttatcggttccaatgtcattcgcaagcaggtctgcattaagtggtaaacccagttgaccatcaatattcaccccaaatagaaggttatttcttggatctgtaacctcaaactcgctatctggaactgtgtcttttagcaagtgatgctggtggaaggatgaaggtggaaagttttgttgcaatgatccatcagcctgggaaaggcaaaccgaagtagctgaagaggatgtgtccaagtaatccatttgaggattgttatttatgcagtcttgtccagtagctggcctttgttctgtcgtcttgggaatcataactgtttgctttacattttgatatggctttgtgtcctgttcgatcgtaggacccaacacaacagatgattgagatgtctttcctgctgtagttaaactttggttcttggagctacttgggatggattgcagaagaacaggattgctgttagtggatggtgatgttgaagtagacggaacatcatctgtcttcaataattggcgtccaccagctacatgcaaagaactagcacccatggaagtagcgatgtctgattttgaattaggaatgacattcccagttaagtcttgaacttggtgagactgaaccttttgctgtgtcgggtattgaatagtgttactgttatgtaaactaatagcttggtttgttacctgtacacactgctgaggagctgactgtgaatttatcacttgctgctgcaaatccaaaagcatcttctgctgctctgagatcagaggctgctgtggctgtaaagccttgagtagttgtagtttcatttgatgatctgccacctgcgtattcatacttgcatccatggaaacatgaacaggttgtatctttatttgctgatgttcctgtactgactgctgaacctgctggacaggttgcaactgttgtgtttgctgctgctgatgatgtaactgttgcggtatctgctggtgctgcacatgtggctgttgctgctggagaagctggatttgttgaagacctccttgtaagacagtgtgactttggaccgaaggttgcgtttgctggagttgggcctggacaacaacttgaggttgctgcagttgcgcctggagaatgacttgcggttgctgaagctgagcctgaacaacaagctgaggctgtggaatgtttatgtttggctggctgccttgcactggttgagtaaccacatgctgcctttgttcagagttgcaatcctgaaccaccttctgcggtattataacacttcccaattggtttggtgtagggataactttcgctaattgttctgtctgttggttttgttgaggtaccaacgcagtgttgaactggatgttgttttgttgcaagaactgcgggtgaaaactgatttgccttgataaatcagctgcagccaaattttgtacaggttttccacttaatgagtttagtaactctggttgcacaaccgtgccaggaagcgaggagctgtgctgcatgttcatccactgagctagatttagaccaggcactacactgttctgaatattcagatctttcttgcaaatctcctcaccaacccatggcatggccctcttgagaagaccgtccatttcagtctcgtcatctacagatgtgattaaattattataagataatgaaatcataattttctgttagaactgatattcagtcgaaaactttggttacacaataatcatagtctgatatgagtactaatcatccatagagtgaccttttatcagatcagtaactgtttacctgtcatcccaggtagccttggacgttttgcggtgaataatggtgaggggtagatgaagaatggagcaatgataggctctatctcccagagggaaaccctggtgcgtctctcagttggtgccgcttcatcccatgcaacctgcatatagttctacttattccagcaaaaacaaaggagatatagctttgtaaggaatcagaccaaacctgaatattgcgccaatgagatgttttccaccttactggatccagatcacttataccagttattgtacccatgtacctgcaaggaagatgtcacaaatacgattcagaaaagaatcttataaaacatcacacattcacaagtgcatgaacatgaacacagtcaacacagagagctgaatgtgactcaatgcagaaaaatgatgctcccaaaatatcctaagtgtgcacaacacacaccaaggatctttttaggtccagtctgtagcagggtccctgtgggagtcaaggtagctcgatatccaccccttagaggggggtttaggataaaaaattttcaactaaaaggaatttgaagtaatgagaacaagtatatgttacacaaataagataaagttcagaaactataccttcttgttcctgactcttcagtttcaaacatcattctgaaccgcatgccaagagataattggttaccatacactgccttctggtatttggcaaaaggaatcacaaattcggaagtactggccctgaataaacaaaaaaaagttcaaacaaaactaataacatatcatctcttcatacgttaaacctagccaaagatgtttaccttgggttataatatattgtaaattggctgttattcgctgcagcatgggctgctgcagcaagaattccaatatgcatactatcactagataagacagatgatgagaggttcgtaggttgcctatttgctcgtctgatccccaagaggagctgctgttttgcatccctatggtcggaatgaagaaagtttagtactccctcaagattgatttgttacagcaacattttcaagcgatagcgaggcagaaaaaacagtttattggcataatcagtgtacctaataaacaagactgaatcaccagcaagtaatctctttccactgacaaataggctccagcccgtagtcagtaaatgccttttaggctgacctggtgaagagaaagagaactcataaactttgagacattaaagcatgaagtaacaccagagtttcctgaaccttttagtaaccaaaggccaaagctgacatacggcagttgaatacgggtttcgtttacaagagtaaggcctttactaagttgcattagcttttatcatgcatcaaagggaacaacggaatattagtatttttctactgtaccccggtatatatgacgaaatgtccaaacattatcatgcaaatcccgggcctgcagttcctgggcaggaggctgcatggagaagtcctaaacataatacagtgcgcataagttagtagaagaaaccaagaaagaatcaacactttgttttccataaggttaaagtatgctcacaagacgaggaaaaatcctctcagcggcacggcgtggcacagagaaacctccatgagtgcttgtatcactggcggtcagtgttttgcaaaagaattctgtttgtggcctggtttgcttcagcgcaagctctgatgctagcaatgtctccttgtcacactgggtcacctaataatcccaattccaaaatcatgtcggtactgctacatcacataatccagaagatctaactgaatttgggaaattgcaacctacattgctaactggctggagagtcattcgagcataaacctcatctgtgtcaggatcagcctgtcatgttttgtcaagaaatgtgtcagtacagaagttcaaattattggcataatagagcactaataaagcgtggagctctttttctgtttactgatgctcaaagtggcagagattacaagcatggtgacactgtggaggatgcatatcagctttgatggaagatttggatagcttggaatttgcgcatctgcgtcctttcgcatagatgctgcaacctgaaatcgggtatccaggaatgagaattgttctccatgaaaccccaaaaccacttgcacaaaacttgcacatttacaaacggtgtgctagtaactctcaaagcttttgttaactctcatcatagaacttgtgtacagaaacacacatgttttctatatcaaactccatggtaaaacagaagcaaccaagtaacatgagcacttttcgtttgggttgattcaaattacagtgccgtataactgaatttgctaagaactgaaagaagattaacaaaagttgtatgttcgtagttgaaagttgcaaaaagattaaagttatctgcagataagattaaacaacatgtaaaggagcatcagaaaaggaagacagattgggaggatgcccaactccatgctcctccagcattgcatcaaatggcaccaaacctccatgacgcgacgacttaatctcacaaagaacaaaagcaaagggaagtaaacaacacgagcaattagacagtgaattaattcctctctgaaacctcttcctttatgaccaaaaaaatcgattcccaaatcttcctcttatgagaacaagaacaccgagaaaaccggaatctttttttccctatttctcgagaacaaagggaaagaaaccatttggatatatggccaagatcaaacgctcaagaaccaattgacaccggacacggaaccaatcaaccaaaccacacaaccgcaaagagagagagaaaaaaattctccgccgcacgcggacatgacgcgacaactaagagaagaaagatgaaaacgaaaaattcacgaaaaccacaatgaaaaaacaacaagaaccaaagaaagggagaaatctcccttcatccgaaatgggggaaaaaagaagaacaaagcaaagcaatcagcagcagcagctttgatcaaagacgacttcaacaacttcacaagtcgtcgtcgtcggaagcagagagctcggcggcggcggcggcggcggccgtacctgctcgctgtgaccctgggggaagtagacgatgaggctcccctgcggcggcagcgagacgagcggccccgcgcacgcgtaccacagctcctggttcaccttggtcgcccccctggcctccccctcctccccaccaccaccccctccgccggagctcgccatcgccgccgccgtgtctcccgagctcagtcaccgccgcctcagcctaccgcccgccggaatccatcgccggatggatcgccgccggcgaggaggaggcgaatttgaggagagaacagaagagactcggtagcagcgaagagaaaaaaaaaagtagtagtaatataatagtgcagccgagctaagcttactggccactgtactgtttaagcatcagagttaatttaatcgcaggctataattaattaattactctcgctaattaatcaaccagaacacatctggggaatggggatttgcagctgcaggctgcatcacgtgtggagagggattctatacgcgaaattcacacgcgcgagcgtgcgggtgcgttcgttgcgtgtgtgactcctatgaattctgacgaaagtctgaatacactgctccctccatcacaatgattccgttcttttctccaacaaaagttagacgaagattaatatttttatggcacgattttcaaactgctaaacggtgcaattcgtgcgaaaatttttatatgaaagttgctctaaaatatcatactaatctatttttcaaatttgtaataattaaaactcaatcaatcatacgttaataccacctcattttacgtaaaaaaaacttaatcttcatcttcatatttatcttcagaagaaaaaaaagccacctatacaaaactaacttctgactatacgtccagattcgtactcagaatttgattttttatgggacaaagagagcatctctgaataaacatatgggagcagccattcgttttgccttttcttcgtaaagattactaattaatgatgggattttaatttattttgtatactatccaccttttgacaactttgtttcttttctactacctcttttgatgtttgattttgagaagagagggaaaggtaatttgcagtgtatagcatttggggcaattttatctttctctttctctatttctttttgcctactttagttgtgcttctttttgaactcggcttttcagaagttttggatgcttttcagaagttgccaagggagacttcagaatattatttggagtttaactaggtgcatgcatgttggcatgtactgttggtaatatagtgccaattccttttctttttaccataaaaaatggatgataatatgctataatatgataatgtggataatatggatgataatggtgtattacttacaatttggagtttttttttatggaactcttcaagtgacccaaccatagtttcttcttttttttcttttttttaaaccacatgtgttaggcaaagctaaaggatgaagagaacgcttaactactgctactaataggactccaccttacgtgatactagtttcatagtgttaggcccagttgatagttgattgaattagatgtgtatatatagatattattcctttgggataagaaaaaaaaatcagcaatatactcttttcatgcgagtggggtttataaaagatcaaaataaatcgggacactagagttaatattattttgaggaaacttaaaactccattgctaaattgcttttggctctgattgttagagttatggctaataagctgtgaaaaaaatgagcaaagtaaccttatgagtaaaatttttatatgtgtagttatcattgtctattccaaggagtctctacttggccagcttccttagttcgtaagacaagccatcaaaaccgtgcgacttgtgggccaacccctgtttagcttagaccaagtctatggtctcatggggaggtccatgtgtccatcctctgtctagaaatatccttatgaaggttgaacattcgattatggttggttcagttgatgtgggtcgagatcgtgcccctagagctgtttagagacaaacacactttcactatgctagcgcgtaagatatgatagctggctgcatggtggccaggtcatggcgtttttctatgctagagtccatgactctgcattgtccgggactgccaggtatatcttgcccattgaggtcgagtagagtaggcatgtcatcccttctcggagtccaccatgtaatcgtacatgggaaggaggatgaagaccctagactctaggtgttgtatcacgagcaccccttggcgtctcatgacaggccaaatagtgttcatgagtgccgaagatgggtgggtgtgtgtccaaatgggcactacatcgcctttgggaggaatgcataggccacatagtccatccatcatattaactacatattctctcaagttgcctcttagcattaatgatgagggataatgtgtattgaagactcaatatctcttgggagtagctttttaggctcacatgagagaataaggagactacaagttagtccagtgtggattcctaggggagattgactgctacattaaatatagcgaggagttcaaggaattagttcggacttatgattatgtacagtcttttttgtttgtctttcatcaaggagaaaaagagagagcagggtagttgtagggtataaaaacccatcctaaaccctgtagaaaaggttagacgttaggaattggtaagaacaccagtcttcctaagctagttggagagcatccagagcttgtacgagttgctttgatagtgacgaataacatgagtagatttgctatcttcggaagacctgaacatgtgtacgtgcttgtgttctttcttattccccgagcacatctggacacgccgtcagcatctagaaccgtacccctggttgatcccgatttatgatttttcacgtttgtcggtgttaatactggtttaaaattaaccaagactaaaaaatggaccgataaaacaaacaccaaaattaaccttaggattaaaattttaaaattcaaaatttgattgtatgtaaattgcaagctaaggtacaagggaaatccaactgaactactatattgttcaaactgagtttattataaactactctatccatcttaaaatataagtattcatagtattcaacaaaattaattttagggtattgccttcttcaccgactatacctgaactggccctcatttaactttttacccaattaattttaccttaaaccccaatcccactcgaattgaatgacaaagggagtaactaatactacataatcgaaggtctcccataaaacgagccacagagatattatatcaaaatcattaccatgactaagcatatactgaacatgattgcatatatatactccatatatggaattaattgaacattagtgttattcatgcgcgattagatagaacttagggccatgctaattggctgctagctagctaaatagagctagagttagctactaattacctactagctgtttgcagcaagctgatagtgcaaccttagctactagagctagtggccttgcatgtgttgatcatcatctttactctggaatatgcatatccagctaacaataatgcatatgcattgcgtacatttgatgcatggctaacacaacgatcgatcgacgccgctcctactcgatcgtttcaccaatgaataattcatgatcagtttggctctttcttccaagccttttaatactatagcatgtagtatgagtaagagctactttctgcaaacccaagctcatggaccatgcgtgtactttatgttgcagtgttgcagctaattactatgtctgtttctctattgattttttaaataaagtttaaacatttgtcttatctaaaatttttgtgtaaatatacaaacatttaagtcatacttaaatacttaaagaacatttaacgataaacacaataaatgataattacataatttttttaataagatgaattgttaaatgtatctaagaagtcaacagcgtcatacattaaaaaagatagagtagttgatatagactagtacttcaaaattgaagtatagcaactacaaaaatccaagctgcattgcattccgcgcattcatccgccgaccgatcgatcgatcagcagtgatgggatgcaacatgggacctcttgcttgatgaacaataatatgatcatcatacgccggtgccactacttcttatcgtatacacactcgtccataaattaataattttcatcagactagtatataccgagttgtatgtatgtgtatgctgcctgattaaaaaggctgtcgtttcggacacaggtcaaactttcaaagttaagcaacaaattaataatatatatttataaatatttggaatattgcacacattcttaaagtcccaagcctccgaggtaggttcatatgctatggacttgatcacttgattagaggaacttcatcccaaatattacatactcaccgttgaattcttctttacaaaattcttatctagattccaagactaggtaagtacatagttaaaataaaatatagtacttcccccgtttcacaatgtaagtcattctaacattttatatatttatattgatgttaatgaatttagacatatataactatttagattcacttttgcttccacccttatgttatgatgcgattaaccaccgcatctacttgagagaggatcaaatacacaagcgtttcattccaaccaaatattccagataacagataacggggggatgagggagtcgaatcattttttgaggtgatctcggtgagagcactcccattagatttgaagtgccggccattgactagacgaagaggaaggaccaatttgatcttgaccaacaactcgtgccatgccaatgcttgtaaaaactgctaccgatcgagcttgatctcatgcctggattgattgaaaccagctaattaaacacgtgcaatataattcagactctttaaccgatccaaatcttggcattgtacatgtaatagtacaaaatatgcatggcagatgcatgctctggttggccacatgatcgtcgcgaaacgtgtgatggacgtacggcgatcgggtgagatgggatccccacatgcatatcatcaccgcttcatccgcctccttctttgtcctcatcttaagctaagctaaactgagaccatagagcttaataattgatcaactatatatacatctatccagtgattagtagttcttgttgttgccagttgccttctcttcagatagatagcgagatttgatcgatagatcgagataatgattaacttgtacatgcaggtgatcgatgcgtcctactactagtagttaatttctccaagctattttcaattcaaagaaatagtttcagcctctgaataatggaagcaagcggatcaacctgatcaagacgattaattgcatcataatcaacagagagttatttaagagctagctatttttaggccttatccgtaggctgccttcacatatatctctacacatcgagataacaatttttacagacaactaaaatacattaatatttgtgtagagatggtagaaccaatcgtctcttaaaataacacatgaaaattatacgtctccagtttttttttcacgtgaaagtaaccagatatatagcttgtttatttctagctatttaagttcatattaaatcattactctagtttactaatatattgacgtacaattcttttgcacgttcgggaaaagaatcttactctagtttagtttacttagtaattaaataattagataattaatatgtcgagacttctggtaatttttattctagtttctccactgaccagcgccatatgaaaaacaatttccaactacgatcggcttaatgccatctcgagcgaaaaccatctccacatgtgggcccttatgccagccgttgccacatatatttctttcatcccataaaaaatcaaaatagaatacaaaagcacatccaaattcactatattaagatatgttatatccaatcctatgcttcttttatagagggagtacataagaccacatgagttgcttgtttacactgataccttgtaagttgtaatgtaagttcatgcagcttagttgcaagatatatttgatagcgcagtgaaaaggggtgtgtggttttaaccttgagatcacgtgtttaatatttaacacgcttataatttttttagaaaaaaaaatatttggagagacgattctccctcgtttttatgcagctcagctgccagctcgatcgactcgaccagcttatgcattcagagatggacgatggctggccgtcatggggtcctcctgcagctgggcatggtggttgcgtcgttgcgagcattcgatccgatggggacgacacattgcgccgctagggcccccggatcgatcactgttcatcgacgtctcgtcggcacctaccaatcatcatcatcatccatcacacattcattttcgcagcaaatctctgaataattcagcagcagctcgatccatccatcagatcgcaggatgaagcatgtcatcgatcctgaatttagcctgacgagactgcatttctgtttcatccatactactatatgcaccggcgaaaactatgcaccgtgtacagtgtacagcgtagaattcagagttcagagtctcgtatcctctcactgggtgttaactgaagaatgttctcttgcagtgatagtattagttgttggcatgaacagctaggagtaattaatagagatatgacgagactgcatttctgtttcatccatgcaccgtgtacagcttagaattcagaatttagagttcagagtctcttttcccacaaattttgacaatttgaccctttgcaaaaaactatttttacaaataaaccgccgccaaaacttatttcaaatctgacccttttactcaacgccaaatcgtgtggcgctgaatttagacacctcagcgccaaatagcatggcgctgaatgtacgttggcacgctgacttagactgccatccgcgtgggacggcattcagcgccagctgacgaggcgctgaggtgtctaagttcaacgccacatgatttggcgttgagcaaaagggtcagatttgaaataagttttggcagcggttcatttgtaaaaatagtttttgcagagggtcaaattgtcaaaatttgtgcctcccacaggatgttaaccgaagaatgttctcttgcatatacagtgatattaactgttggaatgaagaattaggagtataattaattaatagagatatgactgagatgttatccactctgacgacaaatcatcaggaatctgtcaaataaagcggccggctatcctgatgaaccctagaagattttcgtcgctggaattgaatctccgggcactttgatcagcaaaacctgatgtgatgccaaaacgagcaccttgtcggctccgcggtttatgcgattggacatcactcacgcttgatagatgagataatgcgtatgctttcattagttgttgtactgcagtacaatttctactcagtcatgatatcattatgaatgaagctttgcattgtccaagttttttttttttgcagataaatgcatttgttaagaccagtgcgaccgatctgaggacaagaattattgcccattgacattgcgaatggtagtgggcaaacataattaaatgtttgttttttacaaaaatatcatacaataattttaattagttcatccttacagctcatgttgcctttttttttgtttttactgtttggcaaaagaattgcacgttactatattagggttttgttgtttatactaaatatgttcatgagtattttagggcctgttcactttgatgccatttttaaccttactaaattttagtaatgttgccaaaaagtagtttgctgcaaatttttggtaactacataacaaatcctgctaaaattttggcaagacaatgtcaaaatttggtaaggttgaaaatggcaacaaagcgaacatgcctttaaacttttcaatagtttacgcttttcgtctttttgttttaaaatatagtaacatagaacacgcaattagacatcagctaccattacaaaagatatattagaacaaaggacatctttactctctctatctattatattattaaaacagctttgaaagaaggcaccacgttcgctgtggaagttagaaatttccacattaatcagtgaaaaagaaaaaaaaagaagagtccaagtagaagtacaatctaaaaatagttaaaattaggaattaaaaataagcaatattgaaacaagttttcatataggaacccaatacgagattaatcaagattcaaaataaaaataaaataaaatccaaaattagaaaaggaaaggagagtccaagtataaatacaattaaaaatagctgaaattcagaattaaaaataagcaatgttgaaagaagttttcatataagaacccaatacgagattaatcaaaattcgaaataaaaataaaataaaatctaaaattagaaaaggaaagaagagtctaagtagtatacaatttaaaaatagctgaaattcggagttaaaaataagaaatattaaaagaagagtccatataagaacccaatacgagattaattaaaattcagaataaaaataaaaataaatctgaaattagcaaaagaaaataaaagacgagttcaagtaggaatacaatttaaaattagctaaaattcggaattaaaaataagcaatattaaaagaagaatccatataagaacccaatacgagattaattaaaatttcgaataaaaataaaataatatctaaaattagaaaaattaaaagagagttcaagtaggaatacaattagaaaaggaaataaaatccaaaattagaaaaggaaaggagagtcaagtagaaatacaatttaaaaatagctgaaattcggaattaaaaataaggaatattaaaagaagagtccatataagaaccctatacgagattaattaaattaggaataaaaataaataaatccgaaattagcaaaagaaaataaaagaagagtttaagtaggaatacaatttaaaattagctgaaattcggaattaaaaataagcaatattaaaagaagaatctatataagaacccaatacgagattaattaaaatttagaataaaaataaaataatatctaaaattagaaaaattaaaagagagttcaagtaggagtacaattttgaaacaactgaaattgaaaataaaacattaaaacattaaaataacacaatacgatattaactaatttttttttaaaaaaatctgaaattagaaaaagaaaaataagatttcaattaggcatacaatttataaataactaaaatttgtgataaaaataaagattattgaaagaaaagaccatctaaaacacatgacgagataaattaagtaacatgcctataaaggagtagagtggtggcggttgatacgatatatagaaattgttaataaaacactaaataaaatcctaatgacgattaaaaggagggacatcaggcaggccgtaaagcaaacgagtaaggcggtgccgggacttctagaaagtaaaaaaaaacccattgataatcatattcattttttaaaatctcaatgacaataaaaaggagaagcagcgggcgggatgtataagagtatagttacagagccaccgacggttgacgggacttctagaaaataaaaaatgaattccaacgatagttatattcaatctttagaatcacaatgacaataaatagttggcggcggacgggctatagaggggcatagtggcatcgtttgatgggacatctaaaaattataaaaaataaaactacaagtccaatttttaaaggtttaaaacttctaaaaagtaaaaaaaaacaatgataatcatgttcaattttaaaatctcaatgacaataaaaaagggaggcagcgggcgagccgcagaggagtacgatggtaaagctgctgacggtttggcgagacttctagaaagtaaaaaaatgaacccaaacgataattatgttcgatttttaaaatctcaatgacaacaaagagaagagatagtggacggcccgtagaggagtataatggcaacgtttgacaggacatctagaaattataaaaatgaaatccaacgactctaaaagctataaaatccaatttttaaaggttgcaagaagaatgaatagaaatagtggtagatcgagcaagcaaataaagaaggagatgacataaggggtagcaactggtgtgacttttaaaaactacataattataaacacgaggatgataagatttggaatttcaaagtctcatgacaatgagatagccagatagctattttataaattttaagtaaaatcatactaaaaaatattatgattttgtttgggtgctagccgcgcaattacgcgggccagccagctagttaattatataatataacaatataaaacacggaattgacattgtggaacataggggtcggagtctcgaaggtggctacagaggggaaggcaaaaggcccaccaactgcacggcccaatacctgaccaatcgaaacccaacaggccaacactgcgggcaatcccgttccggcccaacttaaatgggccgtccgtaccacggcggagctccggcgagctgccacggcggacgcggagggattcttcgggatcgcagaatgttgggatcgtacgttttcctagtactgaattcaaacaattctcttgaatctgatccaaattcatctctatttcagttgaaaactgatttctacagtacagcaacagagtacacggggtgaaaagatttcccaatttcaccaccacatcaccgggctcgcctgcccgatcgccggcagctgctgctgcggcggcggcatgcagtgctgcggccaccgccggaacaggtacccctcgccgcagccggccgcggcaccggcgccggcgagatgcgcgccctcttcctcgacctccatcgcctccgctgagccctcgccgtcctcctcctcctcctcctccgacgacgacgagacgcccacagtatcctccgccatcgaatcccccgccgctgccggcgcggagccccacgggacaagggccatgccggcgccatcctcttcttcttcttcggcgccggacaacagccgccgcaccgtccggctgtccgcctcccgcagcatgtcccggatccactcggcgccagcgcggaggctggcccacggccggagccgccgccgcagctggccgaggaggccgacgcctcccacagattcgaccggctcgtacaccaccatagccccttcacctaccgccgccacctccgccgccgacggcgcctcgcccatcgccacgtcgtccgccgccgccgcgtcgtcatcgcgcaccagccgcctcatcttggtcgcgcggcaagcgagcgggagcccgccgtcgacgtcgccggggcaaatgaacagctcaggctcctccccgcccttcctcttcagcgtcacgccgccgccgggggactccacgagcaccaccatatcctgctccactaatcaatcaccacgtcgctaatctcgccacttaatcccggtgcactcgaaggttaattctcgcatcgcagcgaaggggggaagcgaaatggcgggagatttatacggggctcgtcgagagaggagtggacgagtggagaagaagaaggcgaggaagaccggagaagcttcggttccatctccggaagcctctagaatgcgcctcgcttctcgagacagcgacagcgcgtcacctgggcggcccacaaggccaccattctgggccggatgggtgatgggccgaattggtggtgggccgaatggcggaagccgaggaggggtgtcgcgcgcggtttggccgtgtgaggtgggggtttgagtttagtaccacctcggcgagcgaggcgggtggtggagggggaggtggctatataaggggggttgggtgtgagggtggaaggcacgcagctgcgtggtgagcacaaagcgaactatt

SEQ ID NO: 79494 - DNA, 2843 bp, Oryza sativa
tgtgcgcgccacaattagcagcatacgctaaatttaaatttaaagctttgttttactaaatcttgaaatgttttggcggaaattcaaagctttcagccgtgagatgtgccaaatgtttttaagtaattgtataactctgaaatgctcaacgaaagactacgggattaacttgatgatttcgagtttgaattgattttaccaatgcctgggattaacttgatgatttggggtttgaaactttgaattaattttaccaatgctgatttggggtttgaattgattttacgcctgaattatcagatatctacaatcgctctctgtaaatttggtttctatagaacatactacaatttatactccactactgttttaaacctggatttcctctgaattaaatttaccaatatctgcaagttttcagaatttacagtgataatcagggaagactcatcgtgtcagagctactcctggtcacaccggacgaggcggccgcgtttgctgcacagcgcctgctcgccgccggccgccgccaccaccttcccgtagctgtaccggagcggcatccttcccagcagccggtggaactccgtgatgcaatcccctctcttctcccagtgcgccgcgccccccgtcgagctcaggccgacggccttcatctcctcgccaccggcgccggcgccggcgtcggcatcgtcgttcctcgggtcgccccagtctctgatgctgccggcctccaccagcaccggcccctcgccggactcctcggcggcgacgaagttcatcaggatgtcctcgcagttgcgctcccggtccaccacggcgcgcgccgcggcgagctccggcgagcaggagtactcgcggaggaggcccgcgccgaggacgaggagcttggtgagcaccatggagtagcgcgcctgctgccgcgccgccgcgccgtacgcccacctcccgcgggccaggtcgaggtggtgggacctcgggaagaacccgacgagggtgcccgggcgggcgcgctgctgccaggcggcgaacgcgaaggagagcgcggcggcgtccgggagcacgtcgtcgtcggcgacggccacggcggcggtgcggatggacgggtgcgggaggaagcgggagttgagggaggcggaggcggtgcggtggagggtgacggccggcgggaagcttgacaggaggctgtccggtgtggaggggttggaccagagcacgacgacggcgaggacgagcgggtgggcggcgtacgctccggcgatggcgcggagcagcgggagccgccgctccgagtagccgctcaggagcaccgtgagccggtccggcctcagcgtggccgcgtccggcatggactccactccgcagaacgcctcttcttcttccacaccggctacggcagcggcggcggcggcgagcgtcgccgcgagcaaaaggaggcggaggcggcgatgcgacgccatggacgcggtggcgagatctggttcaagtgttcaacgctggagccgttgacttgtgagttaaaaatgtctcgagttggattctgtgtgggccccagtgtcagcctcggtggtgagtggtcgtgtacgatccgacgtggactcgcgtgggcccggggcgtcaggcgcgggagccgttcgttttccccgcggctttatccacacgaggagggagagaagaggtggagagggagaggcgaggtgtaaagaggcggaacaatggcggcggcggcggcggcggcgcattggtgcggcgcggctgggctagacaggtgggtgggccggtggcggtgtaccttgtcgccggcggctctgccggtgccgtcgcggcggacgaggaggaagggcggggtcgtcggctgcgtgtccgttccaagggaggtcgccgcggccgcggcggtggagccggcggcgccgccggaggctgaggccgagacagaggttagttatcttgcatgctccctgagctcgccggcgctttgccggagcagtgtgtggtgcaaccgtgcaatcctcacaccgacaggacgggcccacgggtcagcgagacagcagtggtgccctgtggtagttctctctaggaagtccaaccgcttaccatttgtaactgtcctaaccttgacctccctccgccgtccgatctaccataggcggttcagatcactaggggcacgtttggatcctgggcaagggtcaccctagccttgcctggcaaggctatccgtttggaactagtaaaatagcttggcttttaagggcgagttagttgtacagggcgagaaaaaccttgccggctagggagagccaatttggctcgctttcgacgtcaaacttcactcgcgtgaaaatattgtctgcgggcgacgcggacttctccggaatcgctgatattctctccccgatcaggagacgaactcattagcagcagctcaatccggaggcgatctcatccgcgtagactcctagatttgatttcttctttatcgtcagctcctaacctcttctttctgagatacatggtgtgctgtcttgttcaatcgctctgtcaggaagttggtagagttagaaaagagcgtctttgagatcgtttgctttgtgctagatgcagcctttgcgttgccaagatcatttattatgatggtacttgattaaggaattctcttgatttctcatttgtgaatcctaaaatattatgggccattttggtttgatatcaaaatgttgccataccaattttttggtaggttaaatagtaaatgtgatgatttggtttgaagccaaatattttgtaatgactatattcaatttggcacaattctagaatgttcttcaccacaattcaaaatt

SEQ ID NO: 79495 - DNA, 17470 bp, Oryza sativa
agcacaaacatgtttttttcaaatacgacaataagaacattgtaaatacagaagcatatctgaggtaaaaacaacatggtaaaaggtttatcatagtatatactagccaacatatcgacagaaagctgtgaaaacaaatgatatataaggaaacatccatgagagaatcatcactggaaacaaaggtggcacaggtattttgctcctgttggtttgtgatattaaaagaagcatagctgtgagtacacttcaactattattttagcctctggtgaaactggggagatgctacttttctgctgaatttaaattgcaatattacgttttctttttgaaaaacagttctaatgcttagtaacaagttaataatgggtcgttttggattgaagccaaaacgtgaccctaccaaaattttggtaactttaacagtaaacatgctagtttggattgaagccaaacaattggtagcgcccacgctcaatttggctacattctagaatcttcttcactctcatactaaattttggctttatattggtattaaaccaaacatagattagctaactttgccctaccaaaaaattggtagtgccaaaatttgcctagattttggtaccaattaattggtagggtagagaaccaaataggccctaagtacccagtaagtggctttacagtggaaccttttcatatgagcaaagaataaaaattgactaaatctagaaatgctaactactcatagatgcaaacatttgtcaaagcaatgttcataaaaatggcaaatctatttaacaggtaatctatggctccaacagatggagaatatgggtcgttttggattgaagccaaaacgtgaccctaccaaaattttggtaactttaatagtaaacatgctagtttagattgaagccaaacaattggtagtgcccacgctcaatttggctacattttagaatcttcttcactctcatactaaattttggctttatattggtattaagggcttgtttggtttagtaccctaccaatatattggtagtgccaaactctaggcaagctttggcactaccaatattttggtagggtagaattgtaaatgagtgtctttggattgatgccaattgagagccaaatttcaaattatggtgaagaacattctagaattgtgccaaattgagtataggcattaccaaatatttggctttaaaccaaatcatcacatttactatttaaactaccaaaacattggtatggcaacattttggtatcaaaccaaaacggccctaaaccaaacatagattagctaactttgccctacaaaaaattggtagtgccaaaatttgcctagattttggtactaccaattaattggtagggtagagaaccaaataggccctatattccctattttcttgtttaaagggaactcatacactgcctagttactctaccatgtactagcagcatttagtttgggcaagaacagggccatttctgcaagtgatttgaaaggcacaaaatcatatgcaccttctttagcagatcattatgctcactcctaggcttcgcctcatacccaggcggcgggaatgggaaacacctggacattgtgcccctcctggaagatcaatcacaaaactgaatccccagcaaagcagctcaacagattctcccaacaaatgcttgaattctttctcatgcaacatatcccctctctagcatatcatccccagcgccggcaactgcgcgaggccggtgcgccgtaaccccgatttccaaacactcagatgcacaaatcaatcctcaaaacacaaaatactacatctagacctaaacaaaaaaatctcccgattctgtgactgcttggagcgatccagctctcagaaacaccagattgctcttgattactctctaatttgaggagaatccaagtggtggcatgaacagtacgtgcaatcctcttccatctgctcactccccaccaccgatccccaaccacagccacagcagatgaaactgaaaccccggcacggcaccgccgcgatctgagtcgctgcaatctccaccggcgccgccgaccgcagcagtggcgccggagacgcagcgcatcaacaccaccgccgccgccgccgaagcttccggaaaaaaaaaagtatcgggcaccggaaaccctcacaaactgcttcctctcgatcttgaaccaaaacctactaggaagaggccccccgatctagcgaatctttggcactccacgcctccaatccgtcgtcgtggtcagtggcggattcttcgaagaactcccagaaaaatttcccaagaacgcgaactcgatcagcgggatttcgcctatctctctcggtcctgagactttcctcttcgcttcttctctcgctctctttggggattggttggttgcttcgccgcagcgaaaacctgcgagtgcgaggcggcgacgcaggaggaggaggaggaggaggtgaggtgtactacttgctacagctgctgctgctggaggaggagacgtggaggaagcggacgaacaccatgtttgggttacaggtgtcgagctaccactgcagtgattcatcatccttccgtcattcggtttgttgcatggtagactgtagactggatgttttatggagttgtattatacagtagccctctataaaaagttattttataaataaatttttagaaaaaaaaatattttacaaatagactcttttcttaggctgtgttctttccttcgagttctcaacccctctccctcgttttccgcgcgcacgcttttcaaactgctaaatggtgtgctttttgtaaaaagtttctatatgaaggttgcttaaaaaaataaatttatctatttttttaaaaaaattagctaatacttaattaattatgcaataacgtgtgtttcgttttgcgcgccgggaggaggaacgcagccttagcctctcgcagtgcaaactatgggacccatacccctaacacaaaaaattggtccaaagacagtcaccccacagtgcaagcacccatatgtatgtggcttaattgaatggagacacggatgaaggaaataaagcccacagtggggcgtgaccctagggcgagcagccggtgaagcgcaaggaaatttatttcctcacctacccctccagagcttctctcttcctcgcccttctttctcaacctcttctcctcctccgctccatctcgtcgcctacctctcctcccggggcggcgggaggcgtcccctgcggtggcggctggcgcggcggcgggaggcgtccccggctcgtgctgatgccgctcgctcgccgaaggaggttggtcaccagctacatcgggctcaccggcatgcgggcgagggagtagggcgtcggtgtccgtggcgacagcgtgaggtgtccccggcggcggctgctgctggtgcggtgtggcggcgagcagccagagcgtggggcggcttagcgttggatctggccagggtcggcgggaatggacggcgcgacgccgacgggcggccggcggcgggagcggacggcttctccacctcactgatttcccccttccttttctctaccaaatgactcagagaaattttgttgctttgcttttctctaccaaatctgtggtgggcgtttggggggattttcctacgcgtttggggggatttctgttcgtcaatgatttctttggagggcgatttggggttttctacaggtggattcggcgcgagggcatggggcagcgaagaaatgcccacagcgcgcgtgcctcccttttccccggccgctcgcgccctcgctgcaacgaagtattgcgccgcttaggtaggggacgggaaacctagcaaaggcgcggtccctccctccacgtcgaccaaaaactgagctggcgtaacgaggttccgcgccagctcagtgcaccgtgagaggccttagtgtaatgttattgacgccgagatttaatgtctcgttgatatcctcgttctcctgagatatgttattggtgtgaaaagggattgataccagtgacagatttgtttgtaaatggatctgagaatgattagaatgtaaatatttttttcttacatgaacgcagagcaatattttttttgagggattatttgtaagttttaggaaggactaaagtataaaagaacccagtcggtgtagacttgtcgctgctacggacgaatgaccgtacgatttaggacgacgacgaaggcggcgccacgcggaataagttcactttgggtctctctatttgtcgcctagtccgattttcgtctcttaaccgtaaaaccgggtacgactcatccctcaatttactaaaaccaggcaaatgagatccctcggcggttttgaatgcggttttggctgacgtggcgcttacatggcttgtctgactaggtcttcgtcccacgtagcattgacgtggcgcttacgtttcaattatatctcgaaaaaataataaaaagcgtggtcccacatgtcagctgtacacaaaaatattttataagtggtggggcccacatcaacctcacacctctcttcttccctctcccttctctctcttcttcctttcccctctctctctccttcccgggctgccgacggcgtgggtgggccgaggagcaggcgagctccggcggcggcggcgggcgtggtcggtgccgcccccgaccggagcgccgcggaaagcgcggcgttggcggcgggtgaccggagaagtgcgcacgccgggcggtcggagtcggcgagcgccgcgacgtcggaatcggccaaaccaacccttcctcctccccaaaaataccctctctctctctctctcttcgccccaaatcccccaccgcctcccccacctcctaaccctcctcctcctcctcgtcgttgccgccgtcggcgtcgccgagtcggcttccgaagcggacgccatccacgacctggccaagtcggtcccggccctagggtgggatggcgacaacgtgtgcagcttcgagggtgtcacctgcgagcggggcgggtcggggaaggtgacggagctcaacctcgccgacagggcgctcgccggcacgctctcctccctcacctcgctcaccgcgctgcagctccaggggaacgcgctcgccggcgccgtcccttccctcgccgggatggcctccctcacccgcctcgccctcgacggcaacgccttcacctccctaccacccgacttcctccttggcctcacctcactgcagtatctcagcatagacaacctccccatccagccatggcccgtccccgacgccatcgccaactgctcctccctcgaaaccttctttgcctccaacgcgcttcggtcagggggcggcgccgaccacgctcgccgccgcatcccgccgccgccgccggagctcgcctgctcctccgcccacccgcgccgtcggcagcccgggaaggagagagagagaggggaaaggaagaagtgagagaaggtggagggaagaagagaggtgtgaggttgacatgtggggcccacgtgggccccaccatttataaaatacttttgtgtaccgctgacatgtgggaccacgctttttattatttttccgagatataattgacacgtaagcgccacatcaatgccacgtgggacgaagacctagtcaaacaagccacgtaagcgcaacgtcagtcaaaatcgtcttcaaaaccgccgagggacttgtttacccggttagcaagggacataaattggactgggcgacaaatagagggacccaaagtgaacttattgcgcgccacgctaataccatggaggcccaaacccaatctgggccgtcaaatcagccacggtcaggcccagccggcccatctccaccttgcaatcgtgccaaggcctcgtcaccgcggcggcggcgcctccggcgtacggacacctggtgatgatgatgatgatctcaggtgaaaacgacggtgagccacagcactgagccttactttctcacagtcaactcctctcactaccagtagtggcttctgactgatcagtgagtgactgagttagtgagtgacagatatcaaggctgcatcttccaagaatcatggccaccaaaaggtctcctgattgcgttgacatatgctctgtgattcatgatgtcgcttcgttttcaagggacagaaacatgaataaccaatgcagattcagacattcagtagaggccagttaggacatacagaacaggctgtgatggtagatgagtttggttatgtgttcaaaggagggaaaatttggcttggcttggctttgctggcctctgctaactaccaagtgtgtgacagttgagatctcattaactccccaggttttcctccagagattcagagtgcagaagtagatgcatcatgttcattgttttcaatttacagttaggatggacagcacaatctcacggagtcaattttgattcagagttgggagatctgggaggtcggtctgactgatcactttgctttttatttcattggctaaatggactccattgtacagacgaaccatcattgtttcagagattagggttcaagagaaaaaaaacctgaaaaaaatattactgtcatgtttcagaaaaaagaaatcgtcctgcaggaaaacacactcattttagctccgtaattgacagatggggctgaactctgaagtctgaagtcatgaacgtctagaagaagtcattgcaacgtgggttatctttacaaaagaaaaaaaaaagatgaaaaaaaaagagaagatagcaagacagcaaaagcgaaaggtaaaatggaaggtggctcatctagatagttaaaactgtagatgatgaattaggatatcctttttcatcagacagtggtgtcccttgatccaagatcgatcagggaaagcgaaaggttgagcctgcccattcctgcaccgatcgatgcatggcttgaaacttgtgatcgagataatggtacaagatgagtgagcaagagagcataggtgtactacaatatcaccaaaagaaaaggctccaaatcttagcttttgccactgtccactcaactagtgcaggtccaaatggtgatcttggaagctggaatcctgaaattagctaataaaaaagaattaaagcttcagaaaagcaactcctagtacgatgtttcttttctgaaagatatgtagtttgcaactaggcttctcggatacagagaggatgcgatcaaagatgtacgagtcattttcagttaacatatgagattcatcctgcccagcaaatggttaagaaaagaaaaggtgagctttgaatgctgtttggaaggcacaggtagtggtactgtagtagcagcagtacagacagagttaaatccattaaccaattctttgatgatcaatgggtcagggagctggccacaatttcacaatctggctccatatgtacagtgccgaggtacagacaaccaatttatcacatgagatttaggatgaacagcacatgagggaaatcaatttagactggatgcagttaaaggaaaagacaagcaacaatctcagcagtacataagttgtctcctacctgtgaaaaagggtcagaaatttgcaagtggtgaggcacaaaggggaccaaagtctggatgaggtcaatatttgcctaaccttatgcttatactagtcaatgactggctaatttctccagctcaccttgtccatggggaccaagcttatgatacagtaacagccaggctagatcggtagtaccaatccggtgagcaatgcagttcaagaggtgatactagatatttattggccttattgagtagtttagttgaaatgtgataggttatagaagtaatgctgtaataaaaacaggaccctttttgacatgaagcaggtgaataacatgttcagttacttcaactaataaagtgattgtcctggagcacaatgccaaacctgaactttttttattagtatttttaaggatggcaagcatcaggtccaaattgtctccctggccagctgctgatagatattccatttttcatatgctgaaaaagatgtgcaggcaggcagattttgttcttcatcatcaccacagctcatcagactttcagagggctccatgtagtttttttgtgcataatgtattattctctgtggtcctatcttgctagccatgcccaatgcatttctcttcacacttcacaggattgcctcagcatgacatgaacacattagctaagcttatctaagatcaatggtgtgaactgtgaaggcaggagtggacaagagcaaattgggttaagcaggaatccaatgtgtacacacgttgcagcaatcttccactcacacttcccccttatgaattcagaattcacactaatgcatcagtcagaatgttaaatatagatagtgaagtcacaccaaaattggaagtttggttgaaattggaacgatgtgacgaaaaagttggaagtttatgtgtgtagaaaagttttgatgtgatggaaaagttggaagtttgaagaaaaactttggaactaaacacggccgaaatgaacatacaaaacagcttgaagctcaagaattactgtatttggtaggagatttttgatgatggacacatcatcaggagttgctttctgaacagcatgaactgggggctgcatcactgtagtcagtcactgtaccaaaatgctcaatgctcccttcaacctttcatggatgctatctaaaaagcagcagcatcgattcccaaacgattgtattccattccatcaccaactatccaattccactaccaatctctcacagatagtgccagagaaatcagaagcaagtcacacacacacagaattcacaaacactccacatgcagtaagatgctctggttcagagaacagtgcccaaaactggacaggttttataaatgcagaaagaaatcgcagcaaagtccaccgccaaaatttaaagtatatatataaatttttttatggcagcctgaagctgcttggatttacacccactacagcatcttgtgttcttgttgctggcatgatcattcaggaatcacaccaaatgagaccaaatgaacaagaacaagatggtaattaactgaaaagaataagttcagaggaaaatattctaaaccagaaggattccagtgacatcatctttcttcttctgccctggctccttcctttttttgctctgtcatcttatctatactccagtccatttctttttctctctactagccatggattttgcttaagcagcataagcaaaattcagcatggttgattgcatccatcatggagaaacaaagcagcaatcttttaaacaaattagcactgaaaaaagttgcaggacgagtgctagcctccaaggacaattgggtggacacgtcacgacgcggcggacatggccatggatttcctcttgcccttggcgatcttggccgtgtcgagcttgtagtagtggacgaaccagtcgacgaagcggcggaggccggcgtcgaggggggtcgccgggcggtagccgaagtcgcgcgcggcgtggctgacgttggcgtgggtgaacggcacgtcgccattgctgggcatggtgacgacgcgcttgttcgccttcctgccgaggagcttctcgaggatggcgaccatgcgggtgaccggcaccggcgaggtgttgccgaggttgtagacgcggagcggcgccgggccgcgcttcttgccggacttggtgccggtgctctcgccggccgtgtcgagcgcgccgaggcagcccttgacgacgtcgtcgatgtaggtgaagtcgcggcgcgcgtcggcgccgtcggcggtgcggaacagcgtgatgggctcgccagcgacgatgctgcgggcgaaggagaagtaggccatgtcggggcggccccacggcccgtacacggtgaagaagcggaggccggtgatggagaggccgtagatgtggttgtacgcgtgggcgatggcctcgccggccttcttggtcgccgcgtacagcgacgccggccggtcggtgcggtgctcctcggagaagggcgcgtcggtgttgagcccgtacaccgacgacgaggacgcccacacgatcgccggctgcgggtcggcgtgcttggcggcgacctcgaagacgctgacgaggccggcgacgttggacgcgacgtacgtctgcggcgcgcgcatcgcgtagcgcaccccggcctgcgcggcgaggtggagcacgtgcgtgaagcgcgccgcgtcgaacagccgctccagcagcgcggcgtcgttgatgtcggcgtcgagcacggcgacgccgcgcgacgccagcagtcgctgccgcgcccgcttcagggacgggtcgtagtaggagttgaagttgtcgagccccaccacgccgtccccgcgcgcccggagcgccagcgagcagtgcgcgccgacgaacccggcggcgcccgtcaccagcaccgacaagcccccgtccctcctcggcgccgcgctcctcctcacctccttctcccacgccgcgcccccatacgccaccgccgccgacgacccaagcaagctccggtgcgacgaccgcgacgccgccctgtgcttcccgttcgcggcggcggcggcggaggagaggtggaaggagtgggacagcagcgacgggtagtgcacggtgaagaggcagacgaggcagagcgtcgccaggatggttgcccggaacagcaggtgcgacgacgccgacaggagcttgccgctcgccacccggcgcaccatcagcgccccgccaccaccgccccccagcttcacccccttcgccgccgcgtccaccacgccggagtgcggcatcatctgctgctgctgctgtttgctgccaaggtgttcgaccgcgtgcgcgagagtgtgagagtgagagtggagtgaggtgagtgagaggtggtggctataataacacgcggcgtggtgggcagcgggcggaggaggcgcgggagggaccgcggatttgggtcgttttaccggcaaaacaagctgagtttgggtgcagcggcgacgcaaccgtgtgtgcgtgtgggttgggggagacgcgcagctgcggcgtgcgggcgtgtcagaaatcaccgcgtcgaggtgagagtggatttatctgggttgctttgccaggtagtggccggccaatcaactcaaagcacttgcccacacggtacgtaggagtactgtacatatacaccctctcaaaaagagggggaaaaaagcaggttggacatgagccttgtagttttgtagtccaacgcggtttcatttctgagttgatgaaaatgtagttatatctttttttttcccgtgttgggtagagttggagtgagcaagaaatggtgagaaaatttcttgttttctctgcgcatgtttccaaactcttgaaaggctgcggttttttaaaaaataatctatagtaaagttacttaaaaattgttttaatttatttttaaatttgaaacaattaactcttaattaataatatgctaatggctcatatcaatttacgtatcaacttttcgctcctctcaaactcagccttaggatggattataagtgaggtcgataacagttgtaccattttgaggaatagaaagaaaatatttatcaaaataggacaaagagactccgggtgtgtttaggcctggtttagttcccaactttttcttcaaacttccaactttttcatcacatcgaaactttcctacacacacaaacttccaacttttctgtcacatcgttccaatttcaatcaaacttctaattttgacgtgaactaaacacacccttagttcacaacaaaattggaagttttgttgaaattggaacgacacgatggaaaagttggaaacttgtgtgtagaaaaattttgatacgatggaaaagttgaaagtttgaagaaaaaaattagaactaaactcggcctccatatctcagaatgctacaagagatactatcgccgtgtttagtttcaaagtttttcttcaaacttacaacttttccatcatatcattccaattttaatcaaacttccaattttggtatgaactaaacacaacctataagagacattaacctacttgatctagcacctgaaaaaagttttttgaagaaaaaccaaataaataaacgctgaccaccgtctttattctttcgacagaataacaaaccgaggtcattgaacaagttggaaacctgaacccaaagttagcaccaccgatttgatcatcgacgacccgatagacaaacctccacaggtcttcattgatgacctcgtctacgggatagttacaaacaaagagataaaaaaaaaagcaaaatgactattggcagaccaaactccatgaacatcatggaaggcaaacatcatgtagttataacagtatcatttactcattaaacaagttgaaatataagtatttatgtgcatatatgaatatttaggtgccaaattgccagtgcaactatgagcattatgaacagcgtctagaatggagagatcaatcgagtacctgagaagcgatctcttgatctagacctaattggcttaatgaataatgacatctaggtgaataaaatagatcaaagtggaaaggtccaaactaatatgaaattttccatttggtatatagcccacgataacatggtgagcattgatggggtctaccttataattagctagcttatcctcgtctttgtgattaatcgtgctctccctccttccgattttcaatgtttgttgttatctacttttagacatatgtttaattattcgtcttattttaaaagatcatgttattattatttattatatttaatttattttactattagaaaaataaacacaacttatattttaaagagaataagatgaatggtcaaacataaattcaaaactgaacggcgtcaaacattaaaacccaaattaaagggaatatatactcagtactactccctccgtttctaaatatttaacgccgttgacttttttaaacatgtttgaccgttcgtcttattctaaaaatttaagtaattattaattattttcttatcatttgatttattgttacatatacttttatgtatacatatagttttacatatttcacaaaagtttttgaataagacgaacggtcaaacatatttaaaaaagtcaacggcgtcaaatattttcactgtgtttagttttaaacttccaacttttccatcacatcaaaattttcctacacacataaactttcaactttttcgtcaaatcgtttcaatttcaaccaaactttcaattttggcgtgaactaacacacccttagaaacggcgggagtatctagtactaaataattgccgttttcttatctttcagaaaagtacttgtctttcttaacatgcaatgcatactatgtacgttgtactttgcccagtattcaactctgatgagttggatgacagtttggaaagggtgtgaacggatgaactgatggtgctttggagacttttgaacatggtttaatttgctggccggattttctaatgcattttccttttaatttaattacatttacctccatacttcatcaacacgaaaagggaaagtgtcttcccataggccaatctgacaaagttagataatcctaatgacaagccatacaggagtcaggacaagtagtagagtatcagtatatagcctaagcccctatgcaaagctttgagttcatgaagtgattataataaatcacagcgcttaattaatcacatcatggcaatgggctagcaaattagggcaagttgagccgatggactcacttgtaaatcactcctgtttagtataatcaatgcgactctgaagaaactttctgcatttctgtatcatttctttatgtcaaactgatgtgtgatttaattagtagttgctcttccaagactccaaaaattggtattctagtcctgaattcatgatcgatttgatgacaaaggtcagcaactcacatgcacgcatgtactacagcattcttcatccatccaacggttggtacgtggtatatacgtggtaatagctagctagcttcgtactaagctagcgccattactgtcgtcgccgtatgatcgatatcgatcgcaatgtgcagccacgtgcgaccccacgcgcgcggcggccgcacgccggaaacgggagacggtggttggccgccgggatatcagaccggcggcggccggccgccgccggctgaagtagtccgtgtgcatccaacacacagctagctgcacgcaactatagtcagtgtatggtctagttgagttgtgtggcaacgatgacatcagtctaagggcctgttagttccccgaaaatttttcccaaaaacatcgcatcgaatttttggccacatgtatgaagcattaaatatagataaaaaaaattaattgcacagttatgggagaaatcgcgagacgaaccttttaagcataattagtccgtgattagccataagtgctatagtaacccatatatgctaatgatggcttaattagtctcaaaagattcgtctcgcggtttccaggtgagttctgaaattagtttttttattcgtgtccgaaaactccttccgacatccggtcaaacgttcgatgtgacactcaaaaaattcattttccccaactaaacacaccctaattgagttgcgcttcagtatggactaggttgttgtcctaaccctggtattttctgataaagtcggagtcgcccaagtattggtgtgatgacgataacattgcgtctttgccagtgtatgggagccctgttttcttttagcttgttgtacatgaatggcttttgttgagtacgtagagctcggttgtcctgctctcgtttttttggtagcttagtttagttggtggaatgtcgtaatagttgtggtttttacctagttttctctaattaatggtgcattgtacggtttggtcccgttctctccttaaaatgggacacttcttctatatataaaatgtcggtaacggtttgactgttagaaaaaaaagaaatccgtgtatagtcacgaaattcctaagttggtgggatcgagaaaagtgatatgctacttatgagatgtttttacatgatgggatgaaaatgtcccccgtgttttgggacggtattccggactcgaggaacactacattcgaccatgtttcttgtgactacaaaatacttagtagtattgtcgttgcgtcctcactgccaactattttctcgaatatcgttgatatttgaaaaaaaatggctgatcatcgaaaaacactatttgtagttcaggttcaacggtgttggcgtgtcgctggctctatcaccgtgcgtccatagtgcaaaggtgaatagtagtagtgcttccagtggtaactgattgtctgaattaactacagagagatattagtgtggttgatgagaccttggtataataaggcagtgatagtgaccttagtttctgagaatttatagtttagtttataatggcacggtcatgcatgcatgctgatgaagtgatgatcattgctgatcgatcgaccatggcactgaccaaattaaaaagaaggcgagaccacaacaggtagcgatatatatgatggtccataagagtcgtatcatgcaacaaattgcaatgtctgaattagttaggcagggccattattaaccaattgcatcttccttcttttgctacagcaagctgtcaagctgagcatacgtcctcctctccgcctggccaataaatccttcataatgtcaggatcagtaatcacttcaatgaccatcttgaacactgcctccagtgctcacacaaaaacttgtcacttttctgaatcattttgctgttcttgatccagggaaagtctgtagctagggacaaaatcgatattatgctatcatagatttcatcggaatgtcaactttttagcgtgtcatttacaaaataccttcataactaatattctaacatattatttttattttagagtgatattttagcgaaccagaatacattctactgaaccctctttctactatggtggtgggcttctgagaagtgatggacctacagattacagctcattccaaagtctgaagattcagagacagacatcactcgggtatcgtagagatcactcatgcacatcgcaaacgacaaggcgagatgcgcgtcgaaatcgattcaatgcactcggaggactcacctagcagcagacagcagctcaagaaataaaaaaagaaagattcagattttcagaaactgacgcgcttttcagaggcaacaaagcaaaactacacgggatgtttgtcgctgacctctgagattaccactaaactctaatactccctccgtcccataataatattaagggattttaagtttttcttataatgtttaaccgctcgtcttatttaaaattttttaaaattattatttattttatttgtgacttactttattatctacagtattttaagcacaacttttcgttttttatatttgcaaaaaaaaaattgaataaaacgagtggtcaaacgttacaataaaaaactcaaaatcctttatattgtaggactgagggagtagtaggttttttcggtacgttgatcgagctaaactaagtttgtgtttagttaattctaaagttgaaagtttgggttaaaactgatatgatgtgactaaaaagttacgtgtatgataggttgatgtgatgaaaaagttggaagtttggatctaaacatagccttagttccaaagtttttcttcaaacttccaacttttccatcacatcaaaactttccacacacttaaacttccaacttttccgtcacatcattccaatttcaactaaacttttaattttagtgtgactaaacacatcctaatgcgtaaagatttgcataagctacacgtagtccatttatggtgcttgttgtttactattcaggatcgtacgagagaacgcgtccttctctgttcatcgttttctgaactttgcagagatcagttttttgtccacatgtattcaaggttttttgacgagtttctgactgtattgaatgcttagcttaaggagggtgtgttgtagttggggaaaataaaatttttgggtgtcacatcaaacatttgaccggatatcggaaggggttttcgaacatgaatgaaaaaactaatttcagaactcgcctggaaaccgcgagatgaatcttttgagactaattaagccgtcattagcacatgtgggttattgtagcacttatggctaatcacggactaattaggcttaaaagattcgcctcacgatttcctccataactgtgcaattagttttttctttttatctatatttaatgcttcatgcatgtgtccaaagattcgatgtgatgtttttgggaaaaatttttggggagctaaatgggtcccgt

SEQ ID NO: 79496 - DNA, 38844 bp, Oryza sativa
agggaacccacatggtgtgccacctgtgcgggtaccagtacccgaacgcgcaccccagcgcgaagcagcggcgtgcgcaccgcaagaactgcggcaacccgtcgtcgccgtcccccaccgccgccgctgcccacgccgccgtggaggagggcgacgggaagaggctgctgctgctgcgaggtacaaagcaagaactgctgccgccgccgccgtcgttcgcgggtgattgatgcggttttgcgttttccagatgacggtgaagaggcggcggcgggaggaggaggaggaggaggagatgtgggagatggcgcgagcgcggtggcggcggattccggtggcgtcttgcccggatctgcgcgggaggttgggaatgtagcggatgacgatggcaatgcaggttctttctggatattttgctccccccctgaatattcttgttttttctcctttgtttttgttggtttctgaaaaggaaaattttggtagagattcgatttgtgaagggtttgttgtttgattcccaattatgtttttattgacaacaacttccatcaatcagtgaaattgtactgttgttgctgaggctggaattgaggtctgtggtgaaattttttattaccatatgcaaatgttcagagcatgtggggtgttcttgtcatcttcagggttaggctaatgttctgttggattagtgatgatttggcatggcttagtgtttttttatatatttaactcccgaactgtgcattgatcttggcggaatagtacttcattaatcagtttaatcagtgaggctggttcagcttgtttcttgttgcttagtgtagttctgtatactttagtagtactagtcgtaggattttcaccatcttgcaaaattgtccccattccgtgctggtagcttaacttcactcgcataaagtcctgcatcaatgtaaacattcattgtgctacatacgtactcccctacgcattcttgaatgcgttttgctttcgcaagtgcgtataacttctttgtatacattgggcactatagtacaactctcacggcatatacatgtgctcattgggttggttgtcttctttcagagcgttcttcttctcctcctcatgttagtgaggttcaagtcggcctcagtaaatgcacggaagattgtgtcgtcattggtgaccacatccctccttccggaaacgactctaaggccagtggaactgagaatgatgagattcagagtggagtcgttacgcggttaaccgaaaatgtaccacatcttgaagatgggcatcactctgagtcagctgttagttctgatcagtgtatgggtagcacttcttgtctggtgcctgagcatggagatggtgcaagattgagctcagagttctctgcagatgaaatcaataagttaagtgtgatgtctctagaaacagttactggattaagtaaagatggtattggaaacaatgaggatgatttctccggtgtggagagaccaaaggcagtggaggaagatcgatcagtcaatgattctaatgtggtttccaaagagcaaatcccctgcgaagaaactgtgtcatccatggagcaaagtgaagttatgtttactattggaaacaatgaggatgatttgtcctgtgtggagagaccaaaggcagtggaggaagatcgattagtcaatgattctaatgtggtttctaaagagcaaatcccctgcaaagaaactgtgtcatccatggagcaaagtgaagttatgtttactaactcagtggaccatgtttctagttcaaccaaggaacctgtcaatttacttgaggataagatgtcttgtattgagaagcatgtatgcctagacgaaactagtagtaatgatttattccaacttgctagtggtggtagccattcagaggcatcaggcattgacaaaccccggcatcaagctgattgtgcctctctgacgccagatcagttggtaatccccaaggagatggatattgatgaaggacttcattgtactgatgcaggtgaggatttgagttttgactgctgtccttttgttctatgtttgcggagattcttttatttagttgatttagtctattttggctatcagacagtctttatgttactcgttatgctcatagcggtaacagttgtgaaaatgcttagcctaaatacaccaacatggccaatgtcacactcttattatccagattaccaaaatcatttcttgaattttatggcatgccagctcatggtgccttggtatatataggcaatcatggtgccccctttcttatgtaaaagttgtctatgttaggtagaattaacaacttcttctgccttaaatttgagatctctgggaacatgtccatctgtacctcgcagttattgtatgtcccatatgttccttgtttacgtcctgaaatttcatgatcatttttcagatgtgggcatcaaaactttgtcaagtgcagttggacatgctgatgaagatattactgctgttaacctttcaaagaatgtttgttcacctcatttgacagtgggcgatgacatacaggatagtgtcaggcaaacaattgatatcactcccatgccacctcaagttgatctagcagaggttagcacatcctctacttctcatgagatcgataaagtaagtagtaaagatggtattgatgaaagaaatccaaatgtaaaccttacttccgatgaggtaaatgaggtgcatggcatagatgttgaggaaattccacatattgaagatattgctgcatataatgattatcaagagcctaatacagtgcgtggtactcgtgattttgaagaagatacgcagaatgaagaaattattgcagaagctagttctcacaatatcactgctgtacagagcacatgtaatgttgaagaaaaggaacagattgaagaattcgatagcaattcttcctgtaacaagatccatgagataagcagcaggggcgttgaagaaacaaaactgactgatgttaatgtggaaactgcagatgagataaatgtggcaagcagcctagaaaatgttgaagaaaagcagagcaatagagaaaccattgcagacccttcagttgagattgatgtggcaaacttgccaagtagccttgaattaagcaagcttgatgtagaaactagcacataccatactgcttatgaggccaatgcagtgaatgccatggaaaatgttgaagaaatgaagcagaaggaagaaatcgctgtagcgcccacttctcatatcaacacgatatcgagcaccactaatgatgaccagaagcagagtgaagaactctctgttggccctagttccgatgagattactgtgccgcatggcgaattcagtgttaaggagaagactgaggagactgtgtcagaccctacatccaacaaaactgatatggtaagcactagtggcggcgttgaagaacagaaccacggtgatgaagtaacttcaggcacgaatactcatgaggaaagtgtaatattagtacacaccaccgataatgtcgaaaagaagatgaacaaagatcttacttcagaacctgcagacaatgttgaagaggaagtgcagagtgaagatatcgcaacagaccctacttctcatgagagcagcacgctacatatcacagacggtgctgaaagcaagaaacaggatgcgaaggtcgctgcagatctcgctgctggcaaaattgatgtgccacggagcgcagatgatgctgaagaacagaagcatgaggcgaccgtcagcacggatgatgatctcaaaggagatgatccgagcgaaagcaactcgccgcagatcatagacggtgctggagacaaggaacaggacgcagaaaccgctgcagatcctcctcctggcaaaaccgacgcgccacccagcacagatgacgctgaagaaacgaagccgaaggaggaggagttggagacggtcggcacggtggtcgacgatcctaaggaggaggacaaggaggagatcgccgacaaggaagtgatcgtgaattcagacaagaaccacgtctcactgaagtccctcctctccgagaaggccgcagaaaccaaggagtcgaagaagccgagcaccaaggatcgcgtgctgtcgttccggcggcgggtgtcgaaagacggcggctctccggcgaagccaggctctcccaaagcggcggtttcagggcagcagcaggattggaactctccggcgaggttaccggtggagaagaagcctaaggggaagaagcagcagtgggtgcccttcatttgctgcccctccatgagctgatcgatcgatgatgttatatatgaatataaatctttagtgtgccacattcttgtttcgttttttttttacccattttgctcgtggactaagaagaattgcattttgtttatgcacgctacatgctattctgcctctgcatttcatgcaagtattaaagcagtgtcagtttatacgtaagctgtctttggtgatctaatgttgcgcaactgcattgatatctcgcattagacatctgcacttctagttcacatctcagctaatgctctcttgatctttcgtggcaaactggacccgacatggcgtatggttgtaacattcatccagaaagacactagaaacttgacgagattggttcaaatatggattgcaatttgaaaatctcaacaagaatcatcatcgcccgacaacttgggaagtaacgtttctcatcagtgcaccactagaacaaagattagccagcacacaaaatctaagatatgtcgtgagtgtcctgtccttaggcagcagtaacaggttccgatccttgcttcgattcagctccagatccagctttctgcgaatcagaagaaaaccgaattagaacagacttgagggttgtgaaaagtatagagcttcagagtttcgcaattaagatgggacgagctgcttacgccgtcttcggctggctgcttggtcatcttggcgaacatattgctgtagaatttggcatccttcttgttgtactccttgaccttttccttgaggttcttgtatgtcaacttcacatccctgaagataagcagtgacaagatcagtttcaaaatggagtgactactaaaactagtatgcctcccttggggagacgcatatacaaaacttgcctgttatcaggatcaatttcaagtgccttcttaatatccacctctgctaactctaggtcagcaagttgcatgtaagcttgggccctcctgtataaagccttgacattttggctgtcaagttccagaacctggcaacaaacaccagaatgttaccttggtttaccaaaacacataacaaatgggtcttttgcaggaagaactgaatgtaccttggtgcaaagcttctcagcttgcttgtaatctttcagcttcagcttgcaggcagcattgttcaagttgcaggtaaccttcagttgcttggattgtttcttctcatcttcgctaaatgagctgtcatactcaatgaattttgcagcctggaataaaatagatagatcatcagtcagtaagggattatgaaaacaaagaaaatcttgacgaaagattagttatttgaacaagtgttcaacaaaagaagcatgccataccttctcataacgctttgaagccctgacatatttgcccagcttgaacaatgcattcccctcttctttctttgccccagcagtctcaatcttctcggtattgttcaagtcccaagattctttatcctgtgtaccatgaataataattggttttcctgtgcactcatcatagcaactaaaagaaatgcaaacaaatatatagcataaagagaagcacaccttcacgaatgatacaagctcaacctcataaatcacagtgctgtttggtggaactacagcgagatcctgctttgactcagtagaaccaaatgcgtattcaggaggaattgttacaagagcaacctcgccattcttcatgtttagcacagcacggtcaataccatcaatgacctcctctggaaggaaagtaaatcaaaagggaacaagttgttactacttatcagagtaagaacattatttgtttgaacttaaaagtgtatggccagcatagaggaagttgacaaagcaccttcatcagtcttgaattcaaatggctctggttcatcatgccccttctttgtaaatattgtaccatcctgaagttttccagttattttgactgtcaaacagtaaatgcaactttgtcattacaggtagtaatcagacactgttgacctctatctgacatataggaaagaaaatagtaagatcagtaagcatcacgctttggcatacctttaacaactgcaccttcattgggccgctcataccctgtaccctccgtcagaactttcttcaagattttcttatcatcacctatttctgtgactgttttccatgaaaccaactcaagattaacaagaagagtggcatttggtggcacagcaccttcctcaccagctgctggtctaccattctcaccaaatccatctgccattacaaagttttaaatcttttcaatcaactcgaaggaagagatggaaaaccatggaaaaggtgtgaaaccaaagaagcttacattgtggcttaactgtaaggagcactttctctgcttttttcatggttttgacagctttcgccagcgcagggcagaagaaacctggaaccaaactttatttcgttagcaagcagctgattgctcaataatgaacaggaaatgttgacaaggagattatgggtaatcaccatctttaacagtaaattcagcgccctcagactttgatataacagtgccatcctcaagccgagcctcatatttcactacagcaatgcaaagggtcagctacagggcaatatataagatagcaatatgtttcaatgagcaaatattaccaaatacttcatcaagatcttttgggttctcccatttttctccctccttcagtatcttcttgaatataccaccatcttggcaaatgtccttgacacttgtccaagaaagcaactcaacatcaaactgcagtgtggcactggctggaatagttggaggtgaaccagattcaccataggccaaatcaggaggaatggtgaaaacagcattttcgcctttcttcatggtcttgatacctagatcccaaccttttatcacttgacctggatacaagttcaagaaatagctggtgagcatttaacagaaaaatagattttgcaatcccaccatcacaagcacatagcagagaaaaaaaagcttgtgaaatggtatgtgggtctatactgagaataaaacaatattggtctcttacttaatttagagcaattttttaaacagaaacagtccattcaacctctagtaaggtcaacaagttaaacaccactgctgctacattctctacctaatgaaaaagctgatccccaaaattgtaatagcaccagcaattgacagactaaagtgatcagtgcagtgttacagttgagcatcactgggtgatatcagccacagggccattaaacatgctccgggactggaaacaatcacggttttacttcccagtgaaaaacgaactaggtattaagagcccttatctcagaggtatctgtaatacagtcatttctatttgagaagaataacatatcaaaagattagtaaacatcaaaactagtagcatgtaaacagaaatatgaatagatgactgaaaccatgcccaaaaatttgcacaaaatggtgattggcacaagttgcgatcacattggctatgagatgtgccatcaaaaagtaagaaggcagaatggagaaggaattgtaccttgtcccaacttaaacttgaagggtgtcccacggtcacggcttgaatcaaacttctttccatcaagcagtgtgccagtgtagtgtactgaaacatagaagaaaggttcagtccgattcagttacacaaattctaagataaacactaatgacagggtaaatctgatctataaatcaatccgctatcatcatggaacaataaagttgttaaacagcaaataatacaggcatttagtttttccctaaaaaaaaccatacatcagcaacaacattaacattgtaggtatgccacaatcatccctccttcagaaaccatctccccgaaactgtaaggtcacacaaccgtacaagcaaacaagcaattgcaacagaatttatactctctctgccaacataaactcacaataatgtcgcagtgtaagtgtaactagcaaaagcaaaatgcgtaatcagattaaacagtaaactagattaatgttccaatctagctcgaaatgaacatgagatcgatcagacaagtggtgaagatggcaccaaatttcacctaaatataaactcgcactgttgcaaagctagcaaaaccaaaacacatgatcagattataaacactaagcagatgtcccaatctaactcgaaatcgacatcatcataagaccaagcagtgaagataacaccaaattccacctaaatttagcactaattccgcatccaaatatcccataaaccccaacgcatggcacgccaaagtccaaaactaactctgcatcccacaacgaacacatctaaagttctaaaccccaacacgcaaggcactggttggatcaactccacgatttgaggaggaggaggaggcgaggaaccacgcaataccttcgacctcgtcgccgacctcgggggtctcccacccctcgccctccttgagcagcttcttcctgagaccctgcttcccgatctccttctcctctccgaccttcagcggcggcccgtcggcgccgccgaagtcgcccatcccgtcctcccccatcatcaagtcgtcgtcggcgccgggcggcggcatctcgaagtcgtcgtccatggcgcggggcaaggagaggcgagatctgcggctagggtttcgaggccgaggcgaggtcaccactagggtttggactttggaaggttcgagaggagcacgaggcgatgatgaggaggaggagggggagggtttaaatggatgtgagagaatcaggtggtgggcttctagagtgttccgaggaggaaaataaaaacggaaagcgaacggcccggatggatgatggatggatggatgcttctggatctgactcaagtaatcaagcaaagcatcaattaataaattgtttccgattaatcacttctttaaatatcgcatcaaatatttttgattaactgagcagccgctgaaaatatgagctgaaatgtgttggttagggtcggaaaatcctcaacgtcgggcgcctgatgcacgcaaaaaaaaaaaaaatggggtgcccccacgccgcggctcccgcgcgctgcccccaccacgcgcgccccattgtaacaaccgtccgaatataacgaaaatgccctattaaaaggatttgttttatatttttttttcaccaatagtgtttcagctagtgtacttatgatatttcactgtgtatgaatcatgtaatggattttgatattgtttaataatttcatcttgatggacacgttggttgttgatgtacacggaatttaagtgttggaatggcttcaaatcgtatgttttcactttttttaagaattgaaacattctttcgctatttgctaaaacattgtttttatataaggtgaaacaacatttcatacgttgtagcaagatgtttcatgaagtgatttggttgcgtttcaactttttgaaagattgaaatatattttttttgactagggagactgaaacatttttgatctatttagtgaaacatattcgatctacttggtgaaatagcgccctattttttttaaaaaaatcgggtgcccggtttgtaggtgcctcagttaaggtcatactaaactttgcaagagtttcgataaggaacaatttcgaaaggagtaaatgtgaagtattttttgcaagaatttttgtaaggaacagttccaaaggagtcaatgtaatgttgccttatgataagcattaaggcaattagattgcagctaagattagaatatgatgaaccacagtgtaagaggtatagtggtaactccaaagttgagctgattagtatacatgcaaaatcagtttctctaacatttggtagtaagaaatagtagggtacctttaagacctgattaccaagcataaagaataactgaaagtaaaaaagaaaagagaaaaagaaaaagggaacaaaacaagatcgtcagcatcactcttcactgcatcatttacatattgggttctgattgcaccttcttcaacatccagacatccagtatccacattccagtactgcctagtgcctactttagcccactctacttcccagttttgaaggcatgcctaaatctgctatttagtgcaaccaatgataatcacagttcacaaggattatgcttcgctgtttacatcaacaattcctcatagtccacactcacctcacttccttacaagattgtgaaaattacattaatgcacaagacaacagcaaccaaatgaaaattttggtacaataaggaattcacccttttctatgacttgctgccagtctgatcgattcatttacagtgttatcctattggatgcaggatcaattccatagaagcatcacaattctcgtgattatgtttagctctagaacatccaaatgtaagaatattctaaacggcacgagcaaagtgcaacattcaaacatccccatcaattgcagataattatggagtcctcatcaagccaacctgagatcctgccaacaacataatagaaagtttagcagaatttaggagctatgcacaatattgtacaaagaacacaacatctgtaatgatttcaaaagaaaacaccatttcatggactatgttgatttatagtgggcaatttcattctcagttccaacaaagagtgctgatgatgcagtgcaagagatgcatgaaccaattacggcatgagaccttctacaatatcatgtattcagcaataagggaaattaaagcaaccaagaattctaaatatggagcttatttttagtagaggcattgcaactcaacagtgaaatacaacaccatatccttctcaagtctgtctaccttaaatactatatagtacattgaatcttaattagatataaaaatgcatctggattaaactgggttctctaataataatacaaggtgacctgttcccaggttctctaataattttcgacaagtccagaactggtgttaacttgaataggaaaagcactagttccacacttccactgcgctgctgaacatcctaaggacatgaaaattttaaatcccactgtgggcatgaccacaaaccttagattattcattctgtttgccttcactacacgactttaacagattagctgaagccaagtgtggccttagtaccaaatattgcaaacacatcacaggcatattaggcatgatccaacggcataggattcacttatggcaacacgcagaatttaaagaatttctaaatatggagcttatttttagtggtggcattgcaactcatcactgaagtatattaccattcttatctagtctgtctaccttaaatactatgcaaaacataggagtacattgcatctcaattagtataaaaaaatgcatatggggttttgacaacattaagctgggttctctaatataatatgtggtgacttgttcccagtttcaagacacatgaattttcaagaagccaagaactggtgtttaagtaaatagcaaaagaacttgttccagtatgctgctgaacatcctcaggtgtcaggacataagaaatttaaaatctattgtgcatgcaaccacaaatctgtcatcctgtttgccttcactacacaatttctaacagattagtgaggttaaccgtggccttactacaaaatatagcaaacacatcagcacatcacaggcatattagacatgctccaacagcatttcttatggcaagacatacaatcaaaagaagaggaaatacaatattccaatcatacctggaaatccaggagcactgccatgccatttgcaaggcccaatggaaaaagagaactggatacagttcataatccattcaattcccattcatcgacatctcaagctgctccatcctctgagctagatcatgcttcccacaatgccgcaacccgtcaactacagaattaaaggtcggagcacgaggagcgaatccagcttcactcatctcaacaaggtagtttgcagcctccacgaaccgaccgcctctcacacacattttaacaagcatcacatacacaggacgatttggcgggtgccccttcgacttcatatcaccgaaaaatgcgaaagcatcggcgaatcgccccgccttacagagcgccttgataatcgctgcatacaggctggggaatggccggtggccatcctcaagagctgcatagaacaaccgaaatgcctcatcaattcggccagccttggccacagctggtatcatcaccttgtaggtggagatgtccgggcacaggccgcggctggatgcatcggcgagaagcgccacggcgaattccacatctccagagctgcaaagcgcctcggcgagcgagttgaatgtggccacatcggggaggacgccctccttggtcatccggagcgcgaaggccttggcctcctcgaggcgaccggcgcggacgaggccgtcgacgaggagatccctcccgcgcaccggcgggtggaacccgcgctccgccatgtcgtcgaggaacgcctgcgcctcccggagcttccccgcggcgcaccaggcgtcgacgagggtgctgaaggtggcgcggtcgggggccacgcccttgcgcgccatgcggcggagcagcttgtacgcgccggcgaagctgccgttggcgcagagcgcgtcgaggagggcgttgtagacctgggtggtctgcgggcagccgaatcgcgggaggcggttgaacacctcgacggcctggtcggtgaggcgggattggccgtaggaggagatgacggcggagaaggtggagggggagagcgggaggccgagggcgcgcatgtcggcggcgagggaccagaggtgggtgaagaggcgggcgcgggcgagcgggaggagcagcgcgtcgaagtggtcggcggaggcggcgaaggagggcttggcgcggagccaggcgaggaagcgcgcggcgtggagcggctccgcgggggcggcggcgcggatgacgcggagcgcgaggtccggcgggaacggggacgggaggcggaggcggttgagggtgcgctccaggtagaagtcgcggcgcacgacggtggagaggtggtgcaccgccgcgaagtaggcgtccttggaggtcgggtgctgcggctgcgcggcatcgggcagcgtggccaggccgcgtacgccgacgccggcgccggcgccgaggccaagtccgacgcggcgcagcaacgcggcggcggcggcgggcggcggcatggatcgaagtgggcggcggcggtgtaaggttaggattgggcccattagctgagaagcctaaatgggctagtaggcttatatgggcttcgaacagtttggttgatgggccgtataagtctatcggcctgtctaacagattaacagctggacgatctggccttattgttgtggaataagttcactttgtgaccttcaaaagtcatcgaaatctaatcccttaccctaaaccacaaaatcggatatctcgaacccccaactcttaaaaaccggtgtaatttgactccctcggcggttttagagggaggtttcgctgacatagcgcctatgtggcagtattgactcggtcttcttttcacgtggtgttgacgtggcgctcaggtggcattagaaataagaaatatgtgtgggacccatttgtcatccaccaaaagtatgggtgggacccactgatatgtggcgcccacataaaccactcctcatcctccctccctctctctctcaatcttcggcgagcgacggcggcggcggtgggagggcgggcgggcgagggcggcggaggctcgtggcagtgggagtacgacgggaacggcggcgggcgggagaagcaggctgcggcggcggcggcgagagggcgggcaggcgagggagcgtgccatgctccgccatgcccagcagctggtacgaatcgttgctcatctccgccacgaacatgcccatgttcgacagcgccgccgccgactgcacccaccacatcagccacgtgtcgccgagcagcttcgcgatgtccgctaagtagccgtctgtccactgccccctgtcgagcgagacggctcctgtcccggcgaggagagggtacaggtaagcgaccaccacgaagatgaccgcttagaacagcgccttgggcagcgtcttgccgggattcttcacctcgccggccaacgtgctgatcgaatcccagtagttgaggttccagaacagggtgttcaggtacagattccaatcgacattgtggaggtcgatcacaagccacctcgccggccggagcctggggagagcaatgagccccatgacgaaaaaagggaggagggagaagacgcccaggcagatcgccacccatccgacgacggtgagcccccgataactcagcaatgtcagcacggccatcaggccaacgacagcgaacgccctcgtcgcgcctctgccgagcgccgggacgccggacttgaggtagtccaagaagaggacggggtagaggacgttgtcgatgacgccgctcagccacttcatccacccctgctggaacccccagtacgggccgagcgccgacgccacccacacgatgtacccgccgttctccgggaacatggcgcccagctccgccgtgatcagcgtctccgggatgctccagatgacgggaaggaccaagaagccgatgatggcgagcagcagcctggcctcgcccatgctgtcgcctgccgccgtcgcccgccgctgcccgccggctgctgccgccgctaggccccgtccctcgggcgccgctcgctgaagagaaagagaaggatgaggagtggtttatgtgggtcccacatgttagtgggtcccacccgtttttttggtggatgacaaataggccctacacatttttttatttctaatgctacctgagcgccacgtcaacgccacgtgaaaagaataccgagtcaatactgccacgtaggtgccacgtcagcgaaaccgcccttcaaaaccgccgagggagtcaaattgcaccgattttaagagttgggggtcgagatatctggttttgtgatttagggctacggattagatttcgatgactctagcggatcaaaaagtaaacttattcctattgttgtacatgccgtaaaaggcaggcattgcatccagctgcacagcacgattggtcagggaatcaagggccgtcgacgcatcgagacaaagctagcaaagttgcatgtatattttttttttaaaaaaaaggttaagtttcatgtacatatgtgtcaccgctcttataaagtttgtttattttcgagacgaagaaaatatatgtttcgtgtgtaattgatataaatcctatattgtactgtatatatagtacttggtaggtgtcacttacgtataggactaaagcatgtcaatgacacatatgcatattactgtagtaattcgaacgccacacccggcatttgctcagatctccgggtctctctctctctctctgctcgtacagtcttatgcctgcctctccccacaattattgctccccgcgaccgtcgtcgttgcagaagccggccaagcacgtatgtcgtcgctggccatcgccgctgctcgctcgcctgcaaggtaggtcggccccagttgcctggctagctgctgctacactgttgctcggctcgtcactgcgtctatagcctatttacctgagcacctctaccatacgaccaatgacagatctaaccagaaataacaatatatctaaataaattagataaaactatagcccgtgttttcatctgcgtatagcaaggaaaagaaaagatttagtgagaacttcacggggactctcatgattctcgcgtgggcaatacaggcttgaaatcccgtccttaattttcatgctagatcgccacccctgtgttacaggcatccgagtcatggtcgtcgtcgtccctgccgattggatcaagcaagctatagcagctagctttggtctttggagctttcccattgttggtttcttcttgtcgatgccagaactgtgccgcccctgctgagctagggccggcctcatcacgttgcagcagggagccctggttttgtttcacttgacttgacacggatcgatcgatgcacggtagaaagtacgtggaaattttaagaagtgaaaaaacgaacagcgtgtgttgtgtgtttgctgttgatgaacagcggcatgcaaagatacgctgcagatgagggcgcgctttggtcgcgatcttcgcgccatatgcttgcagatgaggagtactccggcctatagctagagtcaacaacactgcgacgacgtgtatgactagtgttgccaaaaaacatctgcaacgttctacagcttttctctgtgacggcgtggacccacatgatcaacaatcaacacacggtgcagctgcagtatgtataattataatggactataggagtacaacagccagctcacgcttggagccttgcgattgttgatttgttgtttgacgagtcaccaacatgtatatagcttatttgtctagggaagcttaaaattctgataaacatctgattgctttagagtctaaaaatactggcttttaacttctagtttattttctgaatttcataactatagcttctcagaatctagctagataaaaagctggagtgtttggcggccatcattaaatttagggtgtaagcaaaatgagcgtagcttttaattgcttatcttctctatgttcaaacttacctatccaggtttaagttctaaactttaaatatgtgctcgtatttatggttacaatatatatttttttcaatgataggtaacatatccaccgatagtgtggtgactttgtcgatcctcaagatcgatcgggaagcaaaatcatttaacgttttgctcctattatgaccacttctagatataattaatgtaaaaaatattgtatattgaagcacataatagtacacccatatggccgtatcagctcgtacatgaaagtttaattccaagatccaacccagaatgttcactggaatggaactgacgagcttggtatgtaaataactgtattaatcattcatcatagttaaatctatgtccatattaatttacatatgtgtgcacgtgagagactgcttttaaattaagtaaggttcgtcttatataaacgtttgttaaattagaacgaaggcgcactttagctagatgtatgtcatgtatatgatcgaaaaaggaaaacagtggagccacactctcacggcattatatgtgcagggaagacgtgcttgatagattctcttgggtccgagctgggcatgtgtatacacagtactgcaagatctatgaaacatatcgttgtgttgtatctcagcgtttcaatttgtcgtccaaaccaccatatatatattccaatctttttttattatatacatgacgctggattcttccaaagatcgttgatggggattggggggtgtttatggcagcttgacacacaaggtggctaaccattatacgcaaatagtacttgacatcgttaattttatcatgcaaaatttcgtcgctacgtttaattacttagtactccctccgtttcatattataaatccttcaacttttttcttaatcaaaattcgttagattttatcaaatttatgggggaaaaattacatcagtggtacacgaacttgtcaagtgagtgtaatctgttgcatgaacttgtttggtgcgtgtgaacaagaccaaaatcgtacggcaaggttaattttactgtttttgttattgatttgaatgctatgtaaacatgtgtctcacgaaaatatcacgtagataaagatctatttagcaaaacatataataaggtatattgattgcatgaagaaagagataaaaaatcgagtaacgatgcaaggaatagaaacaaagtaagataaagtagaaaacaaatttataaatataaccattctaccatacgtgcaccacgcatgtcatgtaataatttgtaatgttcaactttgaagaatcagccttgtcgtgccattttggttttggtttgcacgtaccagacaaattcatatatcaaaataagtgttttacaagtttatgtactaaattgcacctacctgataagttcgtgtatcgctgatgcaatttacttgatcaattactactaatttgtatttaagtgtgatcatttctctattttttctggatttatacatgaaaatttgatatattttttaggtgattgcaattttacaatttttcgaacacttgagatctagcaaagatggagagttgtttttttttaagttaatatagaataaaaacgatcatatcaaagaaatagattatagagacataacttgaaaatggttttatttgaattttcaaacaaattttatatagactttttttaaaaaaagaacgtaccgtttaacagttttaaaaagtgcgttaatagaaaatgagaaagttgaagaaaaggacatgatcttagtctattcgtagggttggtttatatagaccttgtatggttctcattttttttacaatggaaccaatttttatcttataaaaaaatactatgttcgtcttaaaatataaaaaactaggataagatagaatacatcatattactacgtgtctagacatcctaatactactactatttacatcatagtattactactgttaatatttatagtattaaaatatttcttatccgattctaagttcttacattttacgatggagagtaccagacattactcaactattctatacatatcccactaccctgtgaatcaaaagctactccatccgttccataatataacaaattagaaccggacgagacatttcatagtacaacgaatttggacagctggtcctaggttgttatattatgggatggagggagtagaaattactttccagctgtctgttcttctcattcggccatcgatctaaatgaaaggtaaggtgaaaaaggttcagagaaccaaaagcatccaaaggatactgttgctgcacgcctgcgacgtaatttcaggaatccgctagaatcgtactacgtacaaatcgtgcactatgcatcggccttctctgtcgccgattgatgccacatttccatgcattcatgcatcatctcatatcctttttcctctgatcacatcttcagacaactgtatctatatgagatgcacctatatatatataagagtccatgattcatatctgtacgtttatattgcaggaagcttagcatctctcgatctcttcttgttgattttgcctacgtgtgtgtgtattgctagaaaaaaaaagggcaggttggaatagcaaaatggccgctgagccaggaacgaataaactgaagatgttgctgtactttcttctcctgatcgttgccactcttgtgattactgcaggtatatataattcgtgagtatttgaagttaatttgcaggcttatatatgtatcgttgacaaatgaatcaatgtttctcgatcgcgttcttgatccctcgattcctcgaatgcttttgtacagaagttggtgtcgttttagctgctgctgctcgggtactctcgccgtcgacgacagaagaagtaccggtggtaacaagtgtacgtctgcccgtacgtaacttctgctagctcgatctctctgatgcatctaatctaaagcaagctagctgtagctccatgatcgagtatacatggctatatatgtcatggagagcttctaaccactgcatcttcttcaaaagtctctaggtcttcaaacagtttatattctcacttagattctgataaaatatatggaaatatatggttagagaaaaaaaagaactaaaaactagaagctaagaaaccaagattgtttagattcttagaaactgactaccgactggtagtttctaagaattttaagcttcttcaaaataggatctatatatataagataataagaagtaaaagatgcataccaatgtgacgaagatgatgttaaaggtcgaatagccttaggtgagttgcttcagtttaattgactttgtgttcttgccatgtttcttgttaggcccaaactgagatatcatcatcatcagaaggagaagcacggggaggcgggagcagccgggcgtcggcggcggcggcggcgaggaggatggcgatcgggtcgagggctccgacgtgcacctacaacgagtgccgcggctgccgccgccggtgcagcgtgcaggaagtccccgtcgacgccggcgatcccatgaacagcgcctaccactacagatgcatctgccacctctaagttctgattaactagctagcatatgcatgcgtaattgttgttgtgatcgaccgatcgatggaggccgccccgggtgtggttttaataaaagtttgtgcatgctaatgccatggcacttaatttagtttggacgtcgtgcatgtcgtgtggttcggttcttgaataattgtggtcgataagacaattaatcacgctttgaacatccagattcctgcaatatataatatgttcatctagttacatatcttctccatgtaataaaatttagaatttcccaacttatctctcactgacatacatgtgagcgagcaataaacccagaaatcagaatattttttaaaaacttcggacctatttggcacatctacaactccggctctagctctagccaaacagtttcagctccatttaaaatgaaagcggagttgagtggagcattctcacaatataaactagaaaggtggagttggatttaggctactccataaccctattctagacccaattcttgaaactaaatttagaagttagagctctatcaaataggcccctcaactccaacttcacccttttttttaagctagaatctaacagaatgatcttagcttcagctgaaaaggaaattaagtaattgtattgaaatgacgtagatgtagatttaggagtttgagccctgtcaaatactgctccatcaaataaaaaaaagttaataaaaaatcaatcctagctatgaatctatatacgcatatattgaaactaggtgataccccgcgctttgctgtaggattcatggataaatatatgttaaatattatagaaatgatgatagttgaaatgttgagaaaataatgtgaggaagatgatttgacacatacttgttgatctctataatataatattgtagattatatatcatgcttgcatggattaaaataggttagaatagtaattgctagtgggtgatgatgtggcatgcttgcatgttgagatttagcttctaataattgttagtgggtatcaactatatagaaagtatagattcgtagctaggattaagtattttatggaatagagagagacccctagctacctgcagatgaaggtatgaccactttcaataagagtttctttcctacttcctccgtttcataatgtaagactttctaccattgtccacattcatataaatgttaacacacattcatatagatgttaacacatgtgtgactagatacattaacatccacgaaagggcatgtagcctagtggttgcagtgacctgagtagtaccccaaggtcctgagttcaaaaatccaaaggagcgaatttcagattgggttgtttgcgggactaagtttcctatttcaatggccgtatatatccagttggatgtagaggccgggtaaaaaaaaacccttttataaaaaaagatacattaatatctatatgaatgtgtacaatgctagaaagacttacattatgaaacgaatggagtattaaataggaaaaatttgacttacattatgaaacaaagggagtattaaataggcatgacacgcaaaaaacgtgtaattggctgagagccatcgtgaaaacatgacacggctgatggacattacaaaaaacgtgcaattggccgtaggacaccggtcgcattattttattatttccgggacaaaagaggtggaaaattttcaaaatgacaagattgcccctggagccatattcccccgcgccaggagcggcagacggcgagagatcctgtgacggcggcgatggctgctgcgccgcccctagggttcttggacacgtacggctccatctcaccgtagagccctctgatccagcccatgtgcttctccgtcgccgccctgctcttcgaccagaacccatagtactggatgttgtagagcgcctgccggtgcgggaacgacatcaccactggcgcgacgtggaccatcttgccgccgtaggggtcgaggatgagcagcccagcaccgtccttgaggagctagctccaggtggtctcccagacttggctgggcatgttcttggacgtacggagtcggacttggccttcaagtacttgtccggcttgctagtgcccctgtccaggagcatctccaatggcttccccgtgcagtagaacgcgaagtagagcatggactggatccacatcatctcgatgcagtcgctcgccgtcaccccgagctccgggaaggtgtcggccatggcggcgacgaggccaaggcgtgtgccgactaccgaggtacagggactcgaactgcacgttctggttctgcaatacgacgcggagaagttcccgccgctgccgcctcggatggcccagaagaggccctcccccatggcggccctgttgaggagcctccccctcggcgttcaccatgttggcatcgacgacgaggtcggaggcgaggccgtgcttccacagcatcaggctgaagccgccgccgctgaggaacccgtcgacaccgaccgtcctactcgggccgtcgcgctgctcgcgcgccgttcctccgctccgctgcgtgtgtgaggaagaagaaggataggagagcaatgtgggccccacttatgattagcaaatagtaatcaccctattaattaggtacaaattagtccatgatgcgtgaggccaggtggttaaaaacctattaaaaattagattaaacctacactgtctatgacatgtgggacccactggtgtttaaagaaggaaagaaaaggggcaatctgggcatttagaaaaatatctcacctcttttgaaccagaaataataaaataatgcgaccggtgtcctatagccaattacacatttttgtagtgtctatcagccgtgtcacattttaacggtgtctctcagccaattacatgttttttgcgtgtcctgtggcaaatttttcctattaaataagatgctatgttagcattttttataacatgacaagaacatttcgtctagataaaatgagttttacaatttatcccttaaaagtactacttacgaaacaatacaaacaaaacaatacattatattgtatgagttgtttcaacccatcaattaaatattttatttattatgtaatattttaaaaaacacaaatatattatgtaatattaatacaacgaagtggcctttgacgcggccggcggcgagggagacgagctgtcttcgccgcggcccgcggtcgccgcgttggtctggtcggcacgataacgacgacgaggcgccaactcaacaaagcagccagaaagaagcttggcgtgcgcgcactacctcctcccaacccggtgaccccacccgtcatcctcctcacccccccacccctccgcgtcaccgacacctcggccccaccgccaacctcacaacgcagtgggccccacctgtcagcctcacccgcctcgccgtcttccacccgtgcgtgcgtcccactcgcctcccactcacctcctctgcttctcccaccacctcactacctctcgccgcgagagcagcagcgctcgtgttcggtcaaaagcctcgccgcggcgagctcgagctcattcgcattccggaggggagggagggatgggggacgagtcggagggggagacggaggagtacctgttcaaggtggtgatcatcggggacagcgcggtggggaagagcaacctgctgtcccgctacgcccgcaacgagttcaatctccactccaaggccaccatcggcgtcgagttccagacgcagagcatggacatcaacggcaaggacgtcaaggcccagatctgggacaccgccggccaggagcgcttccgcgccgtcacctccgcctactaccgcggcgccttcggcgccctcctcgtctacgacatctcccgccgctccaccttcgacaacgtcggtcgctggctccaagaactcaacagtatacactcctcctcctcctcctccttcaacattttttattttttttaactcaacctgttctctcactgctattttgccaaccacgcgtatggatagatctgattgattcttttttgttaatttcgttgttcttcgaaagggagctgtactagtgttagttaacaattcactgtcaaatttgcgaacaaagggagcaccatttttgggttcctactagatagtgatttgcatgggttgttttggggataggagtgtcgctacacaccggacggattgcaggacctggtctgaatctggatctgaatcttgatgcttaggcagcagtggtgtgtgggggaatgttccaggaatgaatgcgaggaccactatgagggtgtggtgtgattatgcgatttactgatttgggagtgtagtgattgtagacaatttttttggtaccaaattatttgggtgtccaaggtaggtttgcagatttatgaagttaggaagctgattaacttcagttggttcatcagtgcttgagatgttaagcgtagtaattgctgtcttggttcgtgcaatattgaccctgctagaaatgccttgaccctatgagtgatatatgtcctccggttattccgattaagttttgtcaatatggttgaagcagcatgaatcatggatagttggataccgattttcttagtcacaactcacaataggatttacagataagatcatgatctcagtcactattagtactctactttgataaatcggcagttcggcacacgacctttgtgcttgtgttgggaaccttttggttccgtctttcctcttgttggaggcaaaaatttagccttttgtgctggaacttggaaccaacatggaataaatgcagtaatgtactgtctaggtccttcccttttatgtatcctttatgtaggatgcatgactcttatctggaaaggtaaagttttgtgtaaagcaaaactacagtactaatgcaatttatgaggcaggtacaaaatttatccaaattacaaactgtggcctaaccaacagtcagctagtaatgcaatgaacctcaggatgatacattgtaataattcatgttgtgtgctagtttttttattcactgtaagaaatttcagaatactccagaacacaattttgtcaaactgcacattacttgtgtgtttcttcctgtattttctcagtcggcatctatccttctgtagtgtccttcactggctcgtgaacatacatacaaccttacatgtagtgaaattttggttctatgtatcttgatcataaacttgtagcctagtaagttatcttatgagcgctcaagatgatgctatgtttgtctatgtatgctcccttatgatttttttggatgctactttattgcaccctttaaactactaaggatatccttgattatctgttatcgatttgcttactgaagaagtctaatattgttcgtcaggaattaatattgtactatatatatgttctgttctctgttccgaagaatctcttccttttttggtagacttcaagggaggactcaaaagagctctaattaataattccaaagcaagtaatactcactgttttctggaagcaacttactatgcactcataataatgtgtcgtgcataagctttggtttcttgccatcagagtgacagacgcatatagtattatagtgctacagctattgtcttctcttgtttgatgcttttacagctttgttccatgcatgctcaccacccactcacaagaagtcatgagttgcacttatggttgtgtgctgttgcatttgttccacaagatttttctatctgaatatagcttcttttcattcatatgtagaaatgtattttttggctggagtagcgaataactgttcttatattcaatgcagcacattcggacacgactgtagccaagatgttggtgggcaacaagtgtgatctggataatatccgtgaagtgccggtagaggaaggcaaagcacttgctgaagctgaagggctgttcttcatggagacctctgctctggactcgacaaacgtgaggacagctttcgagatcgtaatcaaggagatctacagcaacgtgagcaggaagatcttgaattcggactcctacaaggcggagctatccctcaatagggtaagcattgagggtgattcgaaggatgatcagaaacagtcaaaccggtttggatgttgctaggggttttagtacattattattattggattcactgtgatatgaaggttttttgttcattaatattattattattatctgtaaacttgtaatccaaattgttttttggtttggttactctggtacacactgtgacactgagatacaaagtgagagaagaatagttgctggtaatgaatagttgagaggactgctttgtgctgttacctgaaaaattcatgatccccaactttgtcaatttcttgcaaaagtgtgctagccttttgtatcttccctcacaactatatttcactgttcatacttgaaatcggtggatacaggacacctcttgtgttgagtcagttttttctatgaattttgtgtagttcatggattaacttattcctaacttttttttacgtatgttaaaaagaccgtacttgcgattgtatgtgtgtagtgccgtatatacgagtagataaaataaactggtgtgtatgagtcttcagtatttgtttggggggaaattttcagttttgtttttatttctaggattggagcaaatgggctgaaaaatgcgtgggccgtcgattcacgggcctggaaaggatggactgttgttgttgtgttgcgggcttggggcatataccagggtgggccgattggagcacaaagcagagtattcgtcataatcaacattttaatcactccttaattgcattggagagctataggaccaataatattactttcatttggaaatatatatgagttgtagagttttattgcgtttgaccattcaaattatttaaaagttcactataaatgtctgattaaaacgcatgtaaaatatagaacaaagggagtgattaaacgtgagatggataaattcaagaaatggataagaaaatggttggacagctagcctgtcaacaagatggcattgcctgtcctgtcctgtccttcctcctcccaacacatacctatatatacaaaatgcaaacacaattaacaaacaaacaaacaaacaaacgtgcatacgaaatggtacaagtagtgccaagcacgaaccctagttgacttcttctatgattccacgaactccatcgcatgtctggctctcctgtgtgtatacatactgatcttcgttcgatcatgcaggatgcgaaacattgcatgcatcgtcgtctccagctccggtgaccgacggattgatcagatgcagaagggtgggggtggcgcgtcgtcgtcggcggtggtggtgaggatggggccgtgcggcggcgacggtggcggtgcgagggacatggacatgcgcggcgtgggtcgcgtggtgagggtggccgtccggcacggcgccgccgtggacgccatgtccgtcctgtacgagcgcaacggccacgaggagtggaccgacctgtggggcggccctggtggcacactttccgaggtactacattactctacttcatttatccttaaaaaaatcgcggaactttggactatgaatgtgaaagctagaagtttattttttatagaatggaggaggtatacacaatcttaattgtactataatttcgttgttaattacccctgtttcaggttataaaacgtttgtcaaagtcaaactgttttaagtttgtctaagtttgtagaaaaaattagtaacattttcaatgcaagacaaatttattatgaaaatatattcaattattgatttgataaatctaattttaatattataaatattactatatttatctataaattttcaaattgatcgaaaccgtttgattttgaccaaagttaaaacgaacctgaaacagagccctaaattcttaattaccaccgttccgttgtagtgctagaatatggaaggaggacattgttgtatccggatgataattaactctctttttgtagttcttttggtagctgcatctaattaatccgagaatctttagctaccaaaatagtttaaaactttattttagtttcgaaactataagcatttttcatattcttactagctggatactcacttaacacctataaattgtggtttagtgttttggtaacaataaacaagtactccagtctttgagacgttgacacatttttctcatgtaatcttgatcactaatgtcaatactaatatatgtctatacgagccactatgttaattactaattagaatagttgccgacactgatactcaaaatttgaagagtttgatgttgtatttcgaaacaatctgatctcactcaaattcgtgatgaaactttctctctgtttttcatttttctccccagataagcttgcagccgggcgagtacttgacgagcgtggcggggcactacggccgactagacggcgacctcgtcgtcaggtcgctcaccttcgtcagcaacatgcgggcgtacggcccgttcggccatgaggacggcgtcgcgttcgacctcccggccggcggcggcggcggcggcaagatcctcggcttccacgcgcgctccagtcgccgtctcgacgcggttggcacctacgtcaagatcggatagatgacgaccaccctggcgtcacagctgagcagatctatctaagttctcccctctataacaatttttagtttttaaaatttattttaaaatataattaacttattcactaacgatctctttctaatcaattgtaactctacaccattcaatgttacgggctatctacatttctcatccaattgtaattttcctccatttaattttatttttttaataactgtgtagctagtttcaagaatatttatagaattctaatcatattttataagatctcccttcgattttaattaattatgaagtaacttggtataaagcgaaacctatttcaatatgtcctggtgcaaaatgaaaagtgaaagtacatgttcaacctagcgtaaattatatgtcctggtgcaaattacaatttactctttttttaattacacataaacttttctttaaaaaaagagtggtcataaaaaaatgcagtgaaaaagaaatctttagtaccagtactcaaagatgatttttagtcccggttattttaacctagactaaaaatacctatttttagttcgagattatacgtctcgattatacaaatgggcttaaaatgggttgtcaaccggaaataatgtatctttccctagcaggatcaaagctgatataaagtactccatccatctcaaaatataagctttttttagaccctgacatggtctccgagatactactttgaccaacaatatctataaaaataagatgttttaaataaaatgggttgcatattatgatagtttgtttaataacaaatctagtaacatcaattttacgtgattaatcttttttatttttttctattaataatcaaagttaaaaatatttaacttgtcactatgctaaaatgtttatattttaggatggagggaatagtaataatactccctccgtattttaatgtttgacgccgttgacttttcaaccaacgtgtttgaccatttgttttatttaaaatttttatgcaaatatgaaaatatttatgtcatgcttaaagaatatttgatgatgaatcaagtcatgataaaataaataataattatataatttttttaaataagacgaattataaaacattaaaatatggaggtagtatcaaacaagtgtacatggagagggggagggatctcacatgcgcgtggccgcatcaaccaaccaaccaaccaaacgtacatgtacctgcagacgagtcaagcgtacgtagtcgcacgcgatgctagcaatgttgctatcttttctgtaaaaatatttccttggcctggacacacatgacatagtactgaaccggccggattgtcgatatggaccattacatgcatacaacaccgaaattaagcaaatgatcgaggagagttaattagctcatgctcatatgcatgcacgcacgtatacgcccctctctacctaaccctagcttagctttgccccactactagtctcacaaatggcacaatgaccaaaaagaagatgtgaaagtgtggctcacgactaaacacatgttctatgtgcgtatttattatgtccgttctgaaatatatatagattcctcgcagcctaataaggctctagaagtaaaaaagattaaagcacatttcattaatagaaaatgtagtttggtggatcggtagagatacatagaacttcttgatttatggttcaatttgttttaaaacaaattttaaactttaaaagccaatttattttgagacgaatggagtatacaataacaaccttttgaatatgtcatccctgtgccacgtttgcgatccaatgggcgggggttccttgaagatggtcatggtcccaagctctgtatataggagtgcccctacctacctagctagaggtaaaattgtgacaccaaggtaggggaagaaatgtggtgcaatggactgagacaccataccagagaatttaacatgatgcatcactttcaaattcagttattatatcttctcatccttagcgcattagacggtagtaataataataatggagtatagcacaagtacaagctagctaggtagagtagtggtaggttgttccttgagacatgcgtgggggatgtgtcaaatgcatgcatgctaattgcaagctagagtggtgtgtgtcaatcgatcgccaattgtgtttgtacaagtgtgcgcccactgcaatattgtgggcatatgcatatggttgcatatatctccggtagacaagtctaacggtagcgcatagcccactgattttcaatgtcttgttcaattcacgctgtaatttttaaggcactgtttttttaagctaatggaggtatggattatacttgtcacgtttctaaatagtacgattttaacatgcttttattttatcttataagcatttgttaactttattttaatatttaagtaatctttgtatcaacttatcaactaatcagctgataagttgaattgaacggggcctaattcaatatcatgctgggactctccaatatacatgtaaagataaccttaagcaaaaatttaagagcactactacatatactaaatttttcttactaaacttttgctaacaatcatctcaaccatttgatttaagtagatagaagttataaaaaatctagatgcactcatagcatgacacatcagtgttagtaagaatttagaaagaaaaagtttgtatgtgtagccttttccaaaatttaatatttgtaattcaattttatgccttggaagacggactcacaagagaatatgtttatggatgttggtattgaatcttcatgctaatatgatgaatatcaattcttttttcttggtgggccctagcttaatgtcaagaatggacataaacatgatagcatttggtataagtaaaaagaaaacgtatgcttgtgtgtttccatcttatagccattgtgtgtctcggtcttaaagacgtcctaaggctgaaaactttagggccggttattttgaagcggttcttccaaaggatgaggacgcataatctggtaacaaaatacaagtcattttggatatatgctaagttatttttacggaacaaatttttggtatgcatggatgtcgtttttacgtgcctaattgattgaaccatgaatgtggacatgaagttttgtggcttcaattcacacatttgatataacaaaacaaaatgtaaaagaaaaagaatcaaataactgaagtcttgctaatgtctcgcatgcgcatcatacattatattagggagtagtatgaattttcaaggccagaaaaaggacacaactatgattcagacaacatagatcataatgatggtaatcatagcatcattaacaaaaagaaaaaggagagaagaccgacccatgcataaccctcgtggggaagctaaggggcactctcagcaccccaaagacatgggagacaggacacctatcaggcatgaatgatcatagatcttgaaactttgaaccacataactatatataaattacgtacagagtgaacaactaccttaaatagatatcgacatgattccaatccattcgactcaaacacacaataatatcaattaaaaaaagagtcattttgctcccatttttgtgtgatcaatagagacaacactcaaccccaatcctagcggataagggcatcatcaccaaaatgatccactgaactcaaacacacacaaaaaaaagggaaaaaataataataataataatagaggttcaccaaaataacatatatattggtcctgactcccatttttcggattgggatcacctgcagtttgaatagcaactacaagttaagctactgcacgcaatggcagccctccattttcttgatgaacgaaccatatcattagctacatatcgatttataagtgctcaacaattcttgcaatagtgatctacagtactcagatgcatcttgatcctcggtttcggatctaacagctagcagtggactgcataagttgcatcgacactaccaactgcaccggatccgaataccatttttacaagagcaatagggaagccatacatccctagctagcactagtggataagggcatcatcatcttggtaggtcacttgatctcccatggcgtccgcacttggtccatgggccatggcatcacaggaactatagttggcactagccccacaggccaggttaatgcaagcttaattatgctgccagtagataagctgccaattggctaccccactgcccttttaactctttaacatggcatcaatgccccttgtggaccatatatacaatagcacttaaagagctgatattttagcataacaatccctttaaatcacacatacatatcactctcaactccggatcatcttaaagtaatacttcaatatctggacctatctgtcagtgactgtttatagtgatctgcgcgcgctaagacaaaaaattcatggctttgcaaagagtgtagctagcaaagaaccttccaaatgagaattagctagctgtggcatctcaggattccaccaaaatattgtcttactttgggcacagagtagaagaggaagacaattagttagttagatgcatcgcatgctgtcatcagcagggaagaagaaccgatcgaatcggttcgatggcgacggccaacctaacagccaaattcgcagtcgatcattgcaactcacaatgattataccttcgatccatccggtttttttgggttttttttcctctctttttgagttttttccccttcgttttcttctcttttccgatccttttgcgtggttggacacatcaagcatggccacgatggggattggtgctagctcagctcgatcccctaatgcatgccctgattgcagccacttcatccgggttcttccgaattatcctcagctggcctttttcctgtaatcaatttaatttcttcactggtccagtcttgtgattattaattaccgtttagacttgcagcaactggatttctggactagtctgaatctctccaagccgccattgctgaaatttctatgttggatttctgggtactgcgttcgttcagccagtttccaactctcccatctacttttccgcacgcacgtttttcaaactgctaaatgatgtgtttttttataaaaagtttatatacaaaagttgcttaaaaaatcgtgttgatctatttttttaaaaaagctaatattaattaattatgtattaataaaccgctatgttttccgtgcgcactattcgtgttgggaagcagaacgaacgaatggagcctgtaagtctagtttggatcagtgtgtgcaatggacggttcacaataatttggtgagccttaggaaaatcctatgcagcgaaaaaaatatatgtggtgaatcctatttggtcgtttccgatggtttaaatgattttcacacgaaacagttcaatccttagttccctacagatgggctagctagcaaaacagaaaaaatgttgtgttccagataggaccagattctgttgggatcaaacaatcaatcaatcatccattgggatcaagatggctatatatgagatgatgatgaggcaattgcaatgcatggggttcaattgaattcttgatggattatcatcaccatctcatcgatcagagagtgatgagaaatgcatgagggccataccctctcagatctagcagccgatatatcattcatttatgagatttactccggtccaacaaaaaatatctcgaggtatagctatctcacggtaccaaatcatttccgattgttgaatctatctgggcaggatatgatcgttggatctaacaatatacatcctaggatatgatcgttggatctaacaatacacatcctacccagttaggtccaacgatcggaaacgatttggtaccgtcagatatcggtacctcgagatactttttgctggacatgagcaaatctcttcatccattcattcttcaccagctcaattgttaatatgatgcatgcaacagtgctgtgtgctgcgtctgagtgcatggaccgatcgacgaccgttttggatcatctgcatgctggggattgctactgctgtacctgcaggagcatgagcatccatgcatgatccatccatttccatggccaatccggttgccgtcgccgtcgtcgctttcaatccaacccggccggcccgtcgacagcagccgccgacgcccggattaattcacaaacaaataaagcttgatgcaattgccattatatatcatctctgtttttaaatgtacaacattgttaattttatcttgtctttggcgtattttcattaggatcgatatgacatatggtatctaccaaaattataatattataaaattagttataaagaaattgataactatgtttacatactaaatatttgacaattattgatagtaatagttttagatgtttgaccaaataaagtaaaccatgtatatccttttaaatgcatgagactgaaagaggcccgcctttagagcgcatgaattttacatgaattaatcaatatacgaatccgacaaatgtatttcgagtggatattgtttaggcaacatcagaagtgtgaacttaattaggataggcaacaaggctaggagatatgcatgcgcatggcgatcgatcgattagtatggttggggttgagacttgggaggtggtaagggtaactttatagggatgtccttggacggcagacatggacggtgagtggttatacaacggcgttggcgctacagccatggggtagtaggaggatggtaggcgtgaccgacagtgaggatgttagatctacaatggttagagagtcgaggaggcggcggcgcaaaccaccaaaggtgaggaaaacggacaggagaggaacaccttgctgctgcttgggcatagcaaggaggaaccggaaggagggaggaggccggtcgggcagggtttgctggtggcttccggtaccggagagcagggaggcgggggttccgtcaagcatcacacgtcgtgtgaggaatgaggggagaaagagagaataaggcaattaaggtgggagagatgttactaactgcacgaatctagcttggcatgatctgaattttatatgtatttttggtcaacggaaaagtaggtgatcccaatatacatacatgcatgcatccttgtaaacacatactacggccgtctttagaatacaggaattttacacgaattaatcaatcagcgagaatccgacaaaggcattctcgagtggacgatgttgatgccaacatcagtactgctctaaaagtgtgaacctaattgggatatactccctccatcccaaaatatttgatgccgttgactttttaaaaaatatttaaccgttcgtcttattaaaaaaattaagtaattattaattcttttcctaccatttgatttattgttaaatatatttttatgtatacatatagttttacatatttcacaaaagtctttgaataagacgaacggtcaaatatatttaataaagtcaacggcgtcaaacatttaaggaaggagggagtaggcaacaaagctagcagacatacatgcagctactggtgatcgatctctctcgagatccatccatggacaaaattacgagagaccgatcgatcgtacgagctgagtgcaagctctgctccatgctccagctcaaccgagacgtacacatacttgccagtagcttcttcttgttggttattgttgttgttgggtcgagatgagcatatcatgtgatgcttctgccgatattcgcaacgtagctggatggcaagggctgtgtttagattcaaagtttggatccaaacttcagtccttttccatcacatcaacctgtcatacaaacacaactttttagtcacatcatctctaatttcaaccaaaatctaaattttgcgctgaactaaacatagaccagggtttggtttctttggttgcctttcttggttgcatgtttccggcagaaagcagctggctcattgacttgtgataaatctttgcacgaattcagtactcctcgagaaaataatgggggatctctgacatgtatgtctaatgtcttggactctaggcaaaaggcaatgggttgtgttaagtactgcttttgatactgctccttaattccattttcaaatataaggatttcttgtatttaagttttagactataatataaaagtatttttttcttgattttccacgatttctatcatttcaataattttaaagccaatcaaatttcgaatcgaaatgaaatctacaccatccaaaattcaaaatttgacaatcaatttttttaaaaaaaatcttttgatgtaacattaacatttactaaataacctaaaaatccttatattatttaaactgaaggagtagaatgtttttataatgctactccatccgttccaaaaaaaaaccattcctagcatcccaagaagagactagtgaagaataaaaataaccaaaatacccctcattattagaaaagtagtagtgttaatagataggtaaagggtatttaagggagaaaacttatcgttttatgtaccgaggttagatatgattgttgaagttgattttttgtaggagaaaattcaaactccagaagtagagttttttttcttagaacggagggagtaaagtagtagatgagatgagtgcgaaaagagagttgaaatttttgcacactagaggcagcttctttgttactgtactgacaaaggtacgagtgtatcgttatgtctgtcagggcttaaatcttgatagcgagctaggagatgatgtgttcctttgaaaatgtctttttatattcagtttgatatggtactataagtttttcttgcttaatgtctatgagttttggcatctctattacgtgagaaataaaaagatgaggatgggcaatttacggtgactttctttttatcttggcttttgatttgcccctcataattaagtggatggcatttttcttgttttccacataagtgtgtgtgataatatgacatgttgtccatgagtctagttgtcattaattatctggatacggtaaataagcaattttaccgtaaaggaactaggtctacacacttgacacaaaacgtgggggtaaatatacgatgggaaccatagctaggtggataatatgaaaaccacgatatagaagttctcaaataatttgaaataaattcttgcatatatccccctacatgtgtgaaatttttttatatttttttccaaaaacttctactccctccattttaaatatgtaacgttgttgacttttagacatagcatttaaccatttattttattcggaccattatataagtatcatttattttgtcgtggactattttagcattaaagaacgctttaagcatggcttatatttttttatatattcatactaaaattttaaatgtaacgaatgttcaagtattatattcaaaagtcaactgcatcatatatttaataacagagggattttaaatataatgaatgttta

SEQ ID NO: 79497 - DNA, 9218 bp, Oryza sativa
gtaccctccatgtctccaacccaactaggagtaccatttcttatttctgaataggagtgcactcaactataaaagaatcttaattttgaaacaataatccagatctataggtgctatacagtagtaaataaagtcattaaacttcatttacctttggaagtacccccttagtctcataatatcgcagcttttagcttttaaaatttgttccagaatataataatttcttcaccaacactctatgcttaaccaataacaatattcgctcatttaattttcccacctactttattttttcagtcaatcacaatattttcatatttaatttcacatacttttctcaacaattgtgtctaatcctaaatattttagggacggtggtagtatatcgctaaccttattgcctgttgaccctttttttttcccaggtgggctctgagtgggttggtctagattccaatgagataaattcagagaccaagcctagcatggccagttcctctactggcggtgacaaccaccctgagggcctgcgtgaaagcagttcaccctctctcaacaaagatcctaatgcggccgtgaagaaactcacacgctgcacggcaatggtacccaaacgcagcaggacagtggtagccgctgaggaagctcagctcatgattggtagaagaaatgaaaaggataaacttatcaaaatgcttgattctggttgtgatgcgaaacatcgagtgatttcggtgatttcggtgtggggaatgggtggaattggcaaaaccactctcgtcaaaagcatctatcagagctccgagcttgagaagcttgggtttgagaggcgtgcttgggtacctgtatcgcgtccattccgacgtatcgagctccttaggatcttggctcagcggttggttaaagattcccccggaaagaaggtagaatctacaccaggacttgcaaggagtggtttaagcatgatgggatctaaagaattaattgacaagttgaagcaagatttaacagggaagaagtacctcattgtccttgatgacctatcgactactactgagtgggatttcataaaaacaatttttcctgaaaacagttctagccgcatcattgtcaccacaagacctaaattggttgcccaacattgctccgaggaagaagagtacatgcacagaatcggagatctaaaagataaagatgctcttgatctattcttagataaggtacatgttcccacctgtataatgacttatttttatcttttgagttcatgctctgtacaacttatatatgcatctcacaacatactgtcgagttgaaaagattgtgcttgtgcatcaatggtaataataagtgagtaaccatatacgccactacattttcttcccttccaatcacaaataagtgatgctttgaaacacgtgaaatcaaatgttttcaaaatttgaccattaatattgctatgaatatttgctgtgatcaacttttgaaaaacttatctttaaaatagtttaaaaatattaccactttgctatattattttatactccatcccaaagagaatgcaactctagcattcaaattttgtcaaaaatatatatattctggagtaatactttccccttcaatcaccactcattcagatttctccccattttatctctgaccaaccgcccaccaccgatcatctctaatttaatgagggcatcttaggtcatggtccttttcttttaatttatcttctgaatgttatatttttgggacgggagtagattttatataagtaattactaataacatgcttgtactaatgaccatgtcattgtctaaaaaatcacttatttgtgactggaaggagtagtttgattgtacatcaatgataactgaataatcatatatatgtccttacgttttgcagtttgtccaggcaattttttttttattttttaaaaacaatattttaaaattagacatggcatacattcagtgtacagtaaaatttcacataataatttggttgaatttttatgtattttgtaagtaaatttttttgttaagagatgataataatttagtctacacatgcaaatctcaaatatatttttgcactgccctaaaaaatatatatatatatatattttgaactcaattaattaacatttttccaatctaccactaaatgaataccatgttgaagttcaactacaaatcatttatgcatgcatgtatgtatgtctgtttacatatttcaataaagcaattgttgatgctgatcttcatattaatgtgtagcacctagtttaacatagatatgattcgctaaatctgaactatgattttagttcttaatatatttatttggtaattacaaggtaattacaacaatattatatactctttatgaatttaacttttttttcaaatttatcttaacatttatgtttaaaccaacatccacgattacttgctagtactaaattaattgtaccaacaaatagttatctaacatggaagttagttttgttttttctcaaaactttggtcatagttctaacaaatatatgttttttccaagtttgtatttaaactacctattattgatgttttgtgtaattccagttctactttttttaaaaaaaataaatactttgtcttcctatgagagcggatacaattctatcagccaaaaattggtgtgtgcctaaaggatttatctgtgggtttagtaagaaatgtatgtgtaacggaaatatgattaacatggcttgtatccatatcatatttatatctatgctaattgggtacaccgaaaaaattcttgtgttaattggataatattcaataaatctgccacctatcaaagtaggaccaaactatagaatatataaaaagaaaagccagcatcgattacatccagggtttgcaatttcaacaattttcgtgaaatttctagattttgagctggttcagaaggagattttgaattgaaattcaaatggttatgaaaacaagtgaattgaaaatactaaaaaaaatcctataaattatatggtattattaacaaatattgaatcacttgtctatttgaacctaagaatgagctatatagttttaaaaaaaggcacaaaggaccaaagagcccataaaggatcagccatttaactgaaattgaggggatatactcctccatccgttataatatgttggtattatcaatttttctaaaacaatattgaatttacatatattgaacctcaatcatacaaccaatattgtataaaaaaggcacaataggccgaaattccataaatgttgggcccgtttaaccaacacagagggatatatatttatccacacctttcatacattttatcggatatttttgcactatttttataaattctgaacatttttctctatttcccatttccaaataatcgagagacttttgcatacaactgatatgcttccgaactttttcaatcaattttccctttcatttttgctaggaaaaaaaactaaatttcaatttggccaatcaaaattcaacgcttttcaatcaaattcgatcatcttccaacaaatttcaccctccaacttcaatcttctgtttttgaaattctctcgattttttttattttcactatttcgatgatactcacccttcggtgttcaattgaaagtgtaacctctggttacaactttctaattatcaattttaagtttcggaactaaattaataagttacgaaattgtgagtccaagagaggtaaaacctcatagttatttattctagattcttgaattattaaatcttgaaaactttgcatcgtcattcctaatatataaactaggttaaactatacgcgttgcttcagaagtttaatatgataataacaagtaaaaataatgtgtaaaatagctagacgacataaacttatataagttgatgtgctttatgataatttaaatagtatatagaatgatgatccaaatataaaagtaaggtgatgtggctttatgagagaagaaaaagaggaagataatttagacaatatattaatcatctaagagctagaaacaattgaggtgatatggcttgatgagagaagaaaaagagggagataatttgtaccatagattaatcatctaaggtctagaaacaattgaggtgatatggcttaatcagagaagagagaaatgatattaggtaaatgaggatgaactatataggtacatagcatattataaaaataatggagatatatatattaaaatattatgtgaattatgtgggatgatgatttaacatgctggtattttaaagctctaaaattcaataaattatagataatatagcatggttgcgtgaatttaagatataataattgttagtagatgatgatattgcatatttgcaaattgagttatggatatggtgggttgtaactttatagaaaggtaggattaatttatcaacaaacaataattaatgcttcaaaccaaggacaacttcaaatttatatttattgattatgatccctcattagatagaaattactaagtatttattttgaatttcaagaattattaaagtaagaaaatactaaaactcagatttcatgatgagtgaaaatttgtgcttattactttagtacttaattagtcatgaaaaactacaagtaagactccaaaacaggtacaactttctaatatactccttcctcgcataaatatttattgtttagtacactatttggtcaaactttcgaacaaaattttgaaagtttgaccatcattaacatcacaaatgcttagtttataaggataaaataaatgtacgcatagatttgtctttaaacataccgtcattatatggtaatcttatttgatttcatcagcttgatctaattaaaattgatggtcaatatttgaccaaatcttgttctaaagaacaaatatatatgactagagggagtatgttagtgatttttgaaactatttaatcaaggaaaaactacaaattaggattcatgacaagtttagcttttatttattaattattagttatatattttggaattattagattgagaaaaataataaataaaatgttctggttaattatatataataatataataattattgagtttaaatatcatctttttggcctacgttgtttgagttcaagcaattggacaacaaaatttggcttcttccatcgagttagggtgcccaatactgcttggttaacctctttatacgaatccttggtttattaatggccgatggctctcttaaatatgatccttggttttaatccttgagcatcatccgtagtttagaattcttatattttcccctttaaagattacaataaaatcttctggtagttaactaagatttcagattttcaactggggctttattaaaaaaaagatgaaccagtaaaagtttcttgtgcgagaaagagagatcttcatatattgtgtttaacttgttaagtgacattaatggcaggtatgtaagaaaggggatgaatctgaattgaagcctgacatgatggacatcctcaagaaaaaccctgacatgatagcagaagcagaactcattgtaaagaagtgtggccggcttccccttgccattgtggcggtgggtggttttctgtccacaagacccccaaacattagggaatggagaaaattcagtgaccatatcagtacagaattggatgagaacccaagtctcgagatgataaagaaaatacttatctcaagctatgagggtttatcataccaccttaagtcttgctttttgtatctgtcgattttccctgaagaccatgacatcaggtatggacggttattgaggcggtggattgcagagggttactcaagagcaaagagaaacaataatgctgagaaagaagcggaggaacagtttacagcccttctcaacaagagcatgatccaacagtcaagaacagttaccaccgggaagacaggtttctgccaagtccacgatctgatgcgtgaaatcagcattgcaaagtctgaagaagaaaatcttgttcttgttctagatgaacacagcatctcgagctctaaagataaagtacgacaccttgttataagccagagttggagcagagaacagaagaagaacaatgatatgcaaaatatagtggatgtctcgcatatacgatctctgacagtctttggggagtggaaatcatttttcctttctaagaagatgaggatgcttcgggtacttgatttagaagacacagatggtcttgaggatcatgacattgtgccaattggaaagcttcatcatttaaagtacttgtctctaagaggatctgcaacaatcctcaatcttccaagttcctttggtaatctgttgaacctggagacactagatatcaggggaacatgggttacaaagttgccagcaaccattggtaggttacaaaacttgaaatacctccatgctggcatgccaccagatgatgaggatgacaccagaagctgggttccgactccgccatcggcaattttagaggcatttcgtgagtactggacaaaccaagaagaggttgggatgggaatcaagttatttgtatcagtactcatgtttttgatcagtggttggttgagaaatatggatctgtttggtgttaaagtgccaagacgaattggacgattgaggtccattcacacactgagcgtcgtcaacatttcacggggaaaggccatgctgaagaacctcaaaaagcttacccaattgcgaaagctaggcgtaactggcattaacaagaataactgcgaagaactctgttctgtcatcgtcaaacatggatgcttacaatccttattacttcgggcggagggtaaggatgggttagaaggttgtttggatggcttgtccccccctccaaaagaccttgagagcctccagttgtatggaaatctggtgaaattacccgaatgggttaaggagcttgaaaatctacaaaaattgagccttcggagcacgaatctggaggcggatgctaccatgcaagtgctcggaggcctaccaatgctcgacattctacgtctccaggacaaggcgtgcaaggagaatgaactacgtttccatcccgattgtttcacaaatctgagggcactggagcttatttcgtggggtagcctcaaatcagtgatatttgaagaaggagcgacccctaaacttgaggtgctactggtggaccattgttcgtccatagacgaagctgggtttgctgggatagaaaatcttgcaacactgaaggaagtttcgctccagggttactactacactgaattcaagaaaaaactacagcagcaacttaacatgatcgagcccagaccaaatctaaggattgtgttatacaaaactgtactcccccttacaatctattcacactatgtaatgaaccttgtccgttccctttgaccctttcaatgcaatgacaaaattcaggtggggaatccccccccccccccgggtgatttgggctgtgtttagttggatccaaagtttggattttggttgaaattggagatgatgtgactgaaaagttgtgtgtgtatgacaggttgatgtgatggaaaaggactgaagtttggatccaaactttggatctaaacacagccttggtaaaaaaaaaaaactgtactggttatgcatagaagtcgctccctccatactcaaatatgtggcattgtatcattcaagtagcgtttcataattatctataattctgaaaatttcagcattaagttttactcccttttgtctcctcatgtaccactcgctttaagtgtataagttttagtttcctcgtgaaactttgtaataccattgccatttcactgccagttgcaaagacaaaaacaaaagaaattggcacatctatttattgtaaaattattgatgtatatattttataaaataataaaaggtgaggaaagcttcctgcccagtttttctggtcctcagttcggctccttcagtccatcgtttgatctcttctacccatctgctcaatcaattactgcctgtcctccctcactccacccgcactaaacctgatgttaattcatcaacaactaacatatttccctgtaagtacgtgtactcgcacgcagttaacgatgatcccttgttagagagagatcgtgccgatgccgatgcagatgcaggcaccggagcttcaattcacgaggagttctgcattccggcctcttcatcgcccgctttgccctgcttgtcactagctccggcgacctgcgccgtctcctctgcctccttggagctcctgcgtgtatcagagctctcagtatcaagcgaaatggtaaaagattacagagctatgcaggcatgtcaggatgcagcaattgacagcttaaagcatacttgtatgagtagatgaggaggccagccgctgtgccggcgaaggcaacgaagtagatccagtcaacctggccatgagcaaagaacaccgttcagttcaagaaccgaccagcatgtctagtgaaaggaatgtgcagagtgcagaccttctcatggtaagcaaagatgcggatcagaacagcccacatatctgaagtcagcagtgagaggttcagcatcgttgccccacatatctgcaacagacaactcaacgataagcaatggaacatagatgatagatgcgagttcattgacaccatttttatcatgtaattgcgaggtcgtcatctctgaaatttagtcagtaatttctatatcagtaaaaagcacagcaatgtgcaataccttcagtactgtaggtacagttgagtagaacaggaacatcgctaatgcgaatccaagaaaaggaagcacctgagaaaaatagtagaaatggtcatgccaggaaaattaatgtttaccaattgccagcagacattgttcactttgttgtcaattttaacattaccaaattttggatagttttggcattgccaaattttggtagcgttagatgtatttagtttgatgcctttcaaatatttggtagtgttctgtgagaggaaagtttcggaactaccaaattttggtacagtggcattggtaaagaaatgtttagttggttgaaaatggcaataaagtgaacatgcttgaaaggagatcaaagctggatttgcaattttggttcgaaatttatg

SEQ ID NO: 79498 - DNA, 5842 bp, Oryza sativa
tgcaccactcgagaagtcaaaagggtaatcttttttttttcctcctagaactaattacctcatcaaaaaaagtgaaaaaaagaaatccgaaactttttatcacggaaagaacgagatgtctccaccgtccaacagagagccaatcgtaacaaactactgctaccccaattaaacagaacaaagaaaaaaattaaaaaaacaggagaggtatgataggaaattcgctgtttcgtagggcagtgatacgatcatccaaaccaacagataagattgtcatcatcacctcggcgggcgagctcggaggaggagaagccggtggaggtgatgagcagcgacacgaactgccccagcgccagccccagcagcacatccctccgcatccacctcgccacgcaaccaccgtcttcctcagccgccggcagcagcggcggcgccattctcccctcccaccccgcaactgcaagggcgcaaacctctcggctctcgcgtggcgcgagcgcgtgcaatgtatggttgggttttggagggattcgcgggagatttggatatggcgttgaggagtgagggagtcgtggatgatagggagggagtaggagattaggttggcgcggggggaaattattggggaggatcggagggttggtgatggaggttgacgtctcgtgaatcgtgcgggggccatctgggccgtcggatccttctttccttcctgacttgacgccgcttttgtgttgagctgtttggactttggaggttggttttggatgcgttgcaggcgacaaaaacggtttacgccacttgacttcaaacttccaaactttcccatcagatcaaaactttcctacacacataaactttcaacttttccatcacatcgttccaatttcaactaaacttctaattttagcgtgaactaaacacaccctctggatatgcgattgccacatgtaaactttaaaccttcagctttagataaacaaaaaagatttgaaataaaagaggatttcaagcaaatttaatttgtagtaataagatgacagatcagggtggtgatgtggccagaggtgactatagggatatatggggcctgttcactttgatgacattttcaaccttaccaaattttagtaaagttactaaaaaaaagggctatatttagtttgctgtcaaatttttgtaactatataagaaatcctgccaaaattttgataaatttggtaaggttgaaaatgatataaagtgaacaaggccatggtttggaaaatacattttttttactaaacatggtacaaatgtaggtgctcacaacgcgtgcgcctttatctctattaacatgcatcctacctttataaatgcctccaaaaacttgaatcggtatattttaaaattgatgaagttatcataggtgtcttgttgttgatacggttgaagtctccccagaattcaaatggaaccttaaaattatctgagtgatgcacatagatagccccaaccctcaacgaaaacacagttacaaagttaaagcaagcaaccaattagtcaaaaaacctctgcgaaacatccaccagcatgtctgacttacctctcagtaagagagtcacacgagtaaattcctgtggcaaaaaaccaaaccaaaccgttcgacctttttcttgatgtgaaaccattagcacacccgacagtgacagatgctactagcaccattagcatgatactacaatgaaaaggccatagatgcatacacattcatgaactctgcctgttgggggagaagaaaggatgaactttcagagtttcagatagacagtgaactgacggagagacggacggacggtgaggcctatatagctttcatcatttgaacagagacatttcgccgggaatctgctctcccctcttgacccacccccaaccccaaagctgtactcgtattgtgctgtgcaatctttcatgccaaaaagcgtttggagcgttccatcgccacaaagatccaccacgccgtgtctctctctcgtggtttctccttcttcgggtgtgtttagttcctgaaaaaagttaaaagtttgaagaaagttgagaattaaaaaaaaaaaaagttaaaagtttatgtgtgtagaaaagtttttgatgtgatatgatgtgatggaaagttaggaataggaggaaaactaaacatggccttcttctttttttcatgttgctctgtgaactgaaaactgataagataacagtgctccaatatctctacttttacactgaaaaacactgcttcttgtgtctgttggttttcggttttctgaatctgaagaaactcgctgtctgccttcctgtttctaccaaccgcgcttacccaccgcttaccctctatctgatgggccttgctccagctccacctgcgttgttggtgacgtgtcacggtccagcccgttagtgagatgggccgcttggttgttggttcgaacagatcgcaccacgggcctaacacacgtacgttttcagggcatatgggcctagcttcagagtctctcagactcacagtaagcctactgcttccgtcttcgtcagaaattcatctcaactgctccttccgtttccatttcaaaatatagtaatataagattggaatggataaattctaatacgaagtactatgatgtattcctatcaattctaagttactatattttaggtgaagtaacactgtaaaagtaacaacccaaataattttgaccatcaatcgtggtagatcgacctagcaactgcgaagccggcaccatggtagctcaactacacacttcagacactcagatgtccctttccccttcatcaactcacgtctccgtctcctcgtagtatctgacttttaaggtttaatcgcagtcggttttaacccacagaaataaaatgattttgactcattttcacttgttcattgatgatttagactgtgtttgatagagggggcaaagagggaaaaaaatctcttgtatttcacgtgcacatttgtcgagctgttaaatgatatttttttaaaaaaatgtatagaaagattgttttaaatattatattgatctattctttaaattctaaataatcaatactcaattgagtattaaaaagtcataggctaatggtttacatttttttacgtacttctaaatcttttccatttccttccctttggaaaagcttaccagagtatactaacatgtcttctagattataataattcatcataacaatataaagatttgtttcagattagtcctaataatttaggttataataaccttaagccgaatccttaatcacgttttgaaatgaaatccgccgattaccccatgtggtctcttctcagcagcaaagccaaagcctgagctctcacaagtctcaagtaggagtagaaaactcctcggccgtatcgcctaactacaccaccccatcttctactgctcgctccccgccatgatgctgctcgcccgcgccgtcctccgctcccgcctccgctgcccgccgctgtctgctgcggcggcgtcgacggcggcgttctcgtcggccccgtcgccggcggcggcggaggcggagcgcgcggtacgggacgggcccaggaacgactggagccggcccgagatccaggccgtctacgactcccctctcctcgacctcctcttccacggggtacccatcccaatctctcctctctcttttttttttttttgttctgtctgtgtatgtgtgctcgcttgattggtaatctttttttattatttacggccttcgacttcaatctgtagttattccttgccgttagggaagtttattattaggagtgtgagagagtagatgaggagcaacgaatgcgatgcctttctttgtttctagatgtgcttgagaaatgctccctttttgctagtgaaaaagaatgggagaagaatgaattggtgggcttcctgtagtagcagccgggggaatagtgatgccaagataaacttttttactttgtggatcctggttcacggtggatgtagttctcgataaacatcctttttttggtggcatctgggatgatgagtagtggatacttctcttctttttttttttttttttacttttagtcaaatatctaatattatggctatagcatcaggtagactcgcgtccatgtccagctagcactgcctggaattagtagtaagatgatactaatctgtcaccgaagttctgatacatgatagtgattagcatcttatgacatactagagccttttagtagtgggactaccaattattcacaccaaacttagtgcggattttgtacttggtgttgggtgagatttgccacttaggatcgctgaactgtgggaagtgatgattgacgcaaagcataatgctaagcaccaactggaaaggctttaacattcaggggatattatttgtttactgttgttatagcaggtgctagctttttcgttatgtacaatcactagtgcttaaatttgtgtgtttgttccggaaaaaacttgaaatgatgtgtactatccctatgctatcaagaaattacaatgtgctcatatggatttgaggctaagcttttgcttggtcaagctctagtattaataggaagtaatgccctcaagggcatttataatctggaaattggtgctaaggatttcccatataggggcttcagacaattcggacttgatattgcaaatttagcttgagtaatgaatggcccatatcaaacatgtttggtcacaacaatctgcaacgatctgactggcttgatgcacgatagcttgtcagcattcattcaaatgcatatcttagtcgcattattagcttagtgcatctctgttggttatatgttgaacatatttcccaagcttttcgttgatcattttagtcaaagcctcaaaggggaaggaaaactattgtccagccttcacattagtcaatagggaaatagctctcaattgcaatgtattttcatttaaccagataatgcttgcattttctataggctcaagtccatagaagtgtccataaattcagagaagtgcaacagtgcactcttctttcaataaagacaggtgggtgcagcgaagattgttcatactgcccccagtcctcaagatacagtacaggattgaaggcacaaaaattaatgaataaagatgctgtcttagaagcagcaaaaaaggtactgtttttgtaactttatctcaaggtgaccaagttcatttatgttgttgtttttaaaaatcttgcgaagtggtaacatgagttcttacagactgaggacttcagctttagttcagaaaattatgggttgtaatatcatttcacattatttcttctgatctatttccgctcaggcaaaggaggctgggagcacccgcttttgcatgggagcagcatggagagaaaccattgggaggaaaacaaattttaatcagatccttgaatatgtcaaggacattaggtattatttttgaaagatagcacaatagaattattgtgtgcaagtatttggcagagtcttgcataaccatgcactgatgcgcatgctctcttccatgccattgctatgtcatcattagtttattcgtctgtttttttgtatttccaaacatattagtattgtcaatcttgaatgtaaaaattaaactattctttgcctgttcacttacaaacagacgtaatcttgagccatataggacactgacttaagcctctgcatacattacgatagaatatttgcatgaaggtagttttcttgctttatcactatcttgacttcgatttaccattctgtggataaatctctgcagaggtatgg

SEQ ID NO: 79499 - DNA, 4290 bp, Oryza sativa
  unsure (1)..(4290): unsure at all n locations
atagtgtctttttcctatttatcccattttagtttatttcccatataaatttgattctataatttctaaatcttgcataaatgaagtttactcaatatttgtgttatctcaactaatgaattcaccctagattaatattactcatattttattggtataatttatttgaatttttaattagggttaattcttgttccattgcatttaaatctaattaatacaaatatggccgtgatgatattttatttattcctatccttacataatctttattttaaattataatttatttatttctttaaccaaatctaatttcagggttaattcctaattaattttcccctatttgtgatcgatgaattccgaaatcaaaatccaataaaatcgtcgaataaaattggcatgatgcaatttatttaaaaagtttttgaaggcccatatttttagagtttagattttttatcggtcgaattttcaggtgttacaactgtccacccttatcttacagctacactgaggctacttacatagttgtccctaccacctttgatacccgggccctcctcccaattcccctccacacccgcactcccaaactcaaaactttatctggatgtgccgccacttaggttccaagatttcatcggatatgaaggcgaatttggtgatttgagatagggtcaacgaggtatcggatcccttacctaggttgactctaggggtctacatatttgcaacatactctttccatgtgttttctcattttctatcttttcattctatctatgtacaattttagattacaaagctcatgtcggctcgattgtcagtctatgctctcacgtcagctttttttttttctacaagaaccccttttcaattttagttttagattcactgctagagaataagacatcttgatatatgatttttggagtcgatcagaatgccataacttagactaaattgataaaaaaaaagccatagatatatgtatatcagcactgaaatagaaggtgactttggatgttgaacaaaagctcgtgacttagatttaaatcatgccaaaatctatatattatagatatatatgtatatcaataccaaaatagaataaatacaactttttagaagggagaaaccttttaattgtgattattaacatcccaaatcacccctctttgttgtatactacatagaaaatccacaagtatactgctagtataaatttctcaattctaaaaggtcactttaaattactcagttacaaacaaactgcttatattgagtaacatgtaaggtgagttatcaggtttaggtagcaagaaagttgtttctaagtttgatgacctcattcttcatgtaagggctactttttcaactaccataataaatgctattaactccaacctaccataaatgctactattccaaactatgataaatgataaagccaattaaattatgtgttccaaagttttggttccgttgcatttttttcatttgtaaatagtggtcaatcaatatattgtttataaaattgtgttaaagtaatcacaatagatgggtcttgaaaaacaaaataaaatcatttcaagagaaataaaaaaggaattacatacatatacgccgacacattttattattgaattagtcaaaacttgtgcataggacaaaccttatctctaacatccatcgcatcccctcctctctgtccaccatctnccttccccaccaccccaccccatccaatccttcactttgttaaccccctcgtcgccgacttctccaaaaccagctaatatccccgctatgttttctttcctatctcaagcgaccaccatttaccaccactttcgtttcatcccatccatggcgcccattgtcatcctttgatgttatggctacgataacactactttcatagtcgcccctacctcctttgacacctagcccatcctctcgatccccgtccacacccgtgtcgcaaacttgaaaccttatatggacgtaaccacggcctagtttcctagaaatcatcgaagatgagggggtgagaatttggatatccgaagatggggtgagggagatggagggggaggggaacatgggtcgaccgaggcgtcagatcccttgccatggttggcacatggtgcgaacaactagatctacatgtctgcactacaaaatatcgaggtatttctttcgacgaattttctcaattttggttttgcttaattctatctatgtacaattttagattacaaaagtttgtatttgctcgattgttactctcatactcttgtgattgttttgttctatcatcaaattttagttttagatttactaccaatagaaaagtctttggtatacaaattttagatatcgaataaggggtatctaaaaaattaccataagttttttttttaagttttctgagtgaaaaactttcaaatgtaactatagtataattaaagtgtaactgtattgtaactatactttaactatgatataacttatataaaacttggatttaaccatgttttggttggttagaaccgagatcttacgcatgacatatttgaaacatgcaaaaatcttgaggaagtccgatggctagaaatcagcaaatttgaggataaaaacttatggaagttctcaagcaattctgttgaacaaaacctcataacttagactaagggtgtgtttagttggggaaaagaaaatttttgggtgtcacatcgaacgtttgaccggatgtcggaaggggttttcggacacgaatgaaaaaactaatttcagaactcgtctagaaaccgcgagacgaatcttttgagactaattaagccgttattagcacatgtgggttactgtagcacttatggctaatcacggactaattaggcttaaaagattcgtctcgtgatttcctccataactgtgcaattagtttttctatttatctatatttaatgcttcatgcatgtgtccaaagattcgatgtgatgtttttgggaaaaaattttggggaactaaacgggccctaaaggcatgccaaaagtcacaccaaaactgaaagaacacaactttgctagcctgggccctatttggttccatttgctaatgtttagccctcaccttttagccttaaattagccctcaaggatccaaacaggtgggctaattttgagctaatgtgaattagcccccctcaaaacattagccgctaatggggctaattttgtgtggggaccattaaaaagcagctttctctctccttctctctcctccctttctactctctctccaccttttagccttgaattagtctatggatccaaacataccaccctaggctaatgtttagcatatcaattcatgactaaacattagctcttaaaattagctatgggctaatcttccacacagggcgctgatactagtgagaactgagaagtgcaaattgcatcttccaacctcctaatcttgattattacatcccaaaattactgaatcccctcctcttattgcttcacagttcccaaaagtgtaccacactggtatataaaaaacaccccatcctgtgtgcctgccgactcgcccacgcaactccgactctttccttccccaattctcccgtccaccggccgcggacctcgccggaaccctagccccgccgcccccctcccctccccgatcgcccgattcggtggtcggggtgatggactccgacgccgagatgcccatgtccagcgacgaagagatgttggatgacgaggactattacgactacagtgatgacatgggtgaggacgatgatgggaacgacgccgggggcgggggagatagcgatgggtagtaggaggaggagggggatgagaagctggtggccggcgactacgaggcccgcgaggcggaggggagcgacgaggtggtgtccccccgcgagcaggtgaggatttttttggtcggaagcagatcaggtggtggactggtggtggtgtttttttttcttttttcttttttttagcagaaagcgcgacggtcgatttcattaagattttgggaaaaaaaagttttcatacaactcgagattacaccccccttcggtgtagcttagcggggaggcaaggcgagctgaacgtagatcaggacctggaagatcaggggtgctagattggtagcgtcgaacggtctcgagaatggcgtcgttttgctgaaataaggattaggatgagcttatggcgtccttttcttttttttttctttttttctgaaatgaggatcggg

SEQ ID NO: 79500 - DNA, 14577 bp, Oryza sativa
tactgtaattacatctgacaaatattagggggagaaatttgatgacaaatatctagcaaaatcgtaaaatcaaaggggggccagccggcttttgacagttcaaaagattggcaatttctcctttttttttcatgcattggcaatacataaaagcgaatagtttgcaaaagtggacaatatacttacatgttcatttaaacttcacggcacgagtcttcactgtattgaaatcgctgctatgggccagccggattgaattgggccatacggtggcctgttggacctgggtaccatatataggggtaattaaaaaaaaatttattgggaggcgccatggcccctgccaccccccttagttccgccactagctcacgctatcatccagatccagcagtgcccacccaacgcccgactccatggcgtctccttcgtcgtcggcggagagacgttccctgcgcaccgtgccgtgctcgccgctcgctcaccggtgttccgcgcagagcttctcggacccatggcggaagccaagatgtcacgcataaccatacacgacgtcgagccggtgacgttcagagccatgcttcggttcatctacaccgacgaactcgaggagaaggactccatggcaaccgatttgctccagaatttggtcgcggtcgcggataggtatgatctaagcaggttgaagctgatgtgtgcgcagaagctgtgggagaaagtatcggtggaaaatgtcgcgacaatgctgatctacgccgagatgcacggctgcccggagctgaagacgagttgcctcgacttctttgtgcaggaggagaacttcaaggtggccgtgctgaatgagggttatgctcagttggttcagcattttccatccgttattgatgaaattaaaggtttgttgggagctaaaacaatgcaatggagtgaaaattgatgtggtatctattgagtttaagcttgttacaatgtctatgaatagtactactccagttacttgtatccgtattacttcttctgtcccaaaatataagcatttttttgacttcgatagggtcttcgagatactactttgactaataatatctataaaactaagatgttttattttaaataaaaagagttgcgcattatgatagtttggttaacgataactctaataacaccaattttacatgattgatcatttttatttttattttgctattaatagttaaagttaaaaatatttgacttgatactatactaaaaatatttatattttaggacggagggagtatcttataaaactcagaaaagtttgacagcatgttctataaaacatcgtactctaggcagctagctgttgttttagctatctcaattctcaactactccattcttcccaaattgatcatcatataatatcatataatggaatttaaaatttctcaaattgatcatcgtataaccgcacggacacacatttcatccgaatacaattaatgcagcatggaataatatgtgcatgctaaggtataattggcatggtgttttaatcgatgcatggattttagagcaagtttaatagtacagccaactactagctccaaatcatctatagccaatataatagccaattcatataatagttgcttactatactattaatacccggtcctacatgtcatacacacatttcatcttggagtccgtgctgcagctggctacagatctgtagcccgctgctcttctctctcttcctttatctctttaaaatatgtttatagctggcttatagtctgctattgtacctgctcttaagagaaaatgtgcatggtctcttgattgatgtgatttaaattatccttggtgttggtgtataaacatatatgatgattaatttggaaaggagccacgtgggtgaaagcggggcgagttcccttgcggtagttcatctattcgggagacgtgtcctaacccatttgttttgcccttgtaaaagtcttaagtatttttaccactaactttgttgtatcaatatatatgagatacaacttttatcctcttttttttcttaaaaaaagtagtttcaaaatataagtaacttttgaattttaggcacgacccttttaatatttttagtggtaaagatgaatatttttatgtacaagctgggtttttcctaggcaggcctgtaggtggaccaggcggcctcgtagatgagagcaaggctaataatatagtcgacgtgttggctataaggttctttatagccttctcttagcatacccatataatagttagctctttataattaatatatggccaacttgtctctctcacagaattttttggttcttgtgtccaagccggctgtaagtttacaacccgtttttcctctctctcctctcttctctcctccacctcagcatttagccggcttatagcctaatattatacttgctctgaatctgcgtactgaagtatggccggccgttgcagcgccagatttaatgcagcggctgaaccgaagagacgaggctcaggtgatcgaagagctcagcgcaaacccagagagatcacagctgcagtaacaataacgcgggaaatcaaactgctactcattttgatgacaaacaaggagaattactgctactcgaaactcgaggagttcgatcacactgtactgatcactttgatcagtgtatataatcaggattatgggagttggatactgttcgaatcgatagatagatacatctccgactcaatccctctcgcgattgcgttctggtttgcagctccatatgctggcatgccggactctggttctctcgagctcatactagattacgaggcgaccaaccactgtgccatcctcgtcgacggcgagacgttccccgctcaccgtgccgtgctcgctgcccgctcgccggtgttccgggcggagctccttggctccatggcggaggcgaagatgtcgtgtatcactctgcacgacatcgagcctgtgacgttcagagctctacttcggttcgtctacaccgacgagttgcctgcagacgacggcggcgagctcaatacgacagcaatggcgaccgagaggaagaagggaggaggctgcctactgatggggagaagggcggggagcggcaaccatcaggctgggaagctagcgagcgtgcgcggagagggaggaggcggggaggccgatgagcaggacggagagccgacgagcgggacggggcgaggaggccgacgagcgggatggggaggccggcgagcacgcgaggagagggagaaggtggggaaaggggcggagggcgatagccatcgggcggggaggccaatgagcttgcgtggagagggaggaggcggggaggccctcagcccgtcgatctccctatcctggtggccttgactccccacgtcttcgcccacgacgccgccggtagtctccatcctcacagcgacgctgccggtttcagtcatactacttttgccacaccctcggtgagcacccatgcacaaagcctctttgaaattgctaattagcgcgtatgcgccatcagactaactcgcgcgcgtttctagcccatactcatacgcgacccacacactcgcgcttaccccatcgcttcctttttttacgcttcttctggcgattgttattttgggtaaatctttccttttttttctccacatgcgtgattctttttaggatattttataaattaaatctttacctcccatttcacttgagaattttgaatttgaattgattttttttaaaatttaagttgaatgttttgaattttaagatgaaagttttcaaatttaaattgaatattttgaattttgaggcaaaagttttaaaatttgagttaaaagtttttaaatattgacttaaactttttttaagtttgagttgaaagttttcagatccgagttgaaagtttcaaatattgatttgaaagtttcaaatcttgatttgaataaagttttcaagtctatattgaaaattttcaaatccaagttgaaaattttcaaatccaagttgaaagttttcaaatctgagtttaaagtttttaaatcttgacttgagaatttacaaatttgagttgaaaatttcaaaaaaaattgagttgaaagtttcaaatcttgacttacaagttttcaaacataagttgaaagttttaaatcttcaatttaaaagtttgttgcagttaaattttcgtacctatcccaatttgtcgtgtcctaaataaaaggaataaaatgtgtgggcagttattttttcaaataaaaaagaaaagaaaaaagaaaagaaaagaaaagcgagaacgctacccgtactacccgtaccgccgatcccgcgcgcgagttaatctccccacgtgcacgcgtgggataggaggcccccatcctctttctcatatctcccgagcacaccggtggtcgagctcgatgacgttgcggccgtcgcctagcacctccccaccagccatcggccgccgctccgctagagagctagacagagatggggaagagggtgagagaggaagaagccggcgtgttgtatcagtgacatgcggagggacctgttgcatctggtattgcagttcagggaggaaaattgaactcggtgtaaagttaagggacccaaatgaacttattcctttatatgaggttgtgcgtgttgtccatgggcctggacgtgcaaagctgggcttctcctagacaggcccgtagacggaccaaggcctggtagatgccccctggaccacgtctggtttgcacgccgggcgaacaagcgcgcgagctgaaccgaagagacgagcatcgggtcaaggtgatcgaagagttcagcacaaacctagacatcacacagatgcagtactagtaaaacaatgatcttgttgtatagcagcgctgctagtcattttgatgaataagaatgagaattactgctactcgaaactcgaggagttccatatctcagtgctgatcaattttctttttcgaggtggagtaaatcactgctgatcacttgatcagtataagtataagggcaagttttataatagatgtggtggtcacctccaattttatccacatcatccattcaaaaaattaaaattaacttatataaatgcattgcatttaatacactagtcccaatacacttgccaccaatcagccctcttattttctcttgttctttgaaatttgtgtggaggttgccccttgcatgagggatggctcctcccctctcttctcttctctcctccacatcattatttaagcatacatggcactttggagtttgtgcttagaaccttagggcaagtactataggcatttaagcacaatcacctagatgccacctaattttaaatgatgatgtggaggagagagtagatgagagagaggatgagccacccctcatgcaaggggtaacctcttcataaacttcaaggaggaaggagaaaagagtgaggttgattggataagagtgaataaaataaatatttatgttgcattgagactagtatgtgagctgcccttaataaattagttgatgatgtggacaatattagatgtgatagtcacctctaacataaaacttgcccttatagtacttgccctaaagccatcaggattattgttcgatgcttcaatagatacatctccattaatatttgtgatgaataattggctttacaaaagatttaatcaataaattggtttgaaaatatgtatgaatgttggtgtgaatgcgtgggactaatgtgggtcaggttgtgatatctgtgcttagaaacagttgttttgtctgattatgtgcaggtgacctgaggtcagccttggtcaatggtgaggaccggaactatactcagggaggagcagattaggtctagtgctgttgagataccatgtgagaaggtgactagagtcagtattcttagagatcaacttcggttaacgctggggaccgggactagactcagggaggagttgagatccagacggtcaaagataccggataacgaagttggatacgagatggcacaccatggatggacatcgtgtgggagagatcttcgcaacaggtttcacaaggtgtgcatataagcgtcggtgttcgtgaaggagattgaaagaaattggagtggagtatatattttttttgaaacacagtacaaacgcaggcgctcacaacgtgcgcacactcacccccatgaacgcacacacgcacaccctacccctatgagcacctcgctgtcgacgggtacgtcgcctaccactgaaagaataattagccgtaaatgcgagcacccgtgtcaaatctaggatttgaactcgggtgggctagttccaccacaaggaacctaaccagttgagctatgctcacttcactggagtggagtatatatgatgctacagtacggcgaggtactgttggagcatgcatatactccctccgttttttaatagatgacgtcgttgactttttctcacatgtttgaccattcgtcttattcaaaaaatttacgtaattataatttattttgttatgagttgttttatcactcagtactttaagtgtgatttatatcttatacatttgcataaaatttttgaataagacgaatggtcaaacatgtgagaaaaagttaatggcgtcatctattataaaacggaggtagtatatgtcaagtacatggttgctacagtacactatgaactgtagcggtacactgtagcatacatgtgtcgtgtgtgctgtggatgtcggcctggatggttgggctggcttggattgctggcggcccacgttggtatgagatgcggtgggctgcagggcagcctaggtggcccacgtcgagaggcagcaaggcatcggcccagctggcctgtgcggctggagaggaagcagccgtgcgcaggtgaccgagcaggagacagagaaggaagtccgactcggtgtgattgtttgtggccggtgcggctgcagttttgttaaattgtaaaaggtttggaaattgaggtattgagtcctagagtttttttttataaataaatgaggggttgagactaaatggatattgactttttggtagagaaaagttagggtttacttcgaggtttcaatcctagttcgtgagttgagagaggagtaccttaggtgcactttgtaaacatatattgatgcaataaagttgatatacttttaagtgtttcgtcgatacgtgtttttctggatcccaacggtttgaccggaggcgattcattggtctaaccggcgggcggtcacatcggcggctcaaccagcggcagtggcagggaggcggttcaaccagcgaccaggcggtggttagaccggcggcgtgcgagcggtccgaccagcagcgatagaactacatcaagttctccattgatttgagggtaacttttatttccgctaaaagtttttgggtttttggttttatcaactattcacccttctctagtaggcttggttactcgtgttcgatcctacactccgtactctctcgagtgcgttctggtttcagctgcatcgtctgcgtagacatgccggactccggttttctcgagttcaaactagattatgcggcggccaacaagaactgtgccatcggcgacatcgtccgctctgatgtctttcctgccggaggacacgcatggaggataaggtgctacccgagtggtatagtaaagaagataacggtgagtacctctcgctcttcctcgagctggtccgcgaatccacttccaacaatgtcagggccatttttgacgccttcttggtggaaaaagacgacgagccatcttccacccacgcagacaggggcgtgcatgttcacccaaccaatggctataccgcatggggatggccacagttcgtgaagcgaagcgatctcgagtcgtcgtcgtcgtcgtacgtggtggatggcaaggtcagaatcatgtgtgtggtcatcgtcatacgagacaacaccgtgcccgtgccaccgtctgacattggtgcccatctcggtggcctgctggaccgcggggaagggacggatgtctccttcctcgtcgacggcgagacgttcccggctcaccgtgccgtgctcgccgcccgctcgccggtgttccgtgccgagctccttggttccatggcggagtccaagatgtcctccatcactttacacgacatcgagcctttgacgttcagagctctacttcggttcatctacaccgacaagttgcctgccgacgacggcggtgatcagctcaagatggcagcaatggcgaccgatgagctattccagaaattgcttgcagctgctgataggtatgatttgagcaggttaaagttgatgtgtgcgcagaagctatgggaggcagtgtcagtggacacggttgcgacgacattgatccacgctgagatgcatggttgcccagagctgaagagtagctgtcttgacttcttcgtgcaggacaagaacttcaaggagaccgtgctaactgagggctatgtgcaattggtgcagcgttttccctcgattaaggatgagatcagaggtttgctgagagctaaatcaatgtaatggagtgatattttgtctggccgttcaaatttgcctttttcaggacctgtactgtcaggctctagttttctcattttatttctactcaaattaatagtccattcctcgatatccacattgatggcaatcgacatgtctctttgtgatcaaagtttggagtttgtatgaattaagaatatcattactttttaccagaaatactcaaagttcattacatttaaataatttatcaaacaaagaaaataatatttttatatgaggaattttacagtccttgagaaagtactttgaggtacctaaattttacattaaaatttttggtaccttgagatacttagtacctagaggtaccaaataaaaacaaaatgtggggtccacatgttggtcaaacaaaaggaaaaaaatagtgggacccacatgttaatgggtcccaccctcctctctatctccaccacgtccttctcccttctccctcccggccatcttttaatcctcgagctccctcgccgcctgacaaggtcgcaccgaaaggaagaagggcggaggctgcctgctagcggggagaagggcgaggcgcggcaaccatcgggttgggaagctggcgagcatgcgcggagagagggaggaggcggggaggccgatgaatgggacggggaggccggcgagggggcgaggaggccgacgagtgggatggggaggccggcgagcatgcgaggagagggagaaggcggggaaaagggcggagggtgatagccatcgggtggggaggccgatgaacgggacggggaggtcggcgtgcgcgcgaggagagggagaaggcggggaaaagggtggagggcgacagccatcgttgcacggagggggaggaggcggggaggccctcagcgcgtcgatcctggtggcctcaactccccgcgtcttcacccgcgacgccgccggtagtctccatcctgacaacagcgacgctgccggtgtccatcctactgcttctgccacacccttggtgagcacccatgcacacaacctcttcaaaattgctaattagcgcgtatgcgccatcagactaactcgtgcacgtttctggcccatactcgtacgtggcccttatttttttggaagtttttttagcccttcttttttgttttcgtcttttttagggagtcggactttaatttgttttttgcctttttatttattttattgggaaaactattgacgttggacgacagaaacactacgaattttttaaggaggtaaaagggtaaagataaagatctactaatcaaaatttataaaatttttacataactatgtaaacaacatacatatacctaggtgccgtagaaaatactatcccctgggagactttctactatgcttggcatacattagagccattgattgctcttaatctaacgaactaagggtgtgtttagttccacgccaaaattggaagtttgactaaaattgaaagtttgaagaaaaaaaatagaagtttatgtgagtaggaaagttttgatgtgatggaaaagttggaagtttgaagaaaaagttaggaactaaacccagcctaagataattgtctcttatcatcactttgaatcatcgtatagttaaggaccaatcagtacatattctagggtttgttaactatttcttcgttgttatgatcaccttatagtagcgcatgattttactggggtatttaaaatcatttcattcggagtttgaagaaaattaagaagcgagcttgggttaggactgagtgatttacttccatcctagttaccgatgatggtgaaggaagatggattatatcgatgaagtgattgtgtattgccaatgggctagactatgatgctagtctttgattaacaaaaaaagataatgggtgctagaaagctatgtgtagctttggtctttgggctgctggcagcagacgtgatggtgtgagccttgctttgcttttctacattgcatggctgatctatcctctaatagaacaagcatattgaaggggtcgtttgttttgatgttggtgcccaaaagctttgaatctgaccacgcaagggttcgtggccagcaacaaccgaaaggtgtgtttgctatcaggatcagcaatcatccccgagaaggctaaatggctgtcgaatgatttttaatagctaaatcattcatgttttaatatattcagaactgttgttttattgtagtaaaatgtttcatgaggtgatttgattatgattcatatttttaaaagattaaaatatttttgatttacttggtgaaacaacgcctaattggcttcaaaatctacatgatggaagcctaaaaaaatcatgtgaatcccatatagactctttctcgatgtactcggatttgttttacgtttcaatatattcggaaccgttgtttcatacgttgtagtaaaatatatcatagggtgatttgattttgtacagctttttaaaagattgaaacattttcgatctacttggtgaaacactgcatgatggaagtctaaaaaatcatgcaaatcccacatagacagtcccattacttaattacttaattaggttcgagtgatcaacaagtttggaggttttaacttgcaggcattttgccttaatttacttgcttgagcattatccggtacaagctaagggcttgtttagttggcaaaaattttgcccctgcatgtcacatccaaggccggtcctgacatttgagaggccctaggagaactcgacactatgggcccttaaggcattaaggctaaatattttttacttctaatacatatactctataaagcacatatactatatagtgacacaaataaacatttctaacatggtaaatagtaaatcaaatagtttgcaagttgcaatacaacaatttattatcgataaataatatcgatagtataattgacaactaaaaaacactatagaaacaaagtagtatgaatacattaataggagaccacaaacatcctatatcccttataaaaaagagcttcttcacgtatttcttgaagcgaaatcatttcttttgtgaaccgattaattgatctccccgttttcttttgtttcttttctgagcacctgacaaatgtttttttggtaacattgtaacacctgaaatagtaaatatatatattgtaaagtaaattatacagcaataaccatgaaaattatagcctaactaacctaatttttcgagtggaaaaatcatacaatgatgccaagcaagaaacttcggtttgttgtttgcctaattaacctaagtacctaactaacctcagtttgccaagggcttatggccggcaacaccgcaacaggagactgccagactggagacggggagaggcgtgtgaggctcagagaggcttgggcgttcaggcgttggcgattagaggatagaggcggccctggcgtgccggtggccagccggccactcggccaggcgcccggcgacctggcgccatcgacgcggagagccggagaggagacacgtcgcggtcgcggagttagggagtcactcgtggaagcggaatcgtgattcgtgaggagaaaaacagaaaacgaagcgatctagcgattagcgaagtggcgtcgcggccttctgcatccctccctcctggcttgcgcgtgggctgatggctgggctgggctgctgggggaggggggttgggggttggtgatgggcccccagccagcctaggcccagggccgaccctcacatcggatatatgaacacatatttgaagtattagacgtagtctataactacattgtcaaatcatgccgcaattaggcttaaaagatttgtctcgcaatttcctggcaaactgtataattgtttttttttctacatttaatactctatgcatgtgtctaaacattctatgtgacaacgtgaaaaattttgtttggtaactaaacaggctctaaaacgagagagcactgttgtaatgttgtactactccgtccaaaaaaaaaaggcaaactctagctacgaatttggacacgcatgtccaggttcgtagctagaattggactttttttttttgacggaggggtacttcccagtatggcagagcccaagctttgccactgacagcatccatcagatggtttcctatcataaatggggttgtcaacacacatgcatgggtcaccattaaatgcaatatagttacatcataaatatatatatatatatagacacacactagaaaagatacccgtgcgttgcaacgggtgaatactattttaatcttattattgttatacggtttggctagggtaaaatttactgtgggaattcgcttagatattttttttctagaaaatcatgtgctgcaattaggagtttgacattcatctcaagttaacatgcaagtatttttaatgagatttcttatacgactccttttgtatttctaaaagtaaacgaacttaaaatccgactcaacatggatatgtatttccaaaagcaaacgaatttaaaaaccggctcaaacatgaatgacataccaaaataccagcaaaaacatcttcaatttttataatagtagagatagagataaaaacttaaggtgaacaaaatatggtaccaccaaatatcttactattactccagtatttcagaatcggatattggatatacgtcatatgatacctgagccagggggattttggttttgaatcacttgggcgtttccaggactctgttgagtctttgtctccaaagagagcatttttagagacaacttccgcaagtaatcagactggtaatgcaaaagaatacaatggtaagatttggctttgtaataaataacttgccaccctaaatcctggtggttagcacaattgaaacatatgcttcgtttttttatactatgatttaaattatacaaattcttatctatacagcaagctactttggcatgaataagcctgatgaagtatgaacaggagaacaattggaatatggagattatgaaaccctatacccagccaaggaagctcctacaaaaatgtttaccaaaatgaagtactaacacaaaaggaaggactggagtaaaccattgtttgatgtttcatctcggataaagggaatattttacaggtgatttatacaagcatgaacagatgaaatgatgggcttacagaactcaaggtacaactcctgtacttttaacatggccaatgagagaaaccagtctcatggtaaaaatattgtttagttctataattcattattactaatttactattgagatatgttattaatgaaaaatgatgtggggacatcaacacctctagcataggactgaatcagtcttagtccccgtattaaggcgcaaaggagattttctaccgataaaatggaaggaaaaagtttcagcagccttggataatctggtggaggtgtgaaatattaccatcggttcaaaaaaaaagtggatacttcatggtgaaactctaacaaacttcaaaatcaacagacatatttgcaaacatttgaagatcgatttcttctactaagatcccaaatgccatgcttgagccccacaactgaaagattggatcaaccggaggaagttagcaagaggctaagtgtacccggctggtggctccagtatagattttctcttcaaatcgcactgctaacttttgaagttcattcagcccctcaggccctgatactggtagatgcttcttcagagtctccagtctgtacatagattgcaacaagcaagtaaatgacaaatatatcccatgcagaaaaaaaaagagagagatatattgcttttgagatgttttgtgcaaaaaaaaaattgtcacctaaggcataatgtgtcggtctaccatttaagatgttggacaaatgagtgggaaaatatgtaatgcaaaccacatatatagtggaaacttggaaactaccgttggattgggaaatggac

SEQ ID NO: 79501 - DNA, 8526 bp, Oryza sativa
cagaggaaggggtggccacgtcaccctcgggcccgacccccccgagggggtcaggccacgtgggtgaacgcggctgcccaagcctctagtcacgatattcctggtcccatgtcaccgacacatggtgtcaaagcaagattgatcccgtctgccccctccctctccctctctccttccgctgcatccatggcttctccacagcccatcgatggcgtcgctcctatcacccctccctccgccccaagacgctattgccaacctcgtcacggcgcttgctactgcccatgccgcaacagccactggcaagaccgatgatcttcccgccaccctcactcaagcacaggcggcccaagacgccatcacgctgtcagacaacacaatcaccacgacaccttctccttctaccgtggttgtccagccgggcgtgcgcgatgtggtgcttgccaccacggcaccaacgcctcgtgcccaagacgcagtgccaaccaacgtgacaccagcactacctccgcctcagcgttccaagcgtcaagacgcatgtgtctgttgtcctcgacatgaaaagctcttataccatgcaagcgtattgagagagaaaaggaatggctcaacttatgcacaattggtgcgggctaatttcaattaaatagacccaactgatccccattatctataaactttcacggttattcactagctaggtctatttaattgaaattagtttgcaccaattgtgcgcgagctgagccatttctcttctctctcaggtcctctttgtttaggcttaagcttattgacttaggttattggcttatatgatttataagtgggatgatttaatgtcctaaatttattggtggttcatacatatacctcacataagtaaaaaagcttctccaacctagcttttgagttaatagtgttagagtggcttatggctttaaaaaagccaaacgaaaaaattgtttgtttgtttaggcttaaacttttcgacttataaattggtttataagcctaaacaaagagggtctcaacatgcttgcaaaaaacatccaaattacttttttttttgcctatcggttggacaccacttcatctgaataggaaatggagatggtttagctttcttttttctactagtgggtctcacgatagatttacacactacaagcatacttcccctgtcctaaaaattaaacataaaactggatgtgacttaatctagtacaatgaatctagattaagtcacatctaattctaagtttgtttttatgggacggatggagtactcaattaattgaaccatgtaccctcggtcccatgtttcgctgaatggttagattgtactctagagatgatataaggagttcagaaaaaaagagtggattctaaactcgcgagtaccgtgaagtgtgaaaaaaagagtggattctaaactcgcgagtaccataaagtgttgttactttcctgtaccgacttgagtaccgtaaaaattatctaaaatcaacgacctaactacctaggtggttaacattgtccacacctttccgtggttgggattgctacatattgtgatcttttagatgttgactaccactgagtggaagtagcgagcatccaccaaaaatacaacttgtgtgttgcaggctacacaaacctgcacgaaggatgcaaagatcaacatggcaacttggcaaggcacacggtttttcatttgagaaaaccctgcatttttgtttgcacattgccacaacttggctttctgtttttgagagctttcgtcattggagggaacaggatctgtgttattgttgttgtgaacagagcccctggtcatgtctttaacttcaaaggtcacctttttagggtgcaactattttatgaacataaaagactcatataaggagacatgtgttacacgtacgtgagcacatcaagctgtaattataagagtgtccttctggagatgtaaatatatccgtcttgaaattgcaagggcaaacttctacttttatagcgagtcatataacagacaattctctataaaattataatgttagatatcttccatttactataacaaaatcaagaacagatggtatcactttgttgttaatttttcaccaacggtcacgttaacccatttagtactgcccaaatctcataaaaacgcaaaggggtttacaactttgaattttataaagcacacattgttttttttttcatattatgcagtcccacatatttggccctgggctgtgccactgtggctgtaaagttctgttctgtttttcctagccagaattttggcctatatggttcttctttattcaattccatggcaatcttctgtctgttttgggattttttcccccctcttttttgcagttccaatttttctgccgtgtccggtaggatttagggtacaaggtcctgtaattttgtactacaatatccctttttcaatgcaaattactggtggaggaagtacagacatatagggcctctgtgtcagctggttactggtggagaggaacgcatcttccaaccagacatatactacctctgttttttaatagaagacaccgttaatttttttttacatgtttgaccattcgtcttattcaaaaaaatttacgtaattataatttattttgttatgagttgttttatcactcatagtactttaagtgtgatttatatcttatacatttgcataatttttttaataagacgaatggtcaaacacgtgagaaaaagtcaacggtgttatctattaaaaaatggagggagtatgatacttagatcatttgtacttgttggaggcattttttttccgcttgacatctcctccttttatacatatcacctaaaaagctatttagaatgagaaaatacaatggtaagatatatcaatattttacatgtatattattcacaaacatgaaaatggacaccgttaattttttttcacatgtttgaccattcgtcttattcaaaaaatttatgtaattataatttattttgttatgagttgttttatcactcatagtattttaagtgtgatttatatcttatacatttgcataattttttaataagacgaatggtcaaacatgtgagaaaaagtcaacggcgtcatctattaaaaaatggagggagtatgatacttagatcatttgtacttgttggaggcatttttttccgcttgacatctcctccttttatacatatcacctaaaaagctatttagaatgagaaaatacaatggtaagatatatcaatattttacatgtatattattcacaaacatgaaaatgaaagtggtttcatcactcgagtgggcatacactcaattcgtgcatgccaactaaaaacttatatgagtagaaataaaaataacaaatctcatccatagatgatacacacttttgatcatcatatttgtgtctgttttttttttagaatttgaacttgtatgtttgtaaaattgtatgtttgtaaaatgatatatatcatattgatatatcttactttttaaaaaaattttcatggtagctttttagttgaatgcacaaaacaagtgtatgtccacttaggtgaaaaataagtttcccagtaaaaaaaatgatatactccctccgtttctaaatatttgacgctgttgacttttttaaacatgtttgatcattcgtcttattcgaaaaatttaagtattattaattcttttcctataatttgattcattgaacaatatacttttatatatacatatagtttatatgtttcataaaagtttttgaattagacgaatggtcaaacatgtgctaaaaagtcaacagtgtaaaatatttagaaacggagggggtatatacaagttatctgttatttttatttatacttatataagatgaatttgaatttatatatttatattgtgatatatcatatattagtatatcttgtgacttttttaaattttataagtgaaatgaaaatcgatgggagttcctctcgaggaggaaaaagactttgcgatagtacgtacaaatagtgaatcaatgggggagaacatcttattctgacagattacagcagttgtaaccagtacattgctgtgcgttaacagttgaccgatcagtgagtctctgttacagcaccaagtactctcccggccgtgccatgctaaacatgtcttgaataagaatactcaaaacaatccaagccacaaacatgacacacacaacacaggtgcagtcactgttggatcaagaattgcccgcatttttcttcaagatcgagtttgaaggacgagacgagagcaccaccacatattctccgtgagggtaggcaggttatagagtccgactcgtgtccgaaattggtcaaacttgcatgacgctctcatcgctctcgtacaccatctccactctggcgttggcctcgcccttgctgctcccatcgacgtaaaccacgtcgatgctgtgcagtatcgggatcatgacgacggagcagaggcaagccaagaccgggccgaagatccacaggagaagcggcacgccggcgtagaacagccggtttccgacgaggttgaggaggaatcctctctcgagcacgtcggcgacgtagtccttggtcaccggcagcccggcgatgtcggcggcgaaggaggaggaggaagagagggtgttgaggaggaaggtggcctggttgagggtgcagatggcggtggtgtgggagaggaaggagaggaggaaggcgaggaggagggtgacgtacttgagcgccatcatgtactcgccgtgggcgccgaacacggcgtcgctgagcggcttcttgacggtgtacgtgctgctgaggatggcggcgacgccggtgcagaagaggatggccgtcgtcgccatcagcgtcgaccccattatcacgttcctcatcgactgcaccaccagcaccgccttcttctcgttgtcctgcgtttccaaaatccattaatccaatcgatttccgggccatgatcgaacaccatgatcgacgtggttggtaccttcatcatgcccaagacccagaggcggcgggtggcggtgttaatgccgacggtggaggagagcgggcggcggcggacgacgtgccacagccagacgtggtagacgatcgggaacacgatccccgccgggatcagcacgaggtccaagtagctgtccttccacgccatggacgacctctccaacctgctctctcttcttcttcttccttgccggccgctcgatcgccggagtgcgtcgtcggagaagctagagaggaggaggtggtcggcgtctgcactgtcttaattttctctcccatgtggagattatatagtgatgagctagcaagctagagcaaaaggtaggagatgacaaaatgtgcaccacactgcacatacggttggttggttggttggtggaaacatattcaaattccacgaaggcgagacgagaaatagggaaaaagcaattgtgacctaaaaaaatggtcaagaaaaaactgaaaaagaggggtcagctgatgagatgaccaaacctcatcttgccgcccagttgtgacgaaggagatagctccctagtgctgttataatattttagttcaatttcccctttttccttttctgttcttggttttctttattcagaaaagctttttactggtaaaggaaaagatttcgagtctatctggatttgtttagtgtgatactacctccatttttaatatatgacgccgttgactttttatcgatgtttgatcattcgttttattcgattttttttgaaaaatatgaaatatttaagtcattcttaaaaaatatttgatataaataaagtcacaataaaataaatgataattacataaacttttgaataaggcgaatgttcaaacgtatcccaaaaagtaaacgtcgtcatatataaaaaaaacggagggagtattagtgcttttggtctaatataaatctatcacgcccaaaaaataaaataaaacaagatcactttacaagtcagcctttttgcttgaaatgtattgtaaggtgcatgcaaatcttaattaattaatcttgtgttaactgataaggtgttaactgttaagtgccctggaaagggaaaattttgccttttggccaacattctcctacccctttaattgtaaattaagctgcaggatatacatgtgcggatcatgggttcatacgtgcaggctgaggcagcagaaatgtccattcggttccccaccgagtgttgtgaagaatgtttcaagagctagctagcgagtgacaggtaaactgtatgagttaattaattgccatgctgatcgatgccaccacaatgggcaaaaactcataacaatctgttgttacctattcgggaaaacatagttcggtgtggtagtgaaatcgtagatgcatgattacactcatcaatgttcaaatctcaatatccataaattccgctgtgtgtatttctagttagtctagggatcaggaattatatatgtttccattgtaaaaatcactcgcatttagtgttgtcccactgtaccataatactctctccatctatttttgatagacatattttcaaatctgaaaaatttatttttgataggcatatttcaatccaacaacttatcatcttaatggttttcttgaatttaatgcgtgactctccattcttccacacaagattagctgcatggacatcgagaaatataaatattaataaatcgcctgtttacgaggaatgactagtagcatgtttaaatggatgataattagaatcacttatccttggtctgtgtgccatgatgaaatatgactattaaaaatagataaagggagtattatttagatattaaaaaagtttagatatgaaataaagtatacatgtaatttattatcgatttttaaattacatttaattagaaagatttcaaaaagtgatcgacatgcatagaataggacaatacatattaccatatcgaccctcggccttacaaagtagtattctttatatgtaacacatatgcattcatatcagattagtggaatgctctcgttacaatatactcgtggttagctcaaaattaaacttaccaacatcaaataaaggggtacgtgtagtatataatatattcaccgagcaggctagcaattcttagtggggttgaattgtaaacgccttttttcattgtaaaaagaaaaaattctatatagtgggttgtatgagctggataaacccctcaacaaaagcgagctcgctgtctacctgaaaatgccattagccatttagccacgcctctgtgtatgtcggccggccggccatatgttgggttagtcttcgtcacagcgcacgatagaaactagctagtgtacgtagtattcttctttgccatcgtcttcgtcttctcctcctgatcttaacctttttttccctctctatctcctgtcccaatataatttgcattgcatctcctcgttggattggcacgagggaggcagtggccgccgccgccggatgcacgcacaaaaataatggagaaatggtggtagctagcgtggtagaataacggccggcagtgcgtggaagttactcgtactctcttcgtttcttttttatttgacacgttgaccaatttgattttttaccttttacaccaataaaaaaattttgaatcacgatttttattacgagatgctgtgatgaatgcaacagtagtatgattatatttagcatgatatctttctcgatgttcataactatatatattttaaaaaagacgagcagtgaaagtttaatttatatatagtatccggtgtcaaataaaatggaacatatgaagtactcctatatatattgttagtcgcgtgcatgggttgcattttgattgttggtgtgttgcactcatttgatgagtgtcaaagttactcagaaagtgttatatatctagaagataagaatggcatatgcatggaatttttttacacggagagtttccatatcttcggtatataccatatatatacttgatcttttaggtcagggcagattgacatgttttagtggacatatgtcaacctagcacttcctggaaagatcaatctgttttggagtgcagcatgaatatatgcattttctatcacaggcttctaagatatatatggttatagtgaaagatgcaacaaagttctcctgcgttgatctgggaagaagcaccggtagtgtgatggtgaattcataagtgcaggagcctccaccaaggttgaaatacttgtgcccataaatattgcattgacatgagtatgggaatttagtgaagaaaaggaatttgtcactggtttccaaatttaactttttaagagtgtgttatgtgatatactcatgggtgtgtgtggatatatactcatgggtgtgtgtgcgcatgtggcgtgtgcgtatatatgtatttttggtatagttgaaaacaaaaaaggtgattaattaggatatgtgaaaacta

SEQ ID NO: 79502 - DNA, 20994 bp, Oryza sativa
  unsure (1)..(20994): unsure at all n locations
tatgatttggttaaacttttaaaaccgtgacaatccgtaattaattacttgagaattattaatttaaaacaaaaataatggtatgagctagatttttctttaaaataccatcgtagtaccataaagtttgttactagacttataaacttaatctgatataaaaacaacaacaaaatgagtagaagaggcttctaaatcttacataaagttgataattaaaagttttaattaaatcttattctaattaatgtcaaatatttataaccaggaagtactttagcattctagcaacgtactatgtacatatatatgatactttatttttatagaaaacaatacagacgtcgcttatatacacatgcgcgactctatgaacacgcatgcggtacccatgtcaagttgaggacttgaatccgggtggacagatttccccgtaagataccttaccagttaaggtacgctcagttcatttctacatttaattttaatcatgcatataaaaaataaatcattttaaatgacaaatctattggagtcactttttcctaaaaatatcttttctatgtattagctatagttaatattttgaaagtcatcgattacgtatttacccgccgtctactacagctagtacctataagtttgagaggctgagggagtagtaccatccaaccactgttgccttatcaacgtatatctcatccaataaaactgaggctgtgccggccgccacggccgtatacctgctacttgacatatacccatgagtttaatttgagtttaatttggcctcactttatcgtctgatcaaattctgacctcactcgtcttccttaattagatggagtttagttatgtttgagattgataagatgaagataaaattaaagcactcaaaatgagaaagatgttagtgcataacttattaacttttaattattacagacttaaaaaaataggtttatttgatattttaaagcaacttatatatagaagttttttacacagggacaccgtttaacgatttggatagcgtgctaatgaaaatcgaggaaaaaaacggtcataatgaaaaaaagaataccactgtgcatacttccatgcaagaaatgatcagattatgacctcgtttatgttgattacttagatcaggttttgtgtacttgtacatacatccatatgcaaatcaagaaatgttgccgaccttggtccgtacaccgtatttggatcaacgatcgagtactatatgtgtaagactaaggacttcaagtgattgaccatgcaattaatcgatgtatggcctaaactttaaaagatgttgaccactggtactttatacagttaattaacagaaatggtactctatgaagcttgtagcctgtttgtacaaaaccgtaccaccagattgtgcggctctcatgcattagagaatatctaatgaaaatgttgtgggacggtgcacatatgaagcacatgcattaagtttgtgtctagttaattatgcctgagttaggacatttacattattcaacctttcattcgatagagaaaatattttgttcgcatggaaaatgagactatgagaggggtggctgccatcaaggacaagaaaagcgataaaaagttgtaaagatttcaataaacaagccacttagtcacgcgatgcgtgatttttaattccgtataagaacttgtatacggtctattagtttacagaaggttttagcacgagttaatttatttacaaagtatatattggtctagctaactatagatttagttatagaaatcactataaccccctagtttttgttttcttcgttatctttgccctctttttgtaccatgtgtctaagagggggcactagaaacctccagaaattcctatatgtttatcccattgttatttttttaatgcatatgtaacctttttgatcccatggctattatttatctaaattctttattcaatggttgatatatgtttttttacgatgtggcgtattctcgtgtaagaaagattgctgctttcactatataagataatatacatatgaaaattagacaattcctattccctaatgtactttgtccatcagggttgcccaagggcccagggatttcaagttccatagggaaaaccaaaattagtagttcaaaatataacacgtggtgagatggagttccgccaatagttttcaagattctagaaattcatataatccacttgaacaatatgtcgacgatgcatttaagaagatacttcctccgtttcacaatgtaagactttctagcattgctcacattcatttagatgctaatgaatctagacatacgtatgtgtttagattcattaacatctatatgtatgtgggtaatgctagaaagtcttacattgtgaaacggagggagtagtgaagaagcaagtgaagcaggggcaggtagggcgagagatagccagggctgcaatcgtactcctgagcttaaatacgcattgaaatttgcacttcaaaactaaaaaaaaaggataaaagcaaacttattgagcactaggcttggaatattctagatctgccccttggttcatgaattattaatggagactgtagtttgcaaaggccttgtgttattgggcctgttcggctgcactcatacggctgtggtgcagccggccagaacagtactttatgtaagtagttgtagcagtaacactgtggtacagctgctgcaccttgcagccgaacatgcccattagcggcacatagaaccttatatttgtgtggcgttgtagtttaggccaacgcactatcatggtttaagggagtgtttggctaatgggataggaaaatgatttcccacccactaaaagacatctttaaattctaacaattcattatccctcttccatttaatcctaactcttcatttatttcccaatcctaattccatgccacatttttcattatccaaacacaccctaaaaggtcttttagtggcgatggaattgatccatattccaacaatattggatatggatatcactgaagttgtctaagccccttaagttgtccattgagactttgagagatgcctgggaattgaagcaaggattgctgaagcaaaagaggcttaagagcttgcacagatgagattgtgtgttcccgtaggaatccggcctagactattgtatcagagatataatcgctatttttataattataattaataaagctctttctttttaccttaaaaagtaaaagatccgtacatacgatccatggtgatggtgtggtgttggcggaataaaagcttacggtacgatgtaggcgctcatatccaatcataaaatttcgagttgatatttttttaagaaccaagtataaaagtatcaatgaagtgatatacggatctcgagatggactaaatagattttagaaacttgtgtgtcatgtatatggcttggaaatttcattgtatatttagcctattagcgtttaacaaatatctaaaagtgctaaataaatacttcctccgtttaaggtgataagacgttttgactaagtttatagataaatatagtaattaatatttataatatcaaattagttttattaaatcaatagttgaatatattttcacaaaaaatttgtcttgagttgaaaatattatttttttctataaacttagttataattaaaacaatttgactttgactaaagtcaaaatgttttttaacttgaaaaggatgtagtaactttcgtaaccctttgctagaaaaattttgtacacaggagctgtacactgtgccgttacttttgcatgggcatgggccgttacttgtgcctgtgccgctttacagccaagcccattagcaaggctcaaagatgggctagtttttctcggcccaagccgtctgttgaacagcgtggagaaggccacacggcccacgtgcatacgcaggccgcgcactggatttcaagatgggctgcgcgaggtggacggcccagattgctacggccttctacggcgtcacgttttttcgtggtgcggctggtgcccgtgcttcgcgtacacgacagtgtacacgctgcactgcactccaaagaaatccgccgaaagtgcagttatacgtagcgacaatctgcaatacgtaccaacagccgaaagcatatatggacaagcagccacgcaagccatcagcacaacccacacgaagagcaggttttttttttcgaatcaagccatacggtagtgcgacgtttctattgatatagcaggaaaaaaaatacaaatctatagcattgagagactagttaggagaagaaaaagacggccacaccacatgcctacatctgatcctgctactgaaaacaaaacaagcacacgacacctagaaggaatggttcacactaagagaagttttaacaaaggagagaggtggttgttggaatcaacatgtaattccaatagaaaaaagaacttgattagttgtagtaatccgtaagtaaacagaatcatatagataatggtacaagcctgacccagttgttgatattttttttaatctccctgtcttgcacgtgcggtatagatgctaatgtgatgtggcagcaccgacgtcacacctgtgacatctggccatatgtctacagctaatgctgtgttttgttcaatttttattaaaggcaaataaatatctatatctacggttgtgcctataccaattgaagttatgtcatatgaggcgttttcgtgctatctactgatgaaatttacctctcgtacatcagaaccgtgcaatatcattacttatgtcagtgtaacgggataaattggtagagtttttgagagtggaagcttcctgttttttcaaaatttggtaagatagcaataacaataatgagtttggtttgttgtcctattaaaatttggtaatgccaaaatttagtagggttaaaaataacaacaaagtaaatattccttagtttaaattgttttagttgaaggttaaacattaccaaaaattggtaggttaaaaatgttaataaaaaaagcaaagcccttagtttaaattgtttcagttgaatgttcaacattgctcacaaaatgttctcttaaatagtactttattattacaaagagcatctgaatctgtattaaaaaagtacaaaaaaaaacattctgaatctagaaagggaaaatatctagaagcgactgcacgcggcccccacgaaaagcccatgcacgtgggccccatcccgaaaaaagagcaacagcctcaccgcctacctgcatgtgcaagtggacggtgcgcggctgcgcgccgcaacgcgacgccccctntntnnnnnantnnnanaaccaacggncccacacgtcagctatacagtgggacccacccctccggccccacatgtcagcaagacagtgatacctcctcccccgcctcctcgcgcggcgcgcaacgcacacgcttccccttcatctcagtcgcgcggactcctcagtcctcacactccccacgaactcgaatccccaactataaataatccaccggaaaattcacaattcgatcgcctctctcgatcggagatttcgcaattttctccgccatggggagcctcccgcactgcctctccgcgcgcccgctggtcgtcgcggcggccccgggccggcctgggccggggccggggccgtggctgctcggcggggcgaggcggcggaatgcggcgttttcggcggggaacgcggggaggcgggtggggttgagaaggtcggtggcctcggcggtggaggtcggggtcggggagaatgagaagaagggtgtgtaggagtagaagaagaaggtgaagtcggtggtgatgccgaaaaggtacgcgctgggtggcgcgtgcagggtgctcgccggaatgcccgcgccgctcggggccaccgcgctcgacggcggggtcaatttcgccgtctactccgccggcgcatccgccgcgtcgctctgcctcttcacccccgacgatctcgaggcggtgagctcgcttcagaccaccacaacggtgtcacgcgttcctcgcgaagttctcctttcgttttcagtggctctgttttttttttaatccgatgattagttgaggtggttttgcattgtgtgggatggtgcaggatgaggtgactgaggaggttccgcttgatcctctgttcaatcggacggggaatgtgtggcacgtcttcatcgaaggcgagctgcacaacatgctgtacgggtacaggttcgatggtatgttcgcccctcactgcggccagtacttcgatgtctccaatgtcgtggtggatccttatgccaaggtgatgcattagcttcattttgccttcttggtgttcttctcctatgtttgtgattgtactagttttgggaggcgcttatctgcagtttttttctattactgtaggcagtgataagccgaggagagtatggtgtccccggtcctggtggcgattgctggcctcaaatggctggcatgatccctcttccgtacagtacggtatgccaacgaatcagtttccttttttttttaactcccacttgtttccatttatcctcttttgatctgatacccgactacccgaggcagtcattatccgattatctggttgctgaatgtacaactaagatttgcatctttttttctaatattgtaattttgataataataataataatatttgtttgcaagtggaaaagaacatgatttttttttttccgaaggaattccatttattcgttgctgctatgaagtggaattgcatttatgtgccttgtaaaaaaatgaattgcattaatttgttgttgttactgtctatgatattaaatctcacagtaaaatgtttgcatttgcagtttgattggcaaggtgacctacctctgagatatcctcagaaggatcttgtaatctatgagatgcatttacgtgggtttacaaagcacagttcaagcaatgtagaacatccagggacttacattggggctatatcaaagcttgactatctgaaggtgcattttactaattacctagttcggtcaagaagctattgggccacagagcaatttataagactgttacatattcattttttataagatcttcacgtacatctagattttgcatggcttttgctgaagatatcctattctacaacttaaccataatcaagtatttctaagaccttcccggcgaaaaaaagtatttctaagacctatgctgtactttgtgatagaacacttaaaatttggtctatgcattgacaaatttacttagtgtcccagcattttttttcttattttgttcatgagtggtccattaagtgaatagctgtaataatagcctgtttatatttttagttgtgtgtttattcttaatttaaatctggaataacccctctacaggagcttggagttaactgtgtagagttgatgccctgccatgaattcaatgagctggagtacttcagctgctcttccaagtatgcagacttacatccagaattgagctataagcagtgtttgaatggggcctaacgaatcttactctcgcaaaactgatttcccccttctaaactgtgcattggttaacatccagtcaactattttgcataaggtgtttgtgtagacatgatagatatgacctactgctaacgctaccatcttgacttttataagttgataaaataaactagtttttctttgtgagatgtaaacaataattaatgttggtcacatcaatatcgtattacatttgaataattgatagcccaaatctcccactcttataagaggttccacatgcatagattttgcatagttgcagcataacagccttttctttgtctagattcttgaatgtgatttttttttccatctctaaactcagtttacctttttcccttcatttgcatggaatgttgcagttacgcacttactttcttgtaacatgtgtactgtgtacatccatacatgtttttacattattatgatttttcatattttcatagaaattcaatcattttttatattatttcatataaactgctcactatcttaccaggatgaacttctggggatactccacgataaactttttttcaccaatgataagatattcatcaggtgggataagaaactgtggccgtgatgccataaatgaattcaaaacttttgttagagaggctcacaaacggggaattgaggtaaccaagttgatatagctaattcttgtttagtaattgctgctttctcaacatatttttttacgtggggatactctattaggtgatcatggatgttgtcttcaatcatacagccgagggtaatgagaaaggaccaatattatcatttagggggatagataatagcacatactatatgcttgcccctaaggtgcgttatattgctcattgtggaaacatttctttttttttcttcagagatgtatataatgcagttttattatgtaattctatctaagaatttgaagggtgtttgtgcctacagggagagttttacaattattctggttgtgggaataccttcaactgtaatcatcctgtggtccgtgaatttattgtagattgtttaaggtacagttataaatatatatatatactgcacagtaaaacagttattgatctcttctcactgcttatcattttgtcaagaacttcaattgcaagcctgtaagggttttattcttttaatctccagcaaattgcttttttctgttttcaaaacacatactgatgatgtttcagtgcttgagtatatgtacacttggatattcttctatattctaataaagcagggaaactatatcccatcatcttatcatttttttatgctcattaataataaataaatcaaagaactgccatgtttgttgtaatatgcttgaatctcctgttaggccatttttcatgatatctttggtgtgcttatttttgtttgctttattctaaacaaaatagctttgacattgcagatactgggtgacagaaatgcatgttgatggttttcgttttgatcttgcatccataatgaccagaggatgcaggtaaacggcagttcatttattttattttattttggccgtgttttgtctttccagaagagtcttatttttttcctgttacttttacaagtctttgggatccagttaatgtgtatggaagtccagtagaaggtgacatgactacgacagggacacctcttgctactccaccacttattgacatgatcagcaatgatccaattcttggagatgtcaaggttactactttttctgacttttgttgcgcatctacaatttctagtacattcataccagtaatgttaccattcatatttttggcaatgaatttatttttctacacaagtaattcttttgttctgatataaagaaaatatctacaccaaatatcataatagtatgtactacctctgtttcatattataagtcgttttgacttttttatatgtcaaatttctttaggtttgatcaaatttatagacaaaaaagtcaaaagggacttataatatcaaatggagggagtatgatataattagcacgttgttgtatccttgtgaaatcctcttattcgtatatccggttgcatttatagctcattgctgaagcatgggatgcgggaggcctctatcaagtaggtcaatttcctcactggaaaatttggtcagaatggaatggaaaggtaacaactgcatatcttgatctattcgattttctaaggaaacaaatgtttccttgcatacactaaatagaggttatatatgagacatgtctaatttaacataacattattttactaaacttcaaaggcaaacacataaattattctgcccataaatgtacacagaagataatacatgaactgaacggtgagctatttctcagggctactgctaacaatacataaatacgccttttgttctttagcagggcatgggttatgaaaaagtaagaaacaacagtatactaagcttatatttgagctagacactgaactttggagttataacatatgatctgcatccatctaaagttaaaccaacatctaacatagttcccactttatatgtgtaattgttgttttatcatagcactgacttatattatgtgcttgtttctccagtaccgggacattgttcgtcaattcattaaaggcacagatggatttgctggtggtttcgctgaatgtttgtgtggaagtccacatctataccaggtacatagtgaaatacctttagatggatcgggtacaatgcaaattggatggggtctttggaaatgccacacgatgaactggtgataatagtgcatgaagcttacagttataattctagatccacgcatagcctttaacacacgacttgcgagtaaagaaaatggtcttgttttcttttcattcattttttggggtgctcttgtgtctggtgaggcttctatttggcctaacctctgaaaaaataacctccatgccatttttattttcttttgtccatttctctttgtgaaaagaggttatgttagatactgatagccaattggactagtacatttctgacacttaaaaatacacagagaagtaccaatgcaaagtagcttcattctagtctatgtaatttgttttttacttcacatttcctttaggtttgcataagaatcaaagctgtcacttgtatttgccattacaaatattcctttattaatcaggcaggggggaggaaaccttggcacagtatcaactttgtgtgtgcgcatgatggatttacgctggctgatttggtgacatataacaagaagtacaactcttcaaatggtgaggataatagagatggagaaaatcataacctcagctggaactgtggggaggtaatactgcactataatgtttatgcatagttcttgttttacttctattcaaatgcccgataatcttacaatggctttactcgatagctaaaccattagtgtgatgaaggtttcccctaccaaatatcatggtctgtaaacttcctgtatttcttaaagatgaaaatgtgtgttgtattttgtaaatgagatgagttatgggacttatggatgaaggttactactggtggtaggtaaaccatgagtccagtcactaggatttgatgctggtgggaaaaccatgtgagctcagtgactaggatttgcgctccgtttgcctcaccagaggcgcagacctgatatacattagcaatttcaaagtaattagttttctttcaatttgcagttgagaatcttatatagaatgcgcatttacaatttcatgtcaacaatgtaggaaggagaatttgcaggtttgtcggtcaaaagattgaggaagaggcaaatgcgcaatttctttgtttctctcatggtttctcaagtaagatttattatctgacctctttaattatcttagaccgtttgccaaaatgtaggatgacgttaagatgctagttctgtacttgccactttcattagtcacatcttctgcagtatttaacattttaaactattactttctcttaattctttagggtgttccgatgttctacatgggcgatgaatatggccatacaaaaggaggcaacaacaacacatactgccatgaccattatgtcagtccaatgtgatggtgtatttttcgaatcagctgtcattaaacccctcccttaatccatctttggttcttctataggtcaattatttccgctgggacaagaaagaagaatcctctgacttgcaacggttctgctctcttatgaccaaattccgcaagtaactactctggaacacttccacatgctaaacaagtgagaccgtctccatagcctacatcgacctcatgctttgttttcttttacattgcagacaatgcgagtcccttggcctcgcagacttcccaacagctcaacggttgcattggcatggccatcagcctgggaaacctgactggtctgagacaagccgtttcgtggccttctccacggtacctacataatgctctcacacaacacagccatttcccccaaaaaataaaagcaccgtctttttcacaacaatcaagttgaagctagatgataatttcttttatccatgtctatcacagaaagatgaaacgaaaggcgagatctacgtggccttcaacgccagccatttgccggcggttgttggactcccagagcgcccaggctaccgctgggagccgctggtggacacaggcaagccagcgccttatgacttcctcaccgacgacctgcctgatcgtgctcacgccgtccacctgttctctcatttcctcaactccaatctctaccccatgctcagctactcctccatcatccttgaattgcagcctgatgattgaaagaacaaagtatagcatagtatagcagagtaaaaaacatatgtttatagccctttttgcgtatatgttgaagttgtgcggtccttcaattttgatggatggtgtaatctgtatattcatgcatgtcctgagcggccagataagctcctccgggacgagctagcagaaaaagcattctctggcaagaacggattgatgtatatactagtgcagggtatgctgacatgttgagtggacgaaagatgatcctcatttcactcaacaagaaaggcggaacatcagggtatgcctgatgtttggaagagcaaggtacaataaacagcatatgttgctatgcagaatgcacttgtgtacatagtcattttgcttcaatgcgcagtacaatcagattcagagctgtgcggttgttctatattcatcggtgcagtctatccactcaactcaagcatgctcatcaaaaggatcagatcttcatccagattttccagctcgatcagtttcacttctgttcatgagtcattgctctctggataagtgatgcatttgtagaccctgcatcttgggcaaaggatgtaccctgcctgcaacagcagcaccagttcaaagtgttggaacgaagcagaaaaaggtgatggcaatgtgcaaaattgaagagaggagcgaaactcacggctttgcaggtcgggcagcggcggtagatccggctgctctccgacttgacgttgttcttcttccccttgcagaagtcgcagagcagccaccctgcgccgttgcaaccttcgcactctacaccttcttccttaggacaagaagaatcatcacagccaaggtagttcaacagcatcagattcgaatggtttttgcatcgaaaccacacacagtcagattctcagcatcagaagagagggcgaaggctaccaatggtgttgatctagggtatgtttggatccttcgctccgctagcctggctcagcaaggctaaaacatctcattgccagcttgctagccttgccgtacccctgtgtttggttggtttgcttccgagggcaaggaatagtggctagctgtttgaatccttcaaaaattattgctttgcccaagtttattttgcttcctttttttgtccaaaaattaaaaggcactggtcatgttaataatcttgcattgttttttttcccatagccattcttttgctagtagtttattactaccttaaagttatatggcttgtttggtttagtaccctaccaatatattggtagtgccaaactctacgcaagttttggcactaccaatattttggtagggtagaattgtaaatgagtgtctttagatcaatgtcaattgagagccaaattttgaattgtggtgaagaacattctagaattgtgccaaattgaatatagtcattacaaaatatttggcttcaaaccaaatcatcacatttactatttaaactaccaaaaaattggtatggcaacattttgatatcaaaccaaaatggcccataatattttaggattcacaaatgagaaatcaagagaattccttaatcaagtaccatcataataaatgatcttggcaacgcaaaggctgcatctagcacaaagcaaacgatctcaaagacgctcttttctaactctaccaacttcctgacagagcgattgaacaagacagcacaccatgtatctcagaaagaagaggttaggagctgacgataaagaagaaatcaaatctaggagtctacgcggatgagatcgcctccggattgagctgctgctaatgagttcgtctcctgatcggggagagaatatcagcgattccggagaagtccgcgtcgcccgcagacaatattttcacgcgagtgaagtttgacgtcgaaagcgagccaaattggctctccctagccggcaaggtttttctcgccctgtacaactaactcgcccttaaaagccaagctattttactagttccaaacggatagccttgccaggcaaggctagggtgacccttgcccaggatccaaacgtgcccctagtgatctgaaccgcctatggtagatcggacggcggagggaggtcaaggttaggacagttacaaatggtaagcggttggacttcctagagagaactaccacagggcaccactgctgtctcgctgacccgtgggcccgtcctgtcggtgtgaggattgcacggttgcaccacacactgctccggcaaagcgccggcgagctcagggagcatgcaagataactaacctctgtctcggcctcagcctccggcggcgccgccggctccaccgccgcggccgcggcgacctcccttggaacggacacgcagccgacgaccccgcccttccttctcgtccgccgcgacggcaccggcagagccgccggcgacaaggtacaccgccaccggcccacccacctgtctagcccagccgcgccgcaccactgcgccgccgccgccgccgccgccattgttccgcctctttacacctcgcctctccctctccacctcttctctccctcctcgtgtggataaagccgcggggaaaacgaacggctcccgcgcctgacgccccgggcccacgcgagtccacgtcggatcgtacacgaccactcaccaccgaggctgacactggggcccacacagaatccaactcgagacatttttaactcacaagtcaacggctccagcgttgaacacttgaaccagatctcgccaccgcgtccatggcgtcgcatcgccgcctccgcctccttttgctcgcggcgacgctcgccgccgccgccgctgccgtagccggtgtggaagaagaagaggcgttctgcggagtggagtccatgccggacgcggccacgctgaggccggaccggctcacggtgctcctgagcggctactcggagcggcggctcccgctgctccgcgccatcgccggagcgtacgccgcccacccgctcgtcctcgccgtcgtcgtgctctggtccaacccctccacaccggacagcctcctgtcaagcttcccgccggccgtcaccctccaccgcaccgccttcgcatccctcaactcccgcttcctcccgcacccgtccatccgcaccgcgcgtggccgtcgccgacgacgacgtgctcccggacgccgccgcgctctccttcgcgttcgccgcctggcagcagcgcgcccgcccgggcaccctcgtcgggttcttcccgaggtcccaccacctcgacctggcccgcgggaggtgggcgtacggcgcggcggcgcggcagcaggcgcgctactccatggtgctcaccaagctcctcgtcctcggcgcgggcctcctccgcgagtactcctgctcgccggagctcgccgcggcgcgcgccgtggtggaccgggagcgcaactgcgaggacatcctgatgaacttcgtcgccgccgaggagtccggcgaggggccggtgctggtggaggccggcagcatcagagactggggcgacccgaggaacgacgatgccgacgccggcgccggcgccggtggcgaggagatgaaggccgtcggcctgagctcgacggggggcgcggcgcactgggagaagagaggggattgcatcacggagttccaccggctgctgggaaggatgccgctccggtacagctacgggaaggtggtggcggcggccggcggcgagcaggcgctgtgcagcaaacgcggccgcctcgtccggtgtgaccaggagtagctctgacacgatgagtcttccctgattatcactgtaaattctgaaaacttgcagatattggtaaatttaattcagaggaaatccaggtttaaaacagtagtggagtataaattgtagtatgttctatagaaaccaaatttacagagagcgattgtagatatctgataattcaggcgtaaaatcaattcaaaccccaaatcagcattggtaaaattaattcaaagtttcaaaccccaaatcatcaagttaatcccaggcattggtaaaatcaattcaaactcgaaatcatcaagttaatcccgtagtctttcgttgagcatttcagagttatacaattacttaaaaacatttggcacatctcacggctgaaagctttgaatttccgccaaaacatttcaagatttagtaaaacaaagctttaaatttaaatttagcgtatgctgctaattgtggcgcgcacacggtattctttagtaaaaggcgaaagaatagttcgctttgtgctcaccacgcagctgcgtgccttccaccctcacacccaaccccccttatatagccacctccccctccaccacccgcctcgctcgccgaggtggtactaaactcaaacccccacctcacacggccaaaccgcgcgcgacacccctcctcggcttccgccattcggcccaccaccaattcggcccatcacccatccggcccagaatggtggccttgtgggccgcccaggtgacgcgctgtcgctgtctcgagaagcgaggcgcattctagaggcttccggagatggaaccgaagcttctccggtcttcctcgccttcttcttctccactcgtccactcctctctcgacgagccccgtataaatctcccgccatttcgcttccccccttcgctgcgatgcgagaattaaccttcgagtgcaccgggattaagtggcgagattagcgacgtggtgattgattagtggagcaggatatggtggtgctcgtggagtcccccggcggcggcgtgacgctgaagaggaagggcggggaggagcctgagctgttcatttgccccggcgacgtcgacggcgggctcccgctcgcttgccgcgcgaccaaaatgaggcggctggtgcgcgatgacaacgcggcggcggcggacgacgtggcgatgggcgaggcgccgtctgcggcggaggtggcggcggtaggtgaaagggctatggtggtgtacgagccggtcgaatctgtgggaggcgtcggcctcctcggccagctgcggcggcggctccggccgtgggccagcctccgcgctggcgccgagtggatccgggacatgctgcggaggcggacagccggacggtgcggcggctgttgtccggcgccaaaaaagaaaagagaatggcgccggcatggcccttgtccgttggggctccgcgccggcagcggcgggggattcatggcgaaggatactgtgggcgtctcgtcgtcgtcgaaggaggagaagaagaagnacgccgagggctcagcgaagccgatggaggtcaagaaagagggcgcgcatctcgccggcgccggtcccccggccgcctccggcgaggggtacctgttccggcggtggccgcagcattgcatgccgccgccgcagcagcagctgccggcgatcgggcaggcgagcccggtgatgtggtggtgaaattgggaaatcttttcaccccgtgtactctgttgctgtactgtaaaaatcagttttcaactgaaatagagatgaatttggatcagattcaagagaattgtttgaattcagtactaggaaaacgtacgatcccaacattctgcgatcccgaagaatccctccgcgtccgccgtggcagctcgccggagctccgccgtggtacggacggcccatttaagttgggccggaacgggattgcccgcagtgttggcctgttgggtttcgattggtcaggtattgggccgtgcagttggtgggccttttgccttcccctctgtagccaccttcgagactccgacccctatgttccacaatgtcaattccgtgttttatattgttatattatataattaactagctggctggcccgcgtaattgcgcggctagcacccaaacaaaatcataatattttttagtatgattttacttaaaatttataaaatagctatctggctatctcattgtcatgagactttgaaattccaaatcttatcatcctcgtgtttataattatgtagtttttaaaagtcacaccagttgctaccccttatgtcatctccttctttatttgcttgctcgatctaccactatttctattcattcttcttgcaacctttaaaaattggattttatagcttttagagtcgttggatttcatttttataatttctagatgtcctgtcaaacgttgccattatactcctttacggcccgtccactatctcttctctttgttgtcattgagattttaaaaatcgacataattatcgtttgggttcatttttttactttctagaagtctcgccaaaccgtcagcagctttaccatcgtactcctctgcggctcgccgctgccctcccttttttattgtcattgagattttaaaattgaacatgattatcattgtttttttttactttttagaagttttaaacctttaaaaattggacttgtagttttattttttataatttttagatgtcccatcaaacgatgccactatgcccctctatagcccgtccgccgccaactatttattgtcattgtgattctaaagattgaatataactatcgttggaattcattttttattttctagaagtcccgtcaaccgtcggtggctctgtaactatactcttatacatcccgcccgctgcttctcctttttattgtcattgagattttaaaaaatgaatatgattatcaatgggtttttttttactttctagaagtcccggcaccgccttactcgtttgctttacggcctgcctgatgtccctccttttaatcgtcattaggattttatttagtgttttattaacaatttctatatatcgtatcaaccgccaccactctactcctttataggcatgttacttaatttatctcgtcatgtgttttagatggtcttttctttcaataatctttatttttatcacaaattttagttatttataaattgtatgcctaattgaaatcttatttttctttttctaatttcagatttttttaaaaaaaaattagttaatatcgtattgtgttattttaatgttttaatgttttattttcaatttcagttgtttcaaaattgtactcctacttgaactctcttttaatttttctaattttagatattattttatttttattctgaattttaattaatctcgtattgggttcttatatggactcttcttttaatatttcttatttttaactccgaatttcagctatttttaaattgtattcctacttggactcttcttttattttcttttctaattttagattttattttatttttatttcgaattttgattaatctcgtattgggttcttatatgaaaacttctttcaacattgcttatttttaattctgaatttcagctatttttaattgtatttatacttggactctcctttccttttctaattttggattttattttatttttattttgaatcttgattaatctcgtattgggttcctatatgaaaacttgtttcaatattgcttatttttaattcctaattttaactatttttagattgtacttctacttggactcttctttttttttctttttcactgattaatgtggaaatttctaacttccacagcgaacgtggtgccttctttcaaagctgttttaataatataatagatagagagagtaaagatgtcctttgttctaatatatcttttgtaatggtagctgatgtctaattgcgtgttctatgttactatattttaaaacaaaaagacgaaaagcgtaaactattgaaaagtttaaaggcatgttcgctttgttgccattttcaaccttaccaaattttgacattgtcttgccaaaattttagcaggatttgttatgtagttaccaaaaatttgcagcaaactactttttggcaacattactaaaatttagtaaggttaaaaatggcatcaaagtgaacaggccctaaaatactcatgaacatatttagtataaacaacaaaaccctaatatagtaacgtgcaattcttttgccaaacagtaaaaacaaaaaaaaaggcaacatgagctgtaaggatgaactaattaaaattattgtatgatatttttgtaaaaaacaaacatttaattatgtttgcccactaccattcgcaatgtcaatgggcaataattcttgtcctcagatcggtcgcactggtcttaacaaatgcatttatctgcaaaaaaaaaaaacttggacaatgcaaagcttcattcataatgatatcatgactgagtagaaattgtactgcagtacaacaactaatgaaagcatacgcattatctcatctatcaagcgtgagtgatgtccaatcgcataaaccgcggagccgacaaggtgctcgtttggcatcacatcaggttttgctgatcaaagtgcccggagattcaattccagcgacgaaatcttctagggttcatcaggatagccggccgctttatttgacagattcctgatgatttgtcgtcagagtggataacatctcagtcatatctctattaattaattatactcctaattcttcattccaacagttaatatcactgtatatgcaagagaacattctt

SEQ ID NO: 79503 - DNA, 599 bp, Oryza sativa
ttagtctatgactaaatgattaaatataatacacgggtaaaatccctagtaattaaatccgaatttctaccgtgaaccgattacttaaaggattacccaaaaataatctataataatctataagaattcatctatttgtttagtaattaactacatctaaattattaccgcgaattgatttcttatagaaattgccaagaataatccataatttatattaaattttgcaattctacgactataattaatccataattaaattctaattattttcaattttctaaacttccctaatcttcctctaattactattttttttttcttttctttttctctcctcttttctctcttttcttttctttttctctctttttctctcttttctctcctcccggctcctttctttcttttccttctcttcctctctcctcttttcttcttcctccctagcggcctctcctttcctctctctctcggctcttgtccacccgagcgacggcggtggtggacgcgagggggggggaagaaggctcaacggcggcgacgacggcggcagcgcggcggtggcgacgacgacggcgcaaggcgacagcgacacc

SEQ ID NO: 79504 - DNA, 38575 bp, Oryza sativa
  unsure (1)..(38575): unsure at all n locations
ctaacaaactctaagatactataagtctttgcggcagacttttgcccacatttatctataaggaatttacataacatatcctaattaatagatacaattgccttcccaggactctatccgtgcgtggcaatcatcttgaaatacactaacttgaacccgatgtcgcatacaagttgtattgtcggaatcggctatatcggcttatttagcccgactcagacccaaccgatcctaaccgtagccgatctggattccagccgatccctgctctgcttccgaactcgatctccgcctccaactccgctttgatcaagtcctctttcctgacatagatgttaccaaatttggttgttaacaaggtgcccaatcgatgagagcatacagattaacagggcatgtcagttggttacatgatgatgtgccatttagtcaacacaaacacaccaatttatttaattattttttctttctaaaatgttcctaatgcttatgaaatgattggtaatttggtattttgtcagtttgatggtcttgacatgttcatagagatggaaaatttagtttgaatttgtaatttggttagggcagcacatatttgctttcattctatttatatattaatttaaattaggttgcctaaaaaaataaatttgtttagcaaatgaccggcatacacatattttcatgttgctaggccttttaaggcaatgttggatggtaccggttagtaactaatccttcacgcacgtaaaatatagcaacccattagcacatgattaattaggtattaggttaaaacccttaaaaaatgaattaatatgattttttaaagcaaattttctatagattttttttaaaaaaacgcatcatttacaatttggggaacatgcacggttgtgcgcggaacgagagagtaaaagttgggacaagatagtatttaacttagcttaaactggcttacatggagcaccctctcaacttttatcctagattcgccactgcttatgcattatactaggacgtttggcgtgccttgccgcgccgtaatggcagtgaagagtaatgttaagtttggaagagtgtaagcaaacattgaagatcagttgaaagcaaaatagagtgtcgcgagaacagacgtaaaatgatatgttacatagtgcatgcgatggaattgtatattcgaaccaggagaattacgtatgactctaatggagtagccaaaaaaagatcacataggagatctatagcataagtggtttggctatgtggttggtgagaacatatatagaaggaactattctgctatggagctggatgatatgggtggcgcctacgaaattcaagaggaagacgccgtggtggccttgccggcgacccgccttcaacaggtccgctatctgtgtctgtttgccgagatacccactggaatgtctttataactggcagtcgacggttgtctttctcatattgctttaaaacttctccatcgatctcattgtcgctgtcttcatcagtgtagtcaaaaagcttttcaatgtgaattaatatgacaaataaatctgcattgcgtttccagccttggtcagatgattgttcctctccttgaacctcctcaatattccaatccattagtttggggatgagattgcggtcagttgtccatgcagacaatctgaaaatcgacaggttttgtatatgatgctcttcataaagctcttcaaccatacaactaccgtctagtaattctttcatggcctgcttgttccataattctggtggtattccttcgagtgcaagtatgactctttggcgcagtgggtttgggacactatgaaggttcatcttgaaaggttcatcttgaaaggctcaaaatgcagctgagttgtttggaatgtgtaggatttctgggcaaacgccttttgagatctctcatattgcttgtctgagtccatgaatagcacaatgtacattttgtgcctgaacggcagtaaggcaaaatcatcaatctggcagtcacacacgaagcctatcatagctgatattttcgttgtgtttggattgccagctccaagaacggtgacaaccacagcgtcctggtaaatgacatcggcaaatagctgtgaaatttctccgcggcttgaaaattttgtcgctaacagtggacggctactgccataggacaatggtcgtggttgtctctggctagggtggttatcttgatgggcctccatagtgttctaggaaagaaatagaagacctgttggttaacgcgtgcccattgcagagatcaaaaaaatgtttagtttgtttgctctaatactttcctatattgttctattacagatgtttggatctgacccacttctgtatagggagaggagggataggaatgaacatatggagattactgaagataataagctgcagttgttacctggggagggaggctgaagagcttgtgaaagctgttcttgctgacgggaaggcgaagagcagcagatatgtggtggggaggtgcaagtagcggcgaagaggagaagataagtgtggtagagatagaaataataggatgtgctgtatggcatctcgctgcaaatatgtcatgtctcttcaaaggcagcatgtacgggcaagcgatggtgtggatggagtgtgtaaagaatgcgtaggctgttgtttcagtatggagttggttgatgggtgaatttccctagcattcaataccatatatatatatatatatatatatgtatgtctgtatgtgtgtgtgtgtgtgttttggttctttgtactatacagcggtgtggtatggtctatagatgttttgtatggaagaaacatatattcaggtttagtatctggatggtgattaacttttatttcctgaaagcaggccgatagtggtcagtaagcgcacaaatatcctgggtcgatgaatgtgaactaaactggatgcttgaataaacctggtaatgctcagtcagacgaagtagttttagatagctatcagcattcagtattttcacggtggaggcatgataatatagaatcctggttacatgcataaagagcaattcatacaaagttttttcgcaaaagaattgctgctacagacagtcgggcaatttaatagcagcacagtttgcagaagcacgacagaacgggatatattgttctccttcgatgaagctgattgaggctgcaattgtggaacccaaaagtaagaggtctcttgcataacatattaggcctagttgatggcactggaaggacagaaagaaagcgcaaatttaggacaaagatgtggactgtaaatctgaagcgtttgaccatagggcccaaaaaatattttggagcttgctatacctgccaccagcgccatcgtcaccatcgtctttgaacaacttcttagcagcgcctatgccaggagatggtctagtcctgttatttgtgatttgttattagcctgatgcagaattttctatctagcaatatttagaaggagcaaaatagagcttaccttttttttagcttttggaagcgctttgtttagtgccagatggaggagatttctgtggcaggctggcatgatcagcgccctagtccatagaaaaagaagttcagtactcagttttgaaagatgtttgattaaaagaaaactgagaagcaaaataacctcatcctctacgtcctcttcatcctgaacatctgcatgggtctttgaaacacattctatgtccaactccttctttttcgatacagcagttgatgggctggttggtccagtctgtgcatcactaaggccaactgatggagttggtgatagagccatggaagctgggagagaagatgcttgagatgcagatggcgactgaagcaagggaaggccgtgggaagaagcacctccaaggatcctgttcacctggaacgcaacattgccagtaaaggcagtgttctctatgatactaacattcgaagaaaattctttctcaagtagatcagtgatctcctttggtatgaaatcagtggtagctggattctgctgcaacagcgtctccactgaacgaccaatgagccgctgtgccaaacgaccaaagataatgaacgaagtatcagctgtgtcgtcgcctgctaacacactcagcttgaacctgcgaaaagcataatcagtatagatatagcacactaatatatattcaatatgttacatattgaagcccgtggtaactgacccaggcgaagctgaaataactggtgggcatgttggatctccacatctgtatccactaccaaatcgctttgctgtcttgttgcatatgtcacaagcagtgtaccaccaggaactatccatattgatttttctaatgacaacagtgaccaagaactgatgtttctgtttgccagaagtagggtggtgattagcacactattttgcaaaatggcaaacacaataatgagtactgatattagtaaagatttaccttgaacttaaaagggtgcaggtccttgatctcaataattttcttttgttctgcattgtttggagcatcagatgaggctgggaggtcgatatattttatcggttcataatttcctttgatgctgcacagaaccaataagtgtgagtttaaactggtggtaggaatagaaactaacaagatataaatggcaaagaaaggacaaataaggaacctgttttttaaggcagccacctctggtttgtcaaggtttatgtaccacttgcaagcagagttaccagataaagaaacattccctgtacacatattataagaatctcagagaatttgtggaaagctactaataacgatagcaaacgtttctaatgtacttactgccaaatcccctgacaagtgtcccaacaaagattactacttgtgactcttttggccagcctcaagaatgtcatttgcagggaagcttgtagctcggtctccccacagcgcaacatttattgtcacattactattaaaaggtatagtataatggcagaaaaagtatatggatggtaagtgtttgttatgttattagtaaaacagaacaatatacaaaaagcacatattgaaaggaaggagaatattaggcagcggttagctggcgttactggaacagtggcaacaaagttgttagggaagcagagtaaatatcttttggcagatatgaaaaactgagatggaggactaactcggcatcacggatgtagatgctcctcttgaggctttcaccgtctctgatgcatgtctggataggagctactgacgttatctcagtaatgattccaatagcatctgctatgatgacaataggaaggaatagtctcttaggaatgcaatgagaacagtagtaatttataagaacttaactgcaactataatacctgtgaaaaagtctttcctgttcacccggctccttagctaatcatatggcgttaaagagtaaacatacttagggaaatcttctagcacatcattgcattcttccagtgtggaccactttgtgaaagaaattgactgcatattgctcactggcctatactggctggtgcactgccttacacgatagaatgtcagatcatacaccttcccttcagtgatctgaggctggaaaagctcatctaatggtgggaaaatctgggctgcaatactggctccctgtttacacagtagtacaaagggaaaatatgtgtatgaactgtaagcaaagattccaaagaactaaccgtgcgatcaagcagaaccagcccaagatggtgcaaattactttcatcattttggtcacgaaaagcccagaaccttgacacacgaacacgaattgttgggttcccaagactaggttcaagcctattaattagcgtagcctccatttgtacagaaagtttgaaacggatagttcataacggaaattcctaggatatcataggtacggcaaatagtaaaggcatagataagagggatgtaagataggcaacattacatacacaatacaaacaaggcacacctaaaagtgaaaaaaaataggtatacaacagctgcaaaaaaggcgatatagctggtagctaggtgccaacatcctgcagtatagaaagcacaatatattaaagtgtatttggatatagcgtcaatttcatagggatgtcgatggagctaaactatctaaaatataccatcgatctcactacgtccaatacttcttggtaaaccacattcctggtttttgaaccacagacctcatcctcatcctctataaggattctaaggcctactcttgaggttgacctagaagcagcgacttatagttggccatgtgtaaagacaggtttttttagataaaccccaacccgtgaaagagtctgcccctggctcttgttaatcgtcattgcatagcatatgcgcacagggaactgtctcctttgaagtgtaaaaggccacttagaacttgtagttgtaagcgcgattcgagatatgaaagccttctcaccaatgttagaaccagtcaatattacacactctataagtcgatggcctagagaaacaaccaatagtcttgtgccattataaagacccatagattgatttaaatttcgcaacaacataactgtgacaccctttttaagagtaagacgatgtgatgggaaattgttaacattaatagaatctaagaactcagttgggtagagtatatcaaagtcaggcatatggtcacatgcttttgaaattgtatcacagctaagatattctttagcttcggtaggtatcatcttaacaacacaatcatttatttcatcgactgttgagttatttgggcaaacaatagcacgacatgctagataggaatgatctgtgtagctggaggggaaatctggaaagacctcatctataattgcctttactttgtcgccgggtgtctttattagtaaatcattaggaatatctatccatgttggttcagattcatcgttttttttggttgtaggtagcatgccatcaccgagatctaggatccaattaccaaattcttcaaggtctcgtcgggtgcgttcattaagcccattttgaagaagtctcatattaattttcagtcttaaaagagtaacatgccgccagaggggggagttagttatggatgcatcgactatggaagcacgcgagccctttcttatcacttctagtatgtgtcgaaaatcacctccaagcacaactaccttaccgccaaatggcagcctgccattagaaggtttttgctcggatagtaaatcacgcaaagttcgatctaataagtgatgtttcctatgagtcattggagcctcatcccatataataagtgatgttttttgaatcagctcagcaagcatagtacctcttttaatagcgcagatactggtttcatcaatctcaattggtattttaaatcttgaaggagcagtgcgtcctcgaggcagaagcagtgaagcaacacctgaggaagcaacagcaaggacaattttcttttcagatcgtatttttgtaatcaacgcgttccatagaaatgtcttgcttgtacaccgtggccatatacaaaaaagaatccaggtttggaatcgctaacatttcataatcgtcttaaaaatagttttctgatcgacgtttaattatggaattattgatctagcgatggtatctagtgtggcgctgtcaagagctaactcttcctcaatcattctattacctaccacatcatctgaataaatcgctgggcgcggtaaatcgtagtcgtctatggtaccaccactgttggaaaaagcagtctgcacttctttcattaacagtgacatcagcctttcatgggggaccaaataagaagggttcaacagagctattctaagacgtcgttgtatatcgtcggtaaagtacaaccaatatttttcaaacagggatctcacatttccaacagagcagaacatcacaatagtaacaaataactgtcttaattggctagatgatgcagatattatagccttgtcaaatagcaagtaccactcattatcactctcgagtaaccctcttgcttcgcacgcctctctgaacgttgtataaacaacaccgtcgtatgttctaacatcagcatatgacatcgcacctttcactatcatcaatagcattcataggtagtacaattctccgctcgctgggctcacatagtacatcctacctatcttttcgcatggtgttctaggatgccagctacatgagctgttatcccatgtccattcctttgggaaatcgcagtatgtcagtgttcttgcagcactatgttttttattggcctcaaaccattctgtcagcatcattttttgggctgcaggacttgtaagcagcgaattcaggtcagcaccttttttgtatcgaacaaagttctggtatggaagatgcacagttaggcgctcaaccgaaggcaccctatagtggatatcaaactcaaaagcatgccaaagggactcacaagtagaaaggaaccttgcatcaatgtactcttgtatctcattccgtggtgtgctgttactgtttggtgttttctttgatgtgtcattttgtggtgcactattattttcagataactgactcggtaacttactattaacctcatagtacgctttagatctgtcggttccttttgtgacatacttaaagaggtacttaatcatgttagatttattgcaccattcgacatttatatgtgcttggtattttttaagaagttccatgttgtaaggcacaacccattgattatcgatcttcactccatttttaagaacatatcggtcgttatctctacgtttgtaaatagtaaaaccaaactcgtccattattgtctcgtcctgaaaagacttagggaagtgcttagaacactccccttttttcatgcatgggcatgatttgttctggttgccacaagggccatgcatcatgaactcatcaaccaaagcataccccaatggatcagtgaaaatgtcagggatttcagcagaaatgaacccatcaacaataggagcactgaagtcaatagtggatgcagcaagccaaataaggcaatgtatatgagggggcccacgcttctgaaattctactgtgtagagcactatatgataagcacaaaatatcagaaccaaccaaggaagcacagaacaaactaaatagagcaaaaacaaaaagcctaccagcaaggactgggccaaatgtctttccttccttaatgtccgagataaactcgtctactttcatgttgaaaactctaacaatcatatcagaacggtcgcttggtacctggcctggttcaaacaacaatgcatcgtatatttcttgccacttagaattgcaagtaaaagtcacaaataggtcaggtgctccaaatacacggcatatggccattgcatcttggtaattctgtaccatataacgtctgccaccagtaaaactggtgggcagtacatacttctttcctacagaatccccagatgcaagaccatgatcaatggcatcacttatcccttgtacagattctgagcggagttcatgttggttgtcagcaatgtattttagtctagacccttctacagttgagtatgagtcaacacatattgcatcatttagatgaccacatcaagtatagggatttagtttattcaaccggtaatggagtcggtagcggtagtaatcaagcattgtaacatagcgtcgtgaattaccagaaatgctagggaagtcagtgtactttatacctaaatggaacgaaactcctaatgcgcgatcaatcgttgggcgacaggagcagcgatcgatttccctttccgccacttgccgccaccacttgccttttctggcttttctcagcctctttcctattgggcttggcccacgagagcccatccacagcacggaaccgtttttggcttttttttatcgcccttaccagaagcggaagcggatgccgttgcaattttgaacagtaccctcttcttcctctcctggcgatttcgatttctcctgtgattctccgacgatttttctccaacgcaacgtggttcgtctcctgatctcctcgagcatccttggaatcgattcctcctgctatttctcggttattgtagttagggtttaatttttggaagtgattttctgttcccccgagctagcttgatttgattggtgattttttttgttttagttccttgggtttttgggtttagatccatggcgttttgggtttgtccgtcacaaaatcatgccgtgaaaccacatgcaccacgctgtagacgccgccgtagacgtcgtcgccgccgtagacgtcgtcgctgccgcggttgacgtcgtcgccgccgcggttgacgctgccgccgccgccgccgccgtagacaccgtcaccgccgcccgtcgctgctagggttagggcctaaccctagcaaaatcatggatctaaacccaaaacgccattgcttgaatctctgtaagctggagtattgcaatgaactactgtaagcaggagtattgcaaatgggaatatttgtggctgcatatttgctggatattttccatgtgtatcctggagtgagtggacaatttgggtagattgctgcatattgctgaatcaatgcattgatatagctggaatatttgggcagattgctgtaaatgaatgctatttttgactgcatattgctgcacaactgatgactgcatttttttgcaatgtgattttcaatccagagcaatatccagctgcaatcttggagcatatttggctcctgaaatactacatatctcaagttattttgccagcatgattcaagttattcacagagaaatttttctatctccatgccctgcttgacctggtattatcatgaggctttcacatgatgcatggattgctgcaatctgattttgtaggtgtcatcatatagttgttgctttctaataacattcatacttgagtgagattttcagagaaaaaactacagaggatttaataggagcaaaaacatctttgtgcattaacttggtgtactgagttttttgtcagaaatgtactattttgcgttcctccatatgcagttagttttttcccctgaaacgattgtgcgcagatttgctttgttctagacaaatttttgggagaacccaataggggctggttttgaattttgttttctgactcgattttttcagttgattctaggtgtcctcatcaactgattttgtttttgtatttgtaggattagatattcagtaaagtttcagtgtttcgctctgttttttatagtgcaatgggtgcacttttttgtctaaactgtgtgctggtaaatataaacgattaaaccatccagaactgagaaaacctagcagccgcttgtgttgtgtttgattacatactgcagatttatacacctctgcatttctaagtttgtattcctgcagtcatcaactcattatcctcttatactgagttaagttcagtctggttgcaggtagtcacgaagttttgatgatttttgtaaaaattttcatgagcatatattgttgtgattgactggcccatctgcactttttggcatttttgaccactagcactgaatggtgatctttttgccttattgtcatatatgccctcactatttgccatttgtgggttcatgttagcttaactcttttttttgttactgtggatatgcatatgtttgccacctcatcagcactcataagcaatcaacttagacagattttgctttgttctagataatttttgggggaaccagtagtgactgctagtgaattttatttttctgattcgatttcagttgattctgggatcaactgatttttgattctcacatttcagttgattctcatattttatgactagtagtgactagtgtcctcgtcaactaattttgctctcatattcataggattagatgttcaattaagttcaggattttgctctgttttttattggacaatgggtgatttggctaaactatgtgcttgtaaatataaagtattaaagtatatgtgatgggtggtaagtacataacagggggtgcttgacatggtgactaacaggactagtccatacatataaacaattttttgatccagtgttttgctactatgtcctgataatgtacaacatataaaaaattctcactacaccaagtcaccaaaaatgctcatacatgtgtctgaaaaccaaggggtagagagagagagagagagagagagagagagagagagagtaccttcagcatatagagaacgaacagcttggacggaataaaatctcctggatgaatagtatctttttttggcgcttttctgaattccattgtttcatgttttttgcataacctttttgatttccttgccgctatctgcttgtatcaatgatttctaataaatcagttggtcaggagctcaaggtgtctatgtaactgttgcgcagataacaaattccattacgtgactcaggcagtatggatgattttgaggaacatggtattagttatcgtgaagactcggactgtagcgaggcaaattgtgcaatttcagattatgttccaagcaaggatgccactggtgagcactctgcaagcaaagataacagctcggcagaatctgaaagtaacagagttgaaataaagcagtcttcagattctgcaataaaaaaaatggagatatactatttttatgataatgattttactagtctatttccctgtttctctttaaccgctataatgtcccataccatggatcaattaaaccaagcaaagtgtataaacttactaatcgcccgataggtttttttttaattcacatgtttttgtttctatcccctgccaatttcttgtgtttataatgtttcgaagtataaagtgtttaaagtagaatgtttgtaagtataaagtttctgcaactataaatttttggatgttgaaacttttattagtgtaaattttacaagtataaagttcctatataaaaaaatattggaatccgaattgtaatttgaatcgggtatataaacttttgacttataaactttaggtctacaaactttaggtatataaacttcagatgtgtaaactcgaggtgtacaaactttaggtgtataaacttactatttgcccgatagggttttttttaatacacgtctttgtttccatcccctgctaattccttgtgtttataatattttcgaagtataaagtgtttaaagcaaaatatttgtaagtataaagtttctgcaactataaacttttggatgttgaaacttttattagtgtaaagtttacaagtataaagtttctatataaaaaatatttgaatccgaattgtaatttgaatcgggtatataaacttttgacttataaactttaggtctacaaacattaggtgtataaacttcagatgtgtaaactcgaggtgtataaactttaggtgtataaacttactattcgcccgagagggttttattttaatacacatgtctttgtttccatcccccgctaatttcttgtgtttataatattttcaaagtataaagtgtttaaagcagaatgctcgtaagtataaagtttctgccactataaacttttggatgtttaattttttattagtgtaaagtttacatgtataaagtttctatataaaaatttttttgaatccgaattgtaatttgaatcgggtatacaaacttttgacttataaactttaggtctacaaactttaggtgtataaacttcagatgtgtaaactcgaggtatacaaactttaggtgtataaacttactaatcgccggatagggtttttttagaatacacatgttttttttcatcccccgctaatttcttgtgtttataatgttttcgaagtataaagtgtttaaagcggaatgctcataagtatgaagtttctgcaactataaactttcggatgtttaattttttattagtgtaaagtttacaagtataaagtttctatataaaaaaatattttgaatccgaattgtaatttgaatcgggtatataaacttttgacttataaactttaggtctacaaactttaggtttataaacttcacatgtgtaaactcgaggtatacaaactttaggtgtttaaacttattatcgcccgatagagttttttttagaatacacatgttttgtttacatcccccgctaatttcttgtggttataatgtttttgaagtataaagtgtttaaagcagaatactcgtaagtataaagtttctgcgactataaactttcggatgtttaattttttattagtgtaaagtttacaagtataaagtttctatacaaaattttttttgaatccgaattgtaatttgagtcgggtatataaacttttgacttataaactttacgtctacaaactttatgtgtacataaactgttcttcccttgtttgaacttctctatgtagtgtagtttccaatcactgagtcgcacattgtcatttctttagttgcatattccttttttttatgggatttttttgttatgttttgttcatcatggatttcatgtgacccaattttagcaaatttatgtacatcacaactgtcatatatttatgtgcaggaacggctctagtttaatttaaagctttgtttccacaaaactgtcagtagtataaaattgaatattttttcatctctattttctccgcacaacttatcatgttgcttgcccaacttttttctcccatttaagttgtaacaattttaaaaatattttttctcgtcacaggtttcagttcaaggccattttcaatgatcctaatgttctgctagcgaaagtgcaagttggcaatccccttttataaaacaaatacaatgttctctttttttcccacatcatgtttttattgtgcaattcaactatttttatcaacattttttcaacctgtcaattcgccatctacaaaaatgacgagctgatgaactccatagcgcaaacctgaaatctagcaagtgtgtcacattttactttaactttatggtttttttatcttgcattttttttaattcagtacaaatgagtgagaaagctacagcttttgtcatttcaaagttacttcaatttatctctccaccctccgcttatccgcttatccctacgtaccacatcccagaaagtcagtataattgatgaaaaaagctacagtttttgtcatttgaaagttattgatctccccaccctatacttatccctacttaccacatcctagaaaggtaatgccgaaaagaagagcaaatttggtacgtaccatcgcaaagttcctggtgttggaaaataccatcgcaatgagctcgagtagaaaagtaccatccaaattgcccagtttgttagaaatgcccctaccgtcgctttgtccgtttgaagacgtcgttgatgatgcgaaatggcgatgatgcccctgctgtggccacataggagtggtttttgggccgactttcggcccaaagccaaaaggaggatttttaaaactttttcaatttaaattattcatgaaatgcaattccatttattaaaaaatacttccttggctcaaataaatcccagaaaaatctagaaactatagaatcaagtaaagtatttaacaaaattttatctagcccacttttatattggaatttattatttaaaattagatcttctcttctaggcttttaaaattcatttctaatgattccaattaaacaacaatttatatatttaagatttttagggtgtgacaaacctacccccttaaacagaatctcgtcctcgagatttggaagaactagcgaaaagatgcggatgagctgactttaattcatcttctcgttcccaagtagattcttcctctgagtgattactccattgaaccttatagaaacggataactcgattcttggttcttctctcatctgtctctaagatacggattggtttctcaatatatgtcagatcctcttggaccactatctgttccagattagcttcttcggtgggtacccttaaacactttttcaactgtgacacatggaaaacattatggacacctgccaaggattgaggtaactccaactgataagcgacctctcctcttctactgacaatcttataaggtcccacaaaacgcggtgccaattttcctttagtgtgaaaacgatgaaccccttgaagaggcgtgacacgaaggtacacatgatctccttcctcaaaacttaaatctctgcggcgattgttggcataactcttatgacgagaatgagccacacgcaatctttcttgaatgatctttaccttctcttctgcttcccttaggatatcagtcccaaaaacctgacgttctcccatttgatcccacaaaagcggagtgcggcacttccgaccatacagtgcttcataaggagccatttgaagactagcttgataactgttgttgtacgagaattccgcgtaaagcagattcttatcccaacatccaccgaagtctaaagcacaagctctcaacatgtcttccaaaatctgatttaccctttcagtttgtccgtctgtctgcggatggtaagcggtactgaagttcaacttggaacccatctcttcctaaagtttcttccaaaactttgaagtaaactggctacttcgatcggatactattttcttaggaacaccatgcaaacacacaatccttgccatatacaattccgccaaacggcttccagaatatgttgtcctcaccaggatgaaatgagccattttggtaagtttgtcgactatcacccaaatagagtgatggcccgatgatgttctgggtagaccagtgatgaaatccatgccgatttcctcccacttccattctggtatcttcaaaggctgcaacaaacctacgggtttctgatgttctgcctcgactcactaacagacatcacacacagctacatactctgctatctcacgcttcatacttgcccaccaaaatctttccttgaggtcttggtacatcttagtactaccagggtgaatggagtataaagtatcatgagcttccttcagtattgcatctttcaaatctttgttgtctgggacacagattctctcacccaaccatacagttccttgctcatcttccaagaaaccgatagcttttcctcttctcatattcttcttgatctcatgaatatcaggatcattaatttgggcttctctaacttgatcaatgagagtgggcttcgcttctaacgctgcaacgaaacctctactgacaatttccaaatttaatctttcaaattccttgcataacttcaatggcaactgtcgtccttccgtagcattgcaatagcctttcctgctgagagcatctgctacaacattggcctttcctgggtgataatgaattcccatatcatagtccttaatcagttccaaccatctctgttgtctcatgtttagatccgactagataaaaatatacttcaaacttttgtgatcagtgtacacctccgtacgagtaccaaaaagatagtgacgccaaatcttcaacgcatgaaccactgcagctaactcaagatcatgagtagggtagttcttctcatgcggacgtaactaacgagatgcataggcaaccaccttcccatcttgcatcagaacacaacctaacccaagcttagatgcatcacaatacacttggaaacccttcttaggatcatgcaaaatcaaaatgggagctgatattaagcgacttttcaactcttgaaaactctgctcgcactcttctgaccacttgtacttcacatctttctgaagcagtcgtgtcatgggcttggcaatcttggaaaaattctctatgaacctccggtaataacctgcgagacccagaaaactacgaatctctgaaactgtcttcggttgtttccagttggttacggattccacattactaggatcaacggcaactcctccggctgagatgatgtgaccaaggaacttcacttcagacaaccaaaattcacatttgctaaatttggcatacaactgatgttctcgcagcttctctagtgcaagacgaagatgttcttcatgctcttcattggttcgggaatagatgagaatatcatcaataaagacgaccacgaacttgtctaggtattctataaacaccttgttcatcaagttcatgaagaaagcgggggcattggtaagtccaaaagacataacagtacattcaaacaacccatacttagtggtaaaagccgtcttaggtatatcctcctctttaatcctcaactgatgataccctgatcgaagatcgatcttggagaaaacggtggcacctttaagctgatcaaataaatcatcaattctgggcagcgggtacttattcttgatagtgacatcatttagtgcacgatagtccacacacatcctctgggtatgatctttcttttccacaaagatgactggagctccccatggagacgaactcggtctgatgtatcctttctgaagcaaatcatctacttgcctcttgacttctgctaattcattggctgccattctataaggtctcttatggatcggagttgttcctggtaccagatctattctgaattctatatcccttttaggcggcataccaggtaaatcatcagggaacacatcggggtactcccgtactataggaatctcttccaaagttatttggttcagactcgaccttaaaagttcagagggcaatgcatgaacagttacaacttgaccatcattgctggtgagagttacttttctattggcacaatctatcacacctttatatctggctaaccagtccattcctaggatgacatcaagatctttggattctaacagaataaggttggccagaaatggtactccttgaatctctgttctgacagaggggctacgttgtgatgagagtgcttggttactcggagtactaaccatcaaaggacgtctaagatcttctacttccatcccatgatttcccgcaaaactcaaagataaaaaggaatgcgtagcaccagaatcgaaaagcactgttgtaggaactgagttaacagggaatgtacccaaaatcacatctggagcaccttgagcttctgcagcagcaacatgattgacacgagcctttgtcgctggtgcggaggagttgttctgagcagggacaaccttcgcgcggcggggcttcggacacttgtcagcgtaatgtcctaggtcaccacaattgaagcacactccgggcttgctgccttgctccctcttggctagctgattctatgtcagagctgcaacaggacgtggagcttggttgcggttgttgttgccagcattgttgttgaagaactgacgctgcggacgaacaacagactaagaacctccctctagcattgactgaggtcccatagcaagacgctgtctctgactattcccctgctgagccttgaagtgagcaattcggcgtttcttctgctccatgcagttgtacttgtcctcctggcgaatagccttatccactaacttctggaaatcatgataatccccagtcattaatgggtaagaaagctcatcattcagaccttcgaagaacttctcctgacgctcttcatcagtgcgcacatcttctggagcacaacgggccagacgattgaattcatgcaagtattcggtgacagagcgagatccctgaatgagcgccctgaactccttcttcttgagagacaccactcccgatggtatgtgcgtcttccggaaagcagcggtgaactcaagccaagagataggttcagcagtagtcctgttgagacggaagtgatcccaccactcagaggcagggccatgcagctggtgtgaagcaaaagaaaccttctcttgatctgtgcactgaagcaggtccaacttcttctctatggcgtgcaggcaatcaccagcttcaacaggattggtggtgctagagaaagtaggcggcctcacgcgaagaaattctgccagcttattcgggggaggtgcatggttgtttccctggttctgctggttctggagttgctgcatcatcagattcataagctgtgcctgttgagccaggacttgagcaagcgtgggattctctgcattgttgttgttgttgttggggttggggccattcccgttgctgcgagtaagcaccatctggcatagataggagcacaagaagagaaacaggggaaaatctacttacgacagggaattaattttactaacttaacttttattgatcttaactaagttttattattacaaaactgaagacttcctaatactcgaaagcaaacaaaggcacgcatttacatccccccaatgatgtaaatcacatgcatgacccacacacacaaccaaacttaaacaaactaactaacacaacgatctaagacaacgacttgacaaggcgttcaaggtcttccggacatctgagttgattgaaggctctttcggcgcgtccccatcatcttgagttgctccccactcgaccttggaatgggtgcgcttggattcttcttcatcatcatcacttacgttgacgaccggaggatccactggggctggggtagcttctttttccaccacacgaacctttggcgccaactggtagcgagggacaaatagagctctcttccttgcggtaagacgaaccctggccttctgcggtggcgcttctccttttaatgcggctagctccttctccaaacgatccaccttgtcctccagcttgcaaatctttccgcgattccggtcttcacgatcttgagctgctatcacaattttagcgcgggtctcatccatggcccacagcatctcaaccaaatgccttgtggtagcatcattctcaatccctgcaggttcaaggtaactgccacggtcacttccctggggttgacgaggatggtagcggtactcggtgtcggccaaccgatcattgtagctttcgcggagctctcctatggcgatccttgccacctcctaacaagcatgattgtagcttccctctccagcctcgaacatcaccgatgggatatcttcacgattactgttcaaggtgactttgacacgacacttctcttcatcacgatcatgaggaatctgggcatacaaaggggcagtctcaaatcctatgaggaaggacatcgtacgcaactcctgaacaaatcaacatgctaagtttattccattgcagcaagattaaataaaacaatgtggtaacaacttttgttggtaaatgggccattagcacagtaatagatgtacagtactaacaacaccggaataataaataaattttgaattagaacaattaaagagatcatgaactgcatgtgccattagtttggtttaatttaaagagaaagagaggagaacagttctacttttccaatatttttagagggcttctaggggtaaccatttggcataacctagggtcaaggaggctctgataccaacttgtcacgcccggaatttctgtccaaaattccaaacgcttacatgtgtgtaaaccctcatccaagaatcagccgaggcacacaataacaaattgataatagagtacaattattactctaattaataagcgaataaaatgtcattacagaggtagatagttcctttcaatcaataaagttctaagcagcggaaaataaaggaaacagcgcagacgactccactccataggcagcttgaccagggctacgcctaatcatccacaccatcagcatcactgtaaactcctcctctgatgaatgattgtaaggtgagtatatgacatactcagcaagccacgcagcaaatatgcaagtgcacaggataacaaaggatggcatagtatagtctcatttgcataaacagcatttaataaatatttcagaatttaataaaacagtagaatattaattaaacagtattaatccaacgctatacaacataccctgttgcataggcccaaccattctgaacaaccaatcccggctgcacagttctatctccaaaccaggaatatactattccaaaccaggagctatcaagttattaacagcatcatttaatatggtgagaagtgtgaaactaaacatgaaagacattgttagacccgcccataaccgcgggcacagctattcgaatagtttgaactctggccagaggtgtaccactgtacccacaagacacaacctcaacatcatgtcaaccatgcgttgcgatacttgacaagtacctgaatagagattgtaacaataccctctatataatacaattcacagcagtgcaccgttcccggatcataatcacccccttgtaaacaaggtatggactccccagtgactcccgtgggcttatctccaccacttcacagtctggtgctctactaagaaccatactatacagaaagtaaagccgttgcccacgctggcttgtggttggcacggtaaatgtttcacaaccgaaaatcgtgaaccggtccttaattttcatgagcacaaccatcaaaaccatatgtcacaacccaccattatcaggttttagttggcaaattaattaattaaccaatcatgattaaccatcatgaggtatcattaagccatcattaaataatagtgaagcacaagttatcccagtagtgtgctaatgttactaagcatggctaagaaattatatctaatatccagctgaacccatatataaagctcaactagtcaagttataataaccctaggtatcaaggaatagagtaatcaagaacaaaagggctataacaaggcaataggttaattccacccaatgacattcgaaaataaatgcagtagttgaatagaaacaatagctttaaacgggatcaacatgcttaaagggttgtttgggatctgtgtgacttgccttgctggccttgaaattcctcaaaatattctcctgcaaattcggactctccgggaacgttggaatctaaagagaaaagaacaaaatcaccaaaacagcacataaacaagcatgaacaatacatgtggatatttttaacatgtagatctcaattttagaaaaatttagagacttgaaccaactaaatccgagctaagatgaattagttatgaatttttaaagattaaatcgcattaaatcatttatatagattttaatggaattatgacgcaataatgaattattttttaaaaggaaaaggagattattgcgtcagcgggctcggctcacggtggaccgggtgcacagcggcggttcacggaaacgaatggccgagatcgatctatccaaaacggacggccaagatctaacggtctacgaccggtctacggcggacggcgtcgatgacgtcagcggtgatgtcatcaccgacggcggctcggcctcgcgtgctcgccggcgaacgacggcgcggcggcgtgaacgaaggacacctacgggttgcgggcgacgcggtgaactcaccggtgaccaaaacggctgcggatggtcaacggacggcgacggcgacgaggaagaaacggcggcgaccttcggcttgacgacgacggcggggctccggcgatctacagcgacgacggaggggcggacgaggacggcgacgagatgacgatcaggacgacggccttcccgagcgacgacgatgaccggagcgactgtggcacatggctggacgaacagcggtgacggcggcgctaggctacacggcgctagggctctaccgacaatgagagacgaaagcgagggtggcggcgggtagaggagacaccgggggtccttttaaagcggctaaggggcggcggcgaaggcccacggcggccggcggcgcaaaggaaaggttagggttcagagagagagacgaatccgattcgagatcgaatccacgggtttccaaacgattttagccaatgattccaaaagagaaaaggtagaggggatctcggagatcatttcccctctatcaatttcaccggagaaggaaagggatgaacgaatttggaaggagacggcggcgcggctcggttagggttcggtcgggcgacggcgcgaggaagacgacgagtctgataggtggggctaggtgggccccacctgtcagcgagcgagggcgcgcgcgcgcgggcggcgctcggctgcgggccgacctgggccgggagagagagaggtttgggccgactttcggcccaaagccaaaagaagactttttaaaacttttccaatttaaattattcatgaaatgcaattccatttattaaaaatacttccttggctcaaataaatcctagaaaaatctaggaactatagaatcaagcaaagtatttaataaaattttatctggcccaattttatattggaatttattatttaaaattagatcttctcttctaggcttttaaaatcaattctaataattctaattaaacaacaatttatatatatgggaattttagggtgtgacaattactaagagtggctgacatcaaaaccacctttttggagaagacctcaaaaaaaaaactgaacacgtacatagtacaacacagcaaaaattactaattacttgtgggatcaagcatgatcatacctggagcagtgaagcaactgtgccaaaagaattccacaacagcagagccaggttttgaaacatctctcttttcagaaaaatagtttcaagaagcttcattattcataggtttttccttccatgatgttgtaatgtcaattgtagaatatgcgatttacaattacttattcaattaagaacaattacaaaaataatcaaccaggcaattagaaattaactaatatcttagggtaaggagatctatcaaccctttgagacctcaaggtgtgctttctcacatagattaggattggaaaggttgaggacaagtttctctgctaatgtcatgttttgatccttcgctcactactcgatgacacccaatgtcggagcaagaaagatttttgagcccaggcaaacatcactataactatcatttgctacagaaatttcatcatcaatttattcaataatattaaaatttaatggacttttcaccggtgagcccgagcggctgcctgggctagttgggcgggggctccgcccctgatgacaccaactttagtgcctacctcctcacacggggatgaatgtgagaccatgagagaggagtgtgctatggaggaaaataaagtgttctttttgtttcatatagatgtatgcttgtataaatttctaggtcttagtttcattggtaacatgtatcattatttcctaatagtcttgctctttaagggaaggcatgaagcttagcacgcttggtgggagatgtgtgtgcacacaccctcaacattcaatctctatgttatgttggaatcaacctatttgcttatttcttctctactagtttgatattgagatcctccttagtttggttcattctcttttggctcttccacgggaaagttcccctttccttatgcttttttttgtttagtttgtaccttttagaagtatgtatgcaatgcacatgcctttttatcgtagatagctttgtcttcatgtaagaacaagggacgttgcaatgtgaataaagtctgttccaataagattttggatgtattttggtttactttacataattgtctatattgcagttaagcctattccacgtagatcttctgagttgtgcacactttttctcaacctagcatcttttaaacgtgcaaatgccaaaacccaagaaaaacaacttttggtcggttttccaaaagccattccacctctacctgtatgtagaagcaactagagtaattccctacacctacccctctccctatttaatttcaagcgaccagtggaaacatgaatcatgtgaactttaaacactcacccttcttctccctcccctctcccccctctcctacacacccctcctgttcccttagacaatttatcgcctcaaccacaattcttgtagttagaatgcctgatactgtgtagtagtctaataatctttatgaaaaatatccaaacctaccaaaggggccttactattgtattgggtaggttaataggcatttgcggtaatattgtcacatcaatgcatgccatgccacatattgtccaaatatttacttaaatattgcatattatcgacaaatttaatttaattttatacatatttatttaaaaattgaggggaaaactaatagtatatatgtttagaatatatctcatatagcatcattagataattcctttcgtgcacaaatctgcaataagaaataatgaaatgcaaaaaggtgcatcatctgttttcaactgtcatttattcatgtatgtgtgttacacatatcacttttatttggtggaaaacaacacattagtatattagtaaatcaagttaattttacgcaacttacagcccagtccacttcttcaaataaaaggaatgatgtaatagacaattcccacaaaagatataaattactttgcgcagctcggaaagagcatgtccagatgtcctggatctagcagatcaagaataagacgctcaacaagttcagggtccctagggctaggaacctcactagtcaacatagcaaatatgtgaagactagctatatccaatgaaagaagtgatataaaactctaagtcaaactatctccaatgcttctacatgaataaaatagaaatctgtgatacataggggcactacagcctttaagtagtgtagatacagatgatgtgcatttacttggttcataagaaattagtagaagttgttccagataaatgcacattatcttgttggtttctttgtaaccttgggtgcatgtttcttttgctctaaaaagaatccaaagttaaaaactgcagctccacatctgcgatgagtcatgtaaaagataagtttagcggttcatacctttttatgtcattcctatcgtgtgaagcacatgacaaagtgtaagtttggttcctttatttttgttaatatatgaccagatcactaatctttcttgagggtgagacaaaactcacaggaaaataatgattcacctcataaatttttcccatcagaatgaaatcctcgaggtggtggttttttgtgggggggaagaagaggctaaggcttgtttagattataggataggaaaagtatagaaatttaagaaaggaatctaagtataaaacagagaaattaaaaataaagaaataaaaaagttaataacaagtttcaatcaatccagtgcatcggcccatattcaaagatcatataattgtttaattaatatcttataattatcaatcttatacttataatatctgtttgatccgatctattaagattagttttaatagagttagaagattcaaaattatatcacatccaaatcttggctaatgtattctttgctttatttttcataacttatatcccatcggttatagccgatcgatccaaaattccatccgcatcggctagacacatgattatatatagaccttttggccaatctgccccacgatctaatctttatatattgtcgacgtttgatatcgcgattatgatatttgcatagtatgtggatcgttggtaccagtgtatgtgcgagattgaggtaaaagagatggagacaacgatttttatacaggttcgggccccttatctgacaggtaatagccctactcctgttggccgaagccgttgttgttcttattcatctgaatctcacaagtacaataattatgataatctatctagctgtcatcgacttggcggctagataaccaactcgtagtcgacgacaacatagtcttccttcttgaatatgaactcgtcgggatcagagatgacgctagatccctcttgccagcctccgtagacaccggatagggtatgtctaggcttatctctaacatcgatctctggcggcgtattggcttgtgtgtatgttgtgtcttgtggcttcgtagactgtggtggatgtctctcctctcctctagagggacttgtatttatacccatagatgcccccttgtccaagtaaactagggagaccagtatggatataatctgattagttcttatcgtttccatatagaactttactcgtccttcattatccggaactccttcaatatacgaggattgtttccgtataagacttggtatgtggtgggccccgccgagtttagtcgattactattaggtatgtggtatccataaccctgacatatatatcttgttagttgtaggatcaaactaactaacatgccctgaaccctgattgacagaacatgtactacagctaaccaaatctctcaggcctctatgtgtacgataaattttgtgtcaataaatttgtatatgaatacagactgtttgagaaactgaaaattctgttgaaaaatacaactgctagctagaaacttcccccagcataaacttttattctgttccagttaatgcgcaacgtaatgccgatgctgacagccggacaccgaagcgctcatgtcgatcaccaacgcatatcgcagcacaccgaagcccgccgcctcgccgccggtgcccagccgccgcccagtcatcggcatgcatgaacaagctagctttggtcgtaaaccagctgtgccaaattgatcaatcaagcacgaacgctcaatgatcgatcgattgctcgatcttggacggactgtccctaatttttttttcacgaacgtataaaagaattgcaagttaatatatcaggaactgcccctaatttaatcatgctaatgaaattatttgatcccggtcaattaatctgtagttaatttccagatcgatcatccgtcattttacttctccttccgtgcagtcaaatcctacgggggtatttggtacttgtaactgtcaagctaaccaagtagagatggaattgaatttggtgatcattaaagttgatggagcaactaattgcatgtatgcttgtcggttaaactttccattcctcttgcgacgggagctttcgacgcgtgcatatgactggaaggatggcggcgccggcgccgccgctccccggcggctctcctgctataggctaggttgtaacgagttaattattgaggaactgtactttttccggattatctttttgattatataagaataaattagatactataataaataaagttaataaataatctaacagaagtggctaagcaatacaataggacttaacaagaaagtttattgggaaaatatattttctgaagcatatgaagcaataatctacctatctatctatctatctatctatctatctatctatctatctatctatctattatatattaaaagtccatgaaacatcctaaaaaagcttctacgtcgacacatgacacttctagaaacgttcccaagctatcaagtgatactctaataaattggataagcatgtaactattgattttcacttaattcggtggacccatcaattttgaccattagattaaattctcatctctccaccctaatatatgatggttaaatgctttggtcccaccaaaataattaactacgagtaaacatatgtagagaatcagttgttttctctcccgaaaaaaataccgcagaattaattcttggaaagaaaaccgacgttgtggatttatcatttaatgcaggagcctgggtgtgtgcttccatcatccaaaaataaataaaacaacgaacactttttaagtgaatatcacctttgcgtcaaaaaagtgaatatcactaactgttctaaactatttacagatttaggttccgattcatgaatattgccctcggtagttagtttctgaatttttcctgtatctgtttgattacaaaagtgaatatcactgactgttctaaactatttatacagatttagggtcagattcatgaatattgccctcagggcctgatgaatttctcactagattaaattatcttctctcctccctaatatatgatggttgcatgctttggtcccaccaaaataattaattaggagtaaacaaacgcagagaatcaattatttctctcccgaaaaaatcaacaagtaaattttcagatgcaaagccatagggaaaaaaaagcaatgcgcctctagctcactttttcgaccaatatcgacgacatacatctacatttttttaggaacaagaagcaacaaccaagggagaaataatcctaatcgtatcaaacaggagaatgatgcaagcaacttccacttctcggtttatttaagcatataatttcgctttttatactactccttggtgaagttgttcatcaacaaagtgatatatcaaagctcttgcctcttggacaatatattcactattgtcaggtatttgggtgctgtcggttgatttttgagtacttagtcgaggcgtcctgatagtgcgtgctttgccaccagaaatttgttaattgatattttatataattattttggaagggtaatgcatgccaacttcttttaagaaacatagtataaacacaagcgctcatatacacacgcgtacaattatccatagaaaacatattcgagagactgagctaatgatatatcttcaaattaacgaaatcaccataaacgcctcgctatcgatgggaacgtcgcctacttcaaaaataattagccgtaaatatgagacccatgtgaagtctaggtcttgaacctaggcgtgggcaattaagttccaccatacgtaactaaccagccacactcactaattgcagataatgtggaccccctcttccctcttcttaactcattttttccatatattggttgagataacatgtagtatataaataataaataaactattgtaacttttcaattatatatacaatttttttattcgaccacaattaaatcaatccatatttactatatttttatttagaaaaaaataaatattatttttatccatgatcgatttgaccctttgcgttatgtctaacagaaaaaaaaaacgaaaacaaaggttatagtgtcatagatcacgttataatcataaatactaaaactaactctaagacgtttgaaaataaagtttattagtatattatattatttaccattaacttaatttatgatctatattaaccatactttaatctgtaaagtaaaattatattttaggtcatattttcattctttttctgtagtccaaacggacatgaaaattataaaaaagatgacaatatagactatatatcactatatattctttatcggttataaaaatatgtaccactaaattagatttacaatatcaacaagaaacatgtcatatctttgcgttttacatggcatttgagaaaacaattcaatgatatgggtaaaatcatcacataaatatgcgactatgtagggtgcactatattcggcccatatcagttcacaaatatgcacgactaaattagatttacaatgcaacaagtagcaggtcacatccggggccttgcatggcaattgagaattatgacaaatcatgataaaaattaacaatatagattatatgatcatataaatatgagataatccaagaaatgccattaacaagcgtccaaatcccaaaaatgccatcgacaagtgtgagttataagaaatgccatcatacaaacgactttgtcccaaaaataccatcgccgttagggttccatctattctttgccgttaagttctataggatgaacagtgtatttaatagcacaaaatggacgaaatcctaatggcaatggtatttttgggacaaaatcgtttatacgatggcatttcttggaactcacacttgtcgatggcatttctgggacttgaacgcttgtcaatggcatttcttagattatctctataaatattgttatcatgtggattccaatctatccagactatacggggataatctaaaatgccaattctatttaccaaatcatgtgtaaattctacattttgtagactacaccctaaataagaagtaaaataacagatggagtacacgtcatgttcttccccccttgatttctattaaatacgtatggtgtgtgggtattttgtacatactaagtttggttaattagggaacataaaccatactaaagttatatatgagaattcatgcattaaaaatacaatctcatacaaattattgataaaaacatgttcataataaagtaaaaaatattttaagaaatactcatccatacataaatattcataattaaaatacaagcaacattaaataaggtgctcgcgcatgtgtgcaggttaccttcctaattattatatactaaaagtccattaaattttctataaacgctctcaagccaccacatgtgactcctacaaacactcctaagtcaccacgtggcattctaataaattagaggaattcctaataattctcaaaaaatctaaccattgattttactttaaatacagtggacccactattttccaccattggatttaccttaataagaaaaagctaacaaaacgaaaaggcccacaagttacatgcaccagtgcacgtatgtatgccatacctcctcccctactactcttcatgaaaatatattttgtgataataaattccaaacaattatacgatctaaatcatatagccaatgttttaccacgttcatcattagattatttacaacaaaatttataattcaacacccaaacgctatatttaataagtaaaagaactaaaacacatttatatgaaaaatcatatagatactttaatgatctatttaacaacacatagcttttaatagaacaatatgcaacacataaagtcaatttataatgttataataataagcaatttaattagaaaatagatatttaacaagtatgttactttgggtcattattattttataaatatagaaaactcaaattggtaaaaccattggatctatctcaaaggaaacaaaacttctcccctcctcatgttgtatgtacatatgcatgtcttctggaaacaagatcagaatacatacatctattatatctttattgatccatatgtagatacatataacaaattgcgttaatgtgaaccaattaaaaggagtgctagcttgatggtacattattaagaataatagtttttcgagatttgtaaaaaagaagccccaaaacattcaatttaaaacaaaaaaaacaccttacttttaatttgaacttaatttgttagacattttttttgtaaacaaaataagtctaccttatttttaaattatgaagcagaaagtaataattaattaattatatggatgaattaaatattgcgtagtataaagataacaaataccaaagaaaacttatttaagaaatgccgacaaataaatttatgaaataaaacgtacttctgaagcttggcaagtgctacatgtttaatattcaatccttataagtttctcaaatgcagcttatgatatacatgcccgcgtgaatgcacgggttacattctagttcgttttaacaatcaagtaaataatttgaaaagaactaagcctcaacacgtggagagaaagagtgacatgatataaatgtttggatttggattaaattacttttagtggctttttggtggcacagtgggtaaattttgaagttgtactagattacttaaagaattagctatagaactcccggtaaaaaaattataacaatttgtttgaacaatcaagtactaatttgaaaagagcttagcctcaacatgcgacgagaaaaagcgacacgacagaaatgtttggatttggattaaattattcttagtggcttttggtggcacagtgggcagattttgaagttactatattaggaattagctatagatctttcgataaagaaattataactatatatatactataattctagtgtaactaaattgaaattgcatgtaattattagaaagatgtgcttagattagattgttgaatgtgctacacagctactggctcacaaggtctcgggttaattagatccttcctcctatcctcttgtcaaaatcagtatagttaagtggtggtatcaatctatctatttattatatatagggattattatattatttaaaatatcttaaaaagaagccaccatattttctacggagactagaaattcccacatctatgtctatacctaattaaaaaatacgtaaggctttgcttccgtaacctttttcgtctgtcattgtctctcagccggtccagttctgtttttctctccctccctggccacaatctctctccctcttgatctttttccctttttctctccctcttgaatcttcttccgtattttttacaaggattccgtatatttttatgagtccgatccactgactgcgtgcttcacgcgccttcagccgccactcaggccgaacctagtgccaccgccacgttgatctacctccccgtgcgtttcctcttcaaattaattgcaaataacgattccacactcatccctcatcattttcccatgattttccctttcaattcagcttttatgggccagatttaatcttcatttataatggtcgtcaatgatggttagccagtgagcttccgtgggcccttttttctcgagttctatggattcgcatcaatttttggggaaatagaaagaggagattgaatggatcaaaagccctcaaacaatttttggagatcaaaagagatttagccggatttgatgtgcaggatcggttcaagcatcataggggcatgggactcttattcagaggttaaagacgctactgaaacgcgagggtgtggcttggcagcgagaggaggccaatgtttcaatttattgctcaattcctaatagctattgtatcacttagaaaacgtctgtacccattgcaatgcatgggcattttttatagttaattaaagaagaagaaaatatttaatccattaaaccgtgatgatcaaaattataacagtgtagattgatcgatataattgtacatatagtaacatgagctaggagttgtatatgatattcaaatttattttaaaaatatatatagtagaaaatacaattgtatcttaaaacagaatttaagtatatcgaatctaattctattcttagcaatttgcgtaggacaatcccacctaggtgtttcaatatgaaaaccaagaacttaactcagcacttgaaaatagaaaaaacagttttgttatacatttgtcgacaaactatctcctaaaaagttgacagatgtaaacagtgtaatcgtagtgtaattatattgtaacttgcatgtaactttataaaaatcttgtgataacatgctattttcacgaagcggaggtcatgataccaaaccctcttacttgtgtgtgcgttttgatttttgcttcttcacttgcacagatcttaaagcaaatctaatggtttcaaaatcacatgaaagttacatatcaattacgttgtaattacatgtaataagttataatgtaattacattactattgtactatatttacatttgacaaatttccaagagaaatgtatagatagtccctagtaaaaaaaaattacagtgtactccctccggttccatagttcttgatgttttggacaatgacacagtcttcaactatatgtttgactttgtttttatactataatatatacaataaataaatgtgtatgtctacttttttatatagtactttgaaagataaatctatatatgttattccagatcgtttagttcactaaacatttttaaagttactgatacttaaagttacaaaagtttaatcttaaccttgtccaaaacatcatgaattacggagggagtactaaagtaccagggctctatctagttattgaggccttgtttagatcaaaaaattatggccaaaaacatcacatcaaatgtttggacatatatatgcgtggggcactaaatgtgggaaaaacaaaccaattgcacagtttgtatgtaaattgcgagacgaatcttttgagcctaattacaccatgatttgacaatgtgatgctacagtaaatatttgttaatgacggattaattaggcttaataaatttgtttagcagtttacaggcggaatctgtaatttgttttgttattagtctacgattaattaggcttcaaatatgtgctcatatactttaaaaactttacacgtacccaaagaactaaacacaccctgattgcctttttggatatgcgtaacaagtatgggtaaactacactaattgtcggactgccttacatcttccaattaatattggcattatatctcccttggtgttttagttcctgagaaatatttttcctcaaatgtggaccaacaaatttgaccgctagtaaagaaaccttcagtgttgctgcaaagtccttatgcgatatatgtcgatcgattatgatcactaattcacgaccaggtcagtgttcatgaaatacaaaattctcaaagtgtccagaactcactaataaattaggcttgaaattaaaaccttgcagttattctgccgggatgtgtactagtacgatatagacgggagattgagttgcccatggtttgcccctttatgaatgaagctgatcgacttcgaatcactgtcgctattgcatttcggcatatcatcctggggccaactataggaagaagtagaataaattaagacatgtcatttggagtcaagtagagcttagggtgtgtttagatctataggtgtaaagttttgacgtgtcacattagatattatatagggtatcgcatggggtgttggggcactaataaaaaaactaattatagaatccgatagtaaaccgtgagacgaatttattaagcctaattaaaccgtcattagcgtatgtttactgtacaattagttatttttttagcctatatttaatacttcatacaggtgctcaaacgttcgatgtgacagggtataaaattttagggtagaatctaaacacccccttactatttaatattattgccaatgtctatttcgagcaaagttggagatagggactcataaggaacacacgcgcctactgccttctctataattgacttgattttgctggacaatgacatgcatggctactcatttgaatagcaaattctaacggggccatctatatcattgtagggcttagttgcatcatattttggtatcatctttgctcggcaattagatctataactatatgggctctagagtctagactagtagggcatggctcgtcagtaccgtataattgtaacggtcaaacaaacactaaactagtaaattctcaacggggccatctatgtcactcatatttttaaatgtgtatataatatggaataaactgcactagtattatctggatgtcctactttcaactcaccttgctgntatatttccttgtatcatatccctggggcggaagaatggaacaaggcagcttcagtgggacttttttttccgcatgtatcagtgggttatgcccctctggcgacgtaatttggagtaaagctaaagaaaatgtccctcctacaatatatacaacttgaattctttaacttctgaggaagtggcacactaatacataattatctttgcagacctaccctgtttatttttacaaacagactataagaaaacctgcatgcaaaaacatttcagggttgtctagtaagacccgcatgtgaaaatcaatttttataaacaggtctctaaacatagccgctagtgtaaatacgtttatttttacaagcgactatattaagatgccgcatgcaggtatacgcctcgattttcacccgcgttagaaaatcacatctcaattttctctcaccctcagcttaaaagtcaatgtccatcatcctctcatctactcccatctcttctcctccacacatccactccctctctgtcccctatctcttttcctaccggtcggtgacgaccagcgttagcaagggagcagcgccagtgacaagagtgcatgcgcattcctcggctcctccttctcctctctctcctctctccctccctctcactcctatccgaccaactcgggcttaggctggacagagggttgaggcgtatgtaatactgttgtttgataacaataagtcaagttggagataccttggtctcagaatatggtttctttgtttgattcatgtgtaggtgacttgatgcctcgggagagtattgccggtgatggatcgggagtcgacttggggataaggcgacgtccgtgacggtcagatatcatgcgggatacttaagctagagttcaatgcacgtggttggtgaagattacatatggcatacgatggaggtattgtgtgcatatgggatgcggaatcgaatttggaaggagtccgaatttggaatgattggagtttgtaaagtttgtttcttgtacaggacggtttcctaggtggat

SEQ ID NO: 79505 - DNA, 76576 bp, Oryza sativa
  unsure (1)..(76576): unsure at all n locations
gtcgtgcggactggccacgacggctcgcgggtgattcttggcgagatctccggccacaagctgtggaagaaagactacgcggccgccgcggaggcgatggcgaccatgtcggcgatggacttcgccaccggcgtcgacgagagcgggccgtcgcctaccgccaccgccgccgccgccgctggcaatgtcggcggcggcggcgcgcgtgcgcggatggggagcgtcgaggaggagatcgcgcctgtgccgaggctgacgaggttcagcagcaggaagatcgggttctcggcgagcttggcgaacatgatcatggtgagccaccggaagaaccgggtgctgacctgcaaggcgacgagctcgctcgccgccgtcatggcgcagatgctgtcgcacagggccacgcatctctgggtcgtcgaggatggcgacgccgacaaaggcgccgtcttggttggcatgattgggtacatggagatcctcagggcggtcactagaggtgttgttgtccctccggcttgactgctggctgcaaatccagtttggattaaacaaattttggtagattttattgtttgttgagatgtttttggagatggtattgttttcttgtttgagttagtaattagaatgtgttaattagctgtacagttattataattgttttgcttagatgggtgagtgatgaactgactaagtgatctgaattataaaagggattgcccaatgggcaatggcagctgtttttgtaactgtgaagtttctccatatttgagcagatatttcagttctgttatcttctgactatttcagacagcttgttactcgagcttcattcaggggttcaggcaatgcaagaaaaattcagtgagcaattcagatacgcatagttcagatagaaagactacaaaatgtcttacgtaaccacttccgtaataatggtgaacactgaataatacaacggtaatttaaatacatctggcaaggaaaaggcacattctgctagtaactgaatggtattgttgttgcacaggtacgaggtggtttgatagtatcccacgctaatccttccttagctcaatgaactcacggtgagagccggcgctgttgatgacaacaatctccagtttatctccctgcaaaattcatggaacaaaattagaatttgaatcaatactgtttagttggccactagtgattaacttcgagcaaccaaagagatttaaatcatcatacagtgtatatgtctcgttctgtggctgatgcaaaaacgtccttaaccagatcgacagcatctgattgagataatggtgtcactgcatcctgcataataacagtgaattattagagctctcattcgtcagaagaaacatacttgtatctcataaacgaattatattgttttgttttcacaattcttctagagagtcaagcactagctgaaattatataactcacccgagctggaagtagtaatgggctaggagattttagctgattgtccagaacaggcatcatcaaagctgcacctgtcccctgagcactataacctgtcctttcataagacccaacagcatcatatgtgaagacacatcctttacctgcaaaagaagaaaagatattctcacaggtcgtgatcatacgttcatactgatgagcggccactgtaagaggtaaagaagtaaccccaaatcataccttcgctgtcaagtccacccaacacattgaaggcatagtatgggaagaaccttttgtagtagagcgtgttggacagtaattgcgccatcgcagggcagctcattttcttgttatggttgtgttcataaagctataaaagcagaaatgatcataagcttgtactgaatagaaacactgttcatgatcaaaactttgaataaacaaagaaccatgtaaaagatcagataatcttcagggtcagggcagatagtagatcagattattgcgataaagttgtcgaaaatgtggttaatcatgaaaatttcttgcagttacagatggttttagagaattgttcagacttaccaattccttggcagtaaggttcctctgcaaagctttaacatcaccttgaaatccagatgaggccaaaacacatttatccgctctaattgaaggtttagggaaacggcattagcactttattcagaaaaaaaaagagagagagctttccaacaaatatgttatgcgcagctgcgtcgtgattatttggtagcaatattttaagggatagtttgcagaagttactataggaaagtttgtgcactgaaacagaggatttgggctgaaccttcatccaacgatacattcagattcaatttactcctcacgtataatttcgggtgcagaaaatcaacatcagtaatactacccaataaattcatgcgcactccacaaaatttcagctaggcctattttatttttttcaaattcacaacatatgcagtctcttcccttcccttctaaaaagaaaacatgtgaaatctctgtctctctggtaattaaaaaccacaaattcatccctagcaacgcatccatgattgactaactgactaactaacaaactaactataagcgggggattaatcagaatcgccgaatccaaccgagtccaattcgcaaatcggaccacacatcatcaaacgtgagtaggtaggtaggaaggagggtttggaaaacatacaggtgggcgatcttggagctgtcgcggctgaggatgctgtatccgacggagaggcgcgtgtcggcggcgaccacgcagtagtcggcgccggcgacggccacgcacgtgccgccgttgttctcgtacacctcgaacctcgccatcgatctctctccctcgctctcgctcctcctccttctcccgccgcctcagctccctcaccaacctcaaacctcggcgtctctctctctccctcaggctggcgcggcgcggtggcgcggtgcgttgcggcgaggcggacgggcggcgagtgcggcggcgatcgggcggggcggggcggcgcggcgtcgcggggaggctagttttatttcggctcggcttcttcttcttcttcttcttgtgctgcaagaagagggagaccggctcggaggttgcttcgccagtgggccgagtccgagtcgcggaagaagctaagagaggctcggtccggcccggaacggcccgtcttggagttggctggaaaactgggggccgtaagagatgtttgggcttaaaagcccggcctacaattgggccggtttatatgctcttcatcggcctaggggaagctagcttagcccatggccatagatgaacgtttttgcttgtttgtttttactcttttaacattaaccgattttgctatcgatcactagcgtgatttttttttgctgacatttcacgttttttttgcagcctcgtcagctggcgtgtcggacaccagcacgtcagccttcgtgtctgtgtctagctagcccaagcgcacacgataatggagattggagaagcacggtaacacagtggcctctgaccggcgagccagccgccggtagcacggccaatactgatcagcgagagacaccgttcctctcgtcatagtcatgaaatataaaattacagtcctatataactaaaattacatttgtaaatttagttgatttgataggtaagtgtactgtaattttgataaaaaataatgtgtaagtaaatatgtacttattattttctttaaaatataaaattacagtcctatataactaaaattacatttgtaaatttagttgatttaacatgtaagtgcattgtaattttgataataataatatgtaagtaaatatgtacttattattttctttaaaatataaaattacagtcttatataactaaaattacatttgtaaatttagttgcactgtaattttgataataatattgtgtaaataaatttgcattagttattttatttcaaatataaaattacagtcctatataactaaaattacatatgtaaatttcgttgatatgacatataagtgcactgtaattttgaaaaaaatgttgtgtaagtaaatttgtattagttattttattttgtaattcgttggatgcaaatccaaggaaagaaaaaatctgggtgattttatctcaaaaatcacccgagtgatgcataggcggtcccaacattaacattttattatctcggttttcattagcatactctttaaactgctaaacgatgtatttcatgcgaaaattttctatacataagatactttaaaatattagataattcaatttcatgtttaaaataattaaaactcaactaactatacggtaatgactttcccttatgtgcccatagttcatctttatctgacatgaattcgaatggggctaagttactaaagtttaatagtagtagtagcttattgataccattcgtgtaagttgcaagattaatatagtcccactttcctagggcaaagacaatataaggtcccttattagttgtatcgttttgggacaattaaattttgcaagaatttcacatgaaaaccttgatttttttttggtatgtacgatatgaagtttagattggataacccagattaatctgagagcctcatcggttgcctgtattacctaataagccaaaacagtttactaggaaataaaaattaatttataggtaatttttttaatatatttgttcataacgatttaaaagtcaatgctaaaaatagtttgcattgaaaacatcttaaaatcaacttcagaattaagtttgaaaattcaaattttaatttttgctttggcttattatgccaaccgatgaggctctgaaataggggcttttaactatttgccacttttagatttggcaaaaaactacttgtcacccctatctcaatgacatgtgggtccacatgtgtctatgacatgtgggcacagtggcaaaaagttaattgctgcatctaaatgtggcaaaaagttaattgctgcatctaaatgtggcaaatggttaaatatctcctgaaatacgtgcaactcagtgaattttatgtaaaccagctgggatgttttcatttgatcagccaaggcgtccaccttggtacgcacacagcgatcattttcttttctaaagtgtatatgactctatgagcaactgggttgaggtccgcgtcacatcgagtgggcagaacggtggaacagctcagctcccctgcagccaaaaacaaattcagttcaccagcaaaagaacacctgggtttaaacaactccgttctttaacgtcaaaggagatttactagtctatttctcgagccatgacgccaactgctttcttttgctttagttgccaggttttaatcttgtccgtgaatggaaagatcaaagtttgtgctaaatttggtttagaggagccaccactgttaagttagtgcgctgacctacctgcaggctagctcctctttaaaattctctccctttttcattgccatccaacatgttttgatcagacttctcttgtttcaggatgaaaagattgtttgccaaagcagtagccgtctatatatgtgctagcttacttgtttccgttcatcttttcattcttttcgcttcacagaatctctgagttgagtctcattgtaaagtcaccatgcttcatactagtttatagccctcattttaaaaaaaatctcttggtatggtaaaaaacagctagagccgttgtttgcatcttgtctttctctctctgttctttttttaaatctcccatggcggcctagttgcaatttccttttttctttcacttttcacagcttatgtcaaaaccattagcaacagaggtagtaggagcttgcaaatggcagatgaactaaatgatcagaattcagagcataaattcttgcgtgtgggatcaaatttttcttcaggtggatgctcggatatgttggggtagtagtactagtttctttggagtttgtaggacaagttgatcgaagccactcatcaatggtaagcatgtgctgatctgctctcggatagtggagttctgacgcaggaaaacatattcgtagggctattttgaaacgtaggaaaaaaacatataagaataggaaaattgtagaaataaaataattcacggctcatttaatactactggaggtgaattcacaagtatttgtaaaaaatgttgttacctagcactacatgaaaacataggaattttaagagaaaacatgtggtcatgtctctttctaatttttttttaaagataagcctcgaaagagcacagagagcacatgtttttattcaagaataaaatgttttgtctagtttttagggaaaattgggcccaaaaatctcacgtctgacgtctctttctaattttcctttaaaatacttatgaaattagctatcccatagaaatttcaaaatattttgtggaggtcatttcttcgttttaaaggggcatgtagaaattatttccaatggatttcaatcctccaaaatccctccattttttcccatgttcccaagcagccaacattctctcaaatgctacaatgaaatcaacatcgcagttctgaacatcaatgcgtccgtgcgtgcgtctctgtcgttcacgtttcccaggttaactattaccaacctcccgacttcgattcgatcactccctgtctctgtagcactaatgcgaaaatgctaagcttagctttgtcagatcagaatcaaattcgcatgtaaatatgtgagttcaatccgatcgctcaccgtgtctctaccacaagtgcgaaatgctttgctagcttgtcagatcagaatcaaattcgcacgtaatatattcaggtctacgtcgagcgtaatcaatcgaactatcggtctagcgcagcgcttgtttgtcgttccctgggttgaaggtgtcgtttcaagctttttgaatgaaaaatctagctctggctgcattacattcaccggatcttcataaatgtgttgtttaagagtagtcttagacttggtgtactcgtcctggatgtacgagagtgagctgccgcgagtgatttgcatctttgtgttagcttctttttctctctctttttgcgcatgatagatgcagagcagcagaggcacggtgtaaatttatcttttaattgaaatatatcctacgattaaaaaatctattaattgatttgtacttgcatcatccccttcttgcatccattcatttcacctaaataattatatatttttataaaaaaataacaagataaatttatatgatatatatcacttcacagatactcttgaacaaattctttaagttataacaaatataactgtggatatgtatactagtttcagtttattttattccttttattacaacttacatattttaaacttacatatttatggagcggtatgtataatattaatctattttatcaatttattttttatgaccatggcataaaaaaataagtggatgtcctgttgaggatgaaattccatctccaacgcattgcttatatatatgagatgttttacggtgtttgcgaggtacatagaggtacttggagggggaacaacgtgcaccgttgatcaagagaggggcaaggtacggaacaaattttgtaacatgatggcagttgagtaattaacttgtaaaacatgggcattatactttaattgaatactaaaatccatcgatcggtatgccatcagaaaaaagagtaaatctaacatccatcgatcggtatgccataaaaaaagagtaaatcacggatatccgatcgatctataccagatcgcatcgtcttctttccctgctttgttcttgttctagggtttgaacgtttcaccgaaaggagacagggttcaccaaaaggagacaagagggaaaaatgtaggcatggttgagggttgaataggagactagatcgcctggtcgacgactagctaggctcaaactagcgcaatataacaatataacacaatataaatctcttgctggaaataaaatataattttcaacagaattaaggtaggagtttttacgtattcattggaataaaatgtaaatgtagaaaaaatcacataattaggccaataatgtgttataagaacacaatataaatctagacttcaatacaacgtaaatttacaaaaaaaccatgcaaaatggaaaattaaatcctagtgccgcggtaaacgacttaactccaatacaacgtaaatctacaagaaaccacgcaaaacaaaaaattaaatcatgcagatagaggttttacggtgttaacgcgtaccgttatacctatgcggtaccttttataatttgagagacgattctacccttttctctctactagtaaaattatgtttttatccttagtacctaagtacctatatcaatacttaaatatctttaacatggtacctgtgattgaggagcgttggatctttacctcttttggaatgcaaacaccataaaacctctctatatatattcagctagaaatctgtaccagtgtgcaccaccattcattcgagtagaggtggaaaaaaaaactcgaagcttgtgacttggatcaattcaaactcatagtcttaatgagtcgatccgagctccgtttagctcgtgagcttaatgagctagcttgaactactcaagcttgagtttagctcgtttgtaaatgatatcatcatatctttgtatacttagtgcttgttaactagtccttcatttttttaattacatcaaaactatttgtatttagtgagtttaatgtttattatgttaatatattacaaaatcataattttgaaattattaacatgatataaatgagatagagctcgttaaccaggctaacgagcttaacgagccatctcgcaagtcaagccgagctagcctcttagctccgaggaattttgcgattcctcgaggtacttaaattttacactattacttttagtatcttaaggtacttactatctatactatctagaggtatcgaattttacacgtatctctgtaaaaattacctttcagctcatcaaaattaacaaactgagacgaactagctcattaaaataactgagttcaaacgagccaagctggcctaaattccatggtaaaagctattagctagcaatgtctccaccacgtcgatatcgatcgagtgcaccctccatttactaattacttccatattaaagctatcatcaatccatccaatatccatcgtgcactgacgaaaccagctgcattctgctcccagtaagaatcagaactcaattcctccacatatatgctctgcaaactgcaactctgcaactgcatccatcgattgatagatacatgcacatagctgcatctgcatttgtttgttcctgtcacctttgtaccatccaattccaaccccacatttcatcctcgatctttctggtttgccgagccaaacagagcaagcacagctagtagctagccaatattcagataagagagtggagtcaggaactcattagaagagacatctttaatttgctcatggccattgggacccaatcacccaacacatttgataattgatactccattttgattcctcttcttccccagctctagctatatataaaccactccaatggcagcacacaaattcatgaattcccagttcagagtttcaggtactctcaatctgaaacatatagaggagctagtagcaaagagaagtaattagagtgagcttaagtagtaattaattagaggaggttaattaattagggaagatgataggatggggagatgtgtacaaggtggtgggggcaatggcgccgctgtacttcgcgctggggctagggtacgggtcggtgaggtggtggaggttcttcacggcggagcagtgcgccgccatcaacaccatggtggtctacttctccatgcccttcttcaccttcgacttcgtcgtccgcaccgacccgttcgccatgaactaccgcgtcatcgccgccgacgcggtgtccaaggcgatcgccatcgccgccatggcggcgtgggcgcgcacgcgctgcggctgcgccgccgccaaggccggggcgcagtcgtggtccatcaccgggttctccctcgccgcgctcaacaacacgctcgtcgtcggcgtgccgctgctcgacgccatgtacgggaggtgggcgcaggacctcgtggtgcagatcgccgtcgtgcagtccatggtgtggttcccgctcctgctcatggcgttcgagctccgcaaggcctgggtcgtcggcggcggcggcggcgtcgggccggcggtgatgtcgtcgtcgtcgccgccggagaagcagagcgacgtcgagatgaacggcgccgtcgtcgcggcgccgggcggcggcggcggcgtccggctaccgttctgggcgacggcgaggacggtggggctgaagctggcgaggaacccgaacgtgtacgccagcgttctcggcgtcgtgtgggcgtgcatcgcgtacaggtatatacgcgtcagccatgcattgcatgcgccatcgccatcgccatcgccgtgaagtgaaactcaagtttctactagcttcttgacgtcgccgtcgccggtgaacatgcatgcaggtggcacctgagcttgccggggatcgtgacggggtcgctgcaggtgatgtccaggactggcacggggatgtccatgttcagcatgggtaagctagcatcggcataaagtttttctttttctgaatagccgaataattttgcgttataaagttggaaaataggtttaaagctgttgcaaaaatcgcaccatttaggaggccagttgcagggttcaaaatcccgataccagatcgaagtccactcacgggcggtttctttggatttcacataatccataaaaagggataaaaactgatgaaatccgaataaattttaccaaaagaattaaaacttagtttaatttttttaaaacttagatcgaaaaaccgagcggtatgtgttttcgacccagttcgaaaagttcagatttcacgtaattcgaactagattctactggatttatgtttgatgattcaagttgttagagaaatgttgttgcaataatggttgttgttgcatatgctgaataattgctgatggatatcatatgtagtgattggatatgatatatgatgagatgcagggttgttcatggggcagcaggagagggtgatagcgtgcggggcggggctgacggcgctggggatggcgctgcggttcgtcgccggtccgctcgccacgctcgtcggcgccgccgccctcggcctccgcggcgacgtcctgcacctcgccatcatacaggtacacctccttaattttgccttgtcgggaacacaaactgttcacgtcacatcgccggcgcttttcgccgtgtacttagatacatgcaggggaaagtgatttcgtgtacacaatttagcttgatagactaatataaaatataccactccacaaatatacaaattgaattttttttatttacaagttgtaaaaaaacaaatatagatgcggatgtacgataaatattttaagtttaatttgttttttttctaatttgtaaaagtcgaatttagtcttgtttgtcttgaaatgatatattttatattaatctatattattaatttttttataactatttagatgatatgaaaaaacaacgagatattttctcgacagtggtaatttagtttcgccttttgctttcactagtttatctcttctccgatctcaattaaataaactatatatatccggcttcctagagaaaacaaatgagctcgagaggtcggcagctagtgcatgctaactgcagatcacttcgatttgtcgcttttctgaaactcttgtttcgtgctaaccagtgagcaactaagcaacttggtgagtggtatatacgtacccaacttttcacattggggatgtgtatgtgtagtgcatcagcagcagtaaacgaactagctagtgtgccatgcatgcatggatacaccagataagtcacaagtatatatcgtggcttgcatttcaggagtttggaaattttcaaaaatcagtcatcactctcttcttgtccatatattggatgatattttcaatggttctcatctcccctgtattactaatttaaacaaagttaatcccttctttagataaaatgataaaaggttgaacaataaattattctaactgataaaaataatacaaaattacattttcttttactgtaatgcaaaattacatttataattcaatataacaccgagattccagataaattaaactaaaattgcacatcgcataacaatgcaattttaggctttagcaatgtgtaattgcaagcgacaaattttaacgcccctgaaatctaacaaatatgtaaggtgcttaaagttttaaaatttcagccacctttttcatctcttaaatgataatcctcatcactcctaagtcactactccttaaaagaggtttaatactcctacttctttgaacttttttaaaatgatgtaaactatttttttctttttcgaaatggcttgtgggttcatgacttcattctactccatatatatggtgaaatttaactgctagtgctaaaaagagaggtatttagaggttctatgcatacacacgcatgtataagacattagcatgcattccgatcttaattaatactgatcatgtaatcaattttcatgtacatatatgcaggccgcactgcctcaatcgattgcttccttcgttttcgcaaaggagtatgggcttcatgccgatgtactcagcacggcgtaagttaattaattttcattaatttagtatcaacctgatgattaattatgccgtacgagttttccttaactgcgttggattatagattaattacagtatcagtctgccgttgaagtactaataacttgattaatcactaacgaaaatctaattttgaatgcagggttatattcggaacattgatctctctgccgattctgattgcatattacgcggttctgggctttgtctaacatgcatttacagcacggcatgcttacttatattagatttgcttcggtccaacaaaaattatctcgagataccgatacctcacggtaccgataactcatctgctcagctagatccaacgatcgaaaataatttggtaccgtgaggtaccggtatttcgagatactttttgttggacgataacaaacctctaattacattggatgctgagatctaaaccaatgtggagcgtcaatgacgcaacagaaggatgttaattaatcagagtacttcagcaatagagagtttcagtgttgcaagctctgattaatgatctaatattccaattagtcgatattgtatttcgagcaaagtaaataataaagttttcaacagttttgctacctaatattactgtacgttggagcaccagggaaattaccatacacgtcgagatcgctttgtgagcatgtgtgcaaaattcgtgtgtttaaggtctccccaatttaaaatgaaagaatttcatgggattttcattggaaacgaactaaaatcctgtattcagaaagccttatttttctattataggaaattcggtatttgcttcaaaagaagctgtttacaaagtcaccagctcatcaaatgactacaaataacagtacacgtgatgacaaaagaaaaaaaaaggttaattatgtctctagccttttttttatttttgaagaaaaattctctagctttcattaggaagaaggacgatggaaaaagctcaatttattggtacaaagttcccattgcctccaaagcagaggcggattacgtagacaactagccatgcacactctttttttttagggaaagtcattcagcgagctttattcattagacaaaatggttacattgttcactaacaaattcaggataaagctaggtgattcatcaacccaaatatcagaatactagctatgcacacttggtttaacactatcaagctacatttggtaaaacaggtttttagctctatccaacaaaccggtttcatggttgcctatcgaccactccatcaaagattacacagttacactccttttttccaaaataaataattttttatatacaaatctagacatatactccatattcagattcatatacaaaagttaacttattttaaaacagaggagtgagtcattccacaacgcaagttcaccatttccccgtcaagaggaaaaataaatgcagtcacatcaatcgctccaccaaaaatcaagctcaaaattagtctgtacataaaagaaaaaaacaaattcagacgtgaataataccggcctcgtttacatatacgctaggtttgtttttcttatctttatgtgtgaattgagtttaaatgaaataattttgtggagtggtatatacatattgttaaattttttaaagattttttatatatactggaaaaaaatgcccgtgcgttatattggatgaaggctattttagttttattattaatgttatccagtttaactagggtgaaaattattgtaggaattggcttggatattttttaaaaaaaaatcatgagttgtaattaggagttcaactctttcaagttagcatgtgagtttttttaaatgattccttatacgactatttttgtatttccaaaagcgtcccaagttggcatgcgagttttttttaaagagatttcacgtcttttttatttcctaaagcaaacgaatctgcaaaccgactcaaacacatatatgtattttcaaaagcgaatgagcattaaaaaccaagtcaaacacgaatgacctatcaaattatcggtaaaaatatcttcaatttttataatagtagagatttagatggtaaggatgatccactcgagcgattaaaatagtttaccatacattctcaaataaaaaaatcacataaagaaactgaatttgctcaaagtgattcacatttgttccgaccgatctgcaggaggcacacagctcaccgatagatatatgatcctattggctactatctgaaaatgcggcagattaaagtaggcatgttcttcagtggtgcgatgcgtacagcttagtacgtaccaactcgatcgatcgatcagcttcagaccggccattggtgccactcccgtcgacggtgactcactcattatccatccatccatatctcgtcgatcggtcgaccatcttgatccgtagcgtacttgtgtttctactgggaaatcatcacggcgcgcactacacgtacttcctctatctcacttaaaacaaatctagaactgagcttatctcatgttcgttgtaatatatcatacctaatcatagatttttttttatgacgaaggggtacgtatcagtagtatcacacgacggcaaactgaagaggtggatacgttctaagagttttgtggttggttacttgctcgattttcatcatcacgcttttcgaacggttaaacaggctgggtgtttcggatgaaaccttttctagaaattattttagaaaattaaataaatccatttttaggtttataataatcaatgcttaattaataatatactaatctttttttttgttttgcgtgcatctgctaaacatccgttttagaacgcactttagacacgcggccgtagtgtagtgcgttcctggcgtgaaatgcacaacgtacgtacgcgagcgcgtacgacgctggctgatcatggcctttgcactttgcaggcacaagtgcaccacctcatccatacacgaaacacggtacaacatctatacgggctgtttttttttttctaaaactgtttggtgatcaacaccgtcgtgtcgtgggctcgtggcctggtccatcaacttggctagcttgacgagaacagtagaccgaacgagaacagtagctcctgatgctacagaccgatcagtccagactccagagccgaccacagctggtgcagcgtgcttccgaattcagatgatcggtataccttgcttccgaatgtttgattcctcgagaaatccaagtggattatccacccatcgatcgagtacagtacagacagattccagaagaatttggcgccgacgggccagctttccctcaactcatcactcgccggctcccatcggttgcccatttgacctaaaatggcttattagaaaattaaaattaatttataagtaaaacttttgtagatttgttcgtagcgacttaaaagtcaacattaaccaaaaaaaaagttacgttaaaagcatttcaaaatcaacctcaaaatcaagtttaaaaattgaaattttgactcattctttggctatttagcccaaacgatggggctagccgagtcgccgtgccaggtcagcgagcgagctagcgagagatcaatctccactagggttccccaaacagttttggatgagattaccgtcaccccacaatttagtggttatcgcggtaaccgctcggttaccacgaaaactatgcgattaccacaaggtatactgtaatttcaaaaactgagaaaattacctcacgtgataactacacagttttataaaccctgatccccacccaggccgcgcgccagaccaccagtgcatcgacgagcatcaacttgtcggagctagggagcatccatgaccaaacatttgcagagcactcattcagttttcttctgtccaaggtttcaccctgcagcatgtagatttcagaacatatatatgaaggatgaacaactacacttcttcgagtacggcaaagtttcaaaatcttccaatcagcaaaatgctgtgaactttcgcgcttccagtctcaacaacactagacatacattctcaccccacacaacagtgagacatgaacccagctactaacataagttaaaatcctgtttccctatgtatttctccggattacatagctaagggtaaacacaggccagtaaagtacaacaggcttcaattcagttcagcgattgaagatgcgaatcattcttcagcagggccagaacggtgagaacagattatgccacggtccaggttacctctaggagagcaaagagaccagcgagacgaactccgatgttaccctgcctttcgatcttgtgttgatgacaaaatgttccggatacttcctcagcaatgcaaggagaccgtaccatggcctaccttttgtttcagttggcgaccagtcctctggtgaaaggtacttccggaccctgctgtggtgccacacattgccaaactgttcaagaagctgcaagtaaccaaacgagttagttacttagtttgcataccaagaaagaggaaacatgcttgagtgtaaaggtagcaagaaaaaagagatggctaggtgaaacgaagatctctccacaagtgcacatatgctaatgaaaatacatacaccaactgtgccagttgaacaaataagattgccatcgtagcattactgtactcatgatttatgctaattttttagatcactggttgaaggcaaagaggagaatcagaaaagatgacactatatgagagttctgacatttataggtacaacaacaaatggttaacgacaagcacaagagccaaacatttcaatctctccgggtgctggtgcaatccaagaaatgcccactgtggcaaatcgaaaaatctgagcttttccaagtaacagaaaacttttatcttttatttcttttccatatatttggactttggatgcaagctactactaataataacttagcagaagtaaacacattttaacactagttttcctcatgcatctgtccttgtttgttttgttagaataacaaagcctaactactgtgtttacatttaggcatcccatcactagcagaagcaactctctgagtatcagtacaaggttaagtgcaaaacatgttcaaagtgataagttgtatgtaatcatactattgtctagagtatgtctctggtgcttgtattggcaaacacatgcatttgaaatcctaacagtcctgtagctgagaggaccaaagttacatgtctatataattgttttgtctcctgactatcaacttatacacaccggcagaacaagatgcactataacccgtgttttagacaagacaccagattttacatggatatttgggatgctgtgtgttgatgacctgaatcatctggttcagattgcaggatcagctactatgatgattgacacggcagggatgctgtcatccaatttttatccccagacgacatcagccaacaagtccccttactgatcaagttttctcattgactgtgacggctccatttaatctttcgaatatatgttcattttatcatgcatttcaataaaataccattttcttcttgttttagcttgttttagttcacaaggcccattcctcaattttcgaaattatctaccccaaaacttgctttttccaagccaaaaggcagtgaagtttcacagaagacagggactaaaaagacatgccagagtataatctagcctctacctatactgtatagaaattggatgaaatatttaagttcatccgtgacaaacctctgtgtggagttttgccataggcatccattctccaggaccacagaggtcagataacactgttgcaacagatgacactacatccttttcttctgcttgcaggatgtgctggttatccatatccctgtcaccccttgatcttatttctgatctgctgtctgcacaaacaattaacaaaggaaggtggttaagatcagatcaaactataagatgtttcttcaatggcacagctatgaataaccagaacacacactaacagtccccaaagttgaatattcggagttggaaactggaaagggatagcaggggtgatccaaacttattccacaccatctagtaattcttagagtgaaatagaatatctcattctctccggctgataggagtagcacaggtaatgcatttaacttattgctgaacattcacattcatttacaaaaaatgagagatgtattacatttgctaattgaaagacgcacaccataaaatagtcttgttatactcaacttagacaacttagagaaaatacttattggcacaggctatgcaattgcatctaaaattggtatagtcttgttatactctatcttgcttatagtgtaaactgtacaatcttcattctgcccagtacagaaggttgaaataaccttatcttacattgatgaccctgagtttcattttcacaatgtaaatgaactgagcaaaaagtacagctatatttagtgatcgtctgattgatcaagcaaaatcgcatataatttatatcgaaacagcaacgccatcaatgcagaatcaacatgtactatcttttacaagaaaacaatgacaccaggataaaatggaaaggatatctagtaagagtggagagcaacgattaccaccttcaccgagtgtcccgattgcttcaacattgatccggtgcccgccatacatctccgactccgcggacagcttcttgttcctcttaatcaacttccccctcatcccaccactctcactgataccattcccaatctcatcaccctcccggccatagtcaccctcaaaggacctgtcatgaaattcagacagacgagggcggcctgtccgcacataggatggtggaggcatctgctgcgggatgataggcggatgccgagcagcggcggcggacgcgaagatggaccgggtgggcagcaagaagtagaacttcttgtccccaatctggagcagatcctgggaatccagcttcacggggtggttcccggggaggtggaggacgccctcgacgaggcacccgttcttgccgatcacgtcgagcgcgaagcggcggcgctggaagtcgtagaagatccgggcgtggtggcgcgagatgttcatcccgccgccgaggctggagaggtccacgtccaccgtcgacttcttgctgttgcgccccagcatgatcgagtaggtctgcatgtagtactcgaaatcctccccctggagcttcgcgaacccggcctccacctcgccgtcgccgcccgaggatcccgccggcatcgcgccaccgccaaggttggccatccaatccacgaaatcgacgaaatgatcctgagcttggcgtggcgttcgggcgcgggcaaggcggccggcggaggaggggaggctcaccggggtctggagtgtccggcggagggggcgcggctgcgtggcggcggagggaggcggccggccgccggcggcggcggcggaggatcgcctgggttggggaagtggggaattgggggacagacaggtagatggagaaggggaacactcacaggacaatcggattatgttttactacctctgtcttaaaaaaaaatctccaaccctaatttttcgaggtgaatataaaagaaccaaaatacccctaattaatagcaaagttatattatgagtgggtaggtgagggttactgaagataattttccaaggtgaatataaaagaaccaaaatacccctaattaatagcaaagttatattatggggtgggtaggtgaggggtattaaagattattttccaaggtgaatataaaaggaccaaaatacccctaattaatagcaaagttatattataggtgggtaggtgagagatattgaaaagataaaattctcgatttacagatcgatgataggcaaaaaggtagaaattggtttatttgaaaatgttataaaatatttatttaaaacagacggcaatcttgcttaacagacgacaatcttgcttaatcacttaatcatttaatcattttgtaatacaacgaatctgaataaaaagtatctcatacttcatccgtttcatattataagactttctagcattgcccacattcatatagatgttaatgaacctagacatatacatctatatgaatgtgagtaatgctagaaagttttatgatatgaaaccgagggagtatatctctaaggtttttttttctgagattgagggaagtgtctcatcaatttctaagttgattttgttagaccaagggaataattagcacgatatcctatgcaatctattatatactagtataatttttgcatgtcaaatataatcttgaatatcctatgtaatctattaggctctatttgagactgctgaaattgaaatgatctaatttttctagttgtctgaggagtcgaaatgttgttttagaataccatatagtttcttttacatgaggcataagcttagaagcgtgtaaacgaaaattcaaagtcgagaacacaaaaaacacgaccataattgaatacattgtatatttatcccgctgaagtcaaagcaacgaattgtcccctataaaatgaaacaaaaaataattataagtggtaaaattgcttgcaaccgcacaccctaacaccatattcgcacacatgtgagtgcgctctaataagaacatgtagttataatgacgaagaccaatgataactctcttatctcagtaaaatcttattagcaaaaaggcatatattttcttaaaaaacattggacaaacacatgtattcacaacacacacgtactcatccatacgaacgtatatatgcacactttacctcccaagcacaacaactatactgatatatattaagatttaagattgacgaactcattgcatatatctctgtattgacgggtacatcgtttaccgctaaaaattaattagccataaatacaaacaaccgtgggcaggtttcaccgccataactactcccttcgtcacataatatgagggattttagagggatgtgatacatccagtacatgtttagatttttagtaatatgatgtgttacatctcttcaaaatcttttatattttgggacggaggaagtaataagtatcttctgaatggatttattttaagtgtatttttaaggaaatgatgcgttgaaaaatgccaagcatttcatacagagtaacacccctattgggaaaaaaacgtttttcgccaaacatcccctctctctctctaatgtaatccaagagaaaaattggataaacaaaacgacgataaaataccataatgggattgagagggaacatgcagccctatcatatcgaaggaaaaaagagaaacaatatactatttgcaaatgaaaaaaaaaaatctgtgtataaaacttatatacatgttcttggcgatataaaattaaggcccctttgattcaaaggaaattcataggaattttagaggatttcattcttataggaatttttcctacaaagtcctttgaatcaaaggaatgaaccctatgaaatcctatgaaattcctatgaaatgcctcttcccatataagttttggaggaattttaacaagaggtagaacctcagggaaaaaatcctttgagtctttatctctcctaaaattcctgtgttttttctgtggtacaatcaaacggtcattcctacgtttttcctgtgttttgcaatcctctgttttacaattacattcctgtcaaaaccctatgtttttcctattcctccgttttttcattcttgtgatttaaagatgccctaaaggttaaaaaataaactacgatgagaaaatttcttaaattaacttcaaatttaacattaataatttaaattttaaccgacaagtataagtataaatgaaaaaaaagtgagtccggtaaaatgtggttatcaaatcataattggaagcgcaacgcgaaggagagacccgttgccatcggtgtgtatcccacgaaggaacaagacgaacgccaaggctcacatgcgacgcgacattgcctacactgtgtcacgttcgttgctactcctccttgctagtgcttaccacccctctccctcctcctcctcctcctcctcctctccccttctctcctctcctccctctccgccgcgcgccggtcgccggagtagcagggtgactgggagggattcagcgaggcaaaaccaatgggggtgctgggggacgggtcggggtggtgcttctgctccggcggggcgaagctggagcggatcaagaactccgtcctcgccgccaagggcgccgccgtcgccgccgtctccttccccgccggaggtggaggagggggcagaggtgggagtgggttcctcatccaccgcgccctcctgctcaccacgcacggcaccatcccctccgccgccgccgccgccgccgccgaggtccgcctcagccacggccgcctcccggctcgcctcgtgccgcagaggtattgaaccccctctccgccatttcttggatttcttcctccgcttcctataataatcctattgggttgttcaaatgcggtgcccaaatgattttacattttttttgtggtgggtttgcgggtttcgaatggaatcgattggtgctgcattgcgccatgagaggattcggttttgaaacctaatgcgacgcctttagcattttttcttttcccttttgggttgcacgcccgcaaggattgctagatgtttgtttgcactatggtgtagagagatctaattttcatcattcgatgtaaagctgctgcaattttgttcaaaatcaaatgaatctagtctttaggggagttcatgagatagtcattttgggcttctgaattacaagaaaaagaaaacttttgcttgctcgaaagttcaggacttggggacattgtggtggggtggggttgacttccatatggttcatgatactatcatttggggcttgttaccatgggacctagacaatcttgatgttattaatgcattctgttattgtagcatccgtacttttgtagtggggataatatatttcctttgtttggtcgttcaggatcaaatgcaactatgtacaaataaatttatttatcttcttcatacgattttggtggatcaccgaacagatttatgagccagcagatgtatgtcaggaagcattattgccattggctgagtaaagtcaattttgtgcaatagctgcgagaagcagatatagcatcgaggattacttcacatctttgtacaagtagacataaactctattgaattctggatgcctgactagaaaatttaaaatgggaggcaatatttgctgaaagtggtccatggttcaatttattcacttgattgctgggcataggacatgttttaaatgcattctttgtttctttacacaaaatcaatgtagggtcaatctggatttctttttgaacactttatttattgggcaaccacccaacattcgaaacttaattgtaataacaagaaatgaaaaggtgaccgtatagaactggaatataaataaatgtgctgtgcatctctattgcttttagagcgggaaacttagcaagtttttactctgaaattttggagtactgaaacatttatttgcccaagtgggccttttatttccatcttttactatgaaaatttacagttatttgttttgtttcattattccagattctttatcactagccccattttggaccttacaatagtgggtcttgatgtggtgaacgatgaattaaattcacacgggcaacagcctcatttcctaaagacctgcctgaaccccagcttggaccttggcagtacagttttgctcctgggccacacaaagagaaaagacctgacaataggcgaggggaaggttataattacaacagacaaccttataaagttctcaactgatgaagtcgcatggtatcctggatctgctggttttgatatgcacggaaatttagctttcatggtttgtgatccaatgaagcttgcaccttctacacctactggatacgcttctgcatcttcagccgcactcctttcagcaaagaaggatgtgccaacacagtttgggatgcccattcctgcagtctgtggttggttgaagcagcattggaatggtaacttagaagatgttagcaagccaatgatgcctcctgcacgattaatatccactgggcaacgaagtgagtgttcttctgttggtcgtcttaactacatcaagaccatggagcgagagggtggtgatgggatgtcatcatcacaaataccacctaggctgacacagcatcatggatcatgcagttcagcttctgcgaagatttcatgcggtgaaaatgattctgttgactcgcactctattcatgaacaacaagatctgacctcacaaatgcatgaatctaagattgagcaatctgcttcacttatggataataactttcctccagggcatccaagatcaattcgcctgccacttcctctaaagcacatgatgtcccatgagaataagataaaaccgaacccatcattttcacatgaagcacagctagctaatgtgaggatcaattgtggcactcttcacaatgttgcttaccaggaaaattgctggagtgaggctcagtccagttcctctccaccagatatatcagagttgggggatgagaggggcggttttagcagtggagaggagacaatgtactctgctgaaactagggaaagcagaaacatccctagcccaaaggaaaagaatcccaagatggttgggagatcacagagttttgtgaatcatagcaagtgggattccccaaaaagtgttgaatcttcgaaaggggccccctcaaagtcacacaccttcattcctttgagaaaaccacatttgcaggctgcagccatttcgcagaaaagccaagattttttcagtcctactgtctcctcaagcatgaaaaagaggaatttatcacaaattcccatgaaacctcggcaaagtgctcaagttacctccaagtggatcatctgatctcaccaactttcctcaaaccatacaaagatagcaacatcttttggttcaaccggttccacaaaatacttcctttttagttctgtaactgtatggtgtaaatgtattctagtcaaactatattctctagtgattcttttcagtgtaacataatctagcttatattcttttctctctaccgtgcatttgcccaatgaagggtaaaaccaatcatcatacaaaatgtagttttttgtccgacaggtagccatggaggatggactgagcattctttatttttcccaacaatgaactgggattcattggcacaagaagcaggactgggctactcatgaagctgcataattggataagtagtgttccatttctgtgaggagaataattggataagccaatgcctctgcagcagtgcagctttctcttcatatacagaagcacagaactccttgaaaattgacttttttctacatctattcagaaaaatcaaatgcaaggacattccagtgctataggagttccttttttttttgccctgtttcttctgcactcattttttgtccagttttggcaggaacaccatttgaaactgtttggtatggttcactttttgaaatgtcaagtgccaaagcaatcagcagttctctcgatgacagtgagtatttgatgcacatgcaacaatatgctcatcatgacatggcagatcataattgtatgcacatattcaggaaaaaaatactaccaggatgagaacaaatgtcatatgatttaaaattttcttcaagagttaaggtacaaccgatccctaaacttgttcgattggtaacatattctcgaaacacacaaattacccacattagcgtctgtgtgacataccacgtaaaattttggaagatcgtggtaattcaggatttgaatgaaacattttaatgagtttatgagatatagatatgtgttttgagagtacgatgagcgaacaaatttagggatcaatcgtgcactttatttattttttttataaaatttcataatacgagtagacaacactactttctccatcccactactaaatgagagaatgaaaataagatggagagaaaatcacccaaacatcccctattaaatgagcgatgatatgaagtgagagggtagttgagagtaagacggagagaaatttgaatgggatctgattgatgtgatagtaaatagtatagtaggattgtattattttgggaaaaaaataaatctagaattgtattatagtgggatgaagtgagtattgttttggcactttactcttaacacattggcattgccagaaatttaaggcctatttagtttagtgtttaaataaacgcttccaaaaattagcaatgaccaaattttgataaattgataacattatcaagttttatagaataggttaaatgtgctattgttaaaattctctaggattggtaacaaataggctgacttctttctgtaacttttccaactcaccttcctcgcttcccacgcgcacgttttttaaattgttaaaggacgtgtttttttggtaagaaaatgtgtcgcgcgccaaccatacctcccgacacagccttaatccatctacatatttatcaattttttttaaaaaaataagatagtttgaaatatgatatcaatccgaacagggcttaaaacctagctcatagcctagccgacggcggcctcgcactcgccggcgccggcgccggcgccgccatgctccgcctccagaaccacctcctcccacttctccgcgcttcctcctcctcctcccctgtacacctccgccgcctaatcccatccaccgccgccgcatcctcttcctcctctgtgcaccccaaccgccgcctccactccaccgccgccgccaggtccaccaccaccgcgacacccttctccatggaggactacctcgtcgacacctgcggcctcaccgccgcccaggcgctcaaagcctccaagaacgtctcccacctcaagtccgccaccaagccggacgcggtgctcgccatcctctccggggtcggcctctccggcgcggacctcgccgcggtcttcgcccgccgagccacggctcctctgcaccaaggcgcccagcgtcgccctccgcgtcgcctccctccgccaccgcgtcggcttgtccgacccccagatcgccagcctcctcctcntgcccggcggcgccaagggcttccacacatgcgacatggccccgaggctcgagttctggatccccttcttgggatccttcgagatgctcgatcttgaagaggaacaacgcgatcgtcagctcgagcctcgagaaggttatcaagcccaacatcgcgctgctccgggagtgcgggctaaagtgtttgtgatattgtccagatgtcccagacgtccgcgcgggtcctcacgttcagcccagagagattgaaggttatcgtgcagcaagctgagaaactccgcatgccgggttgctcatgggcattcaagaacgctgtgggcgccgttgcccgtagcaatgaaggcattgtcaatgcgaggatggagttcttgagcagttctcttggttgctccatggaaaagctccgctctgcggtctgcaagtgtccacaaattctgggattatctgagagcaaacttcacagtaaaatagagttcttggttggcaaagtcggattggagcctgactacattttgcagaggcctgtactgcttacgtacagcctggagaagcggttgctgccgaggcattatgttgtagaagtccttctggtgaagggattgataaaaaaaactgttgatttttacggttgtgtatgtgtgagcaacgaagattttgtagcaaggtacattgatcaccatgagaatgctgttccagggctcgcagatgcctatgctgcagtttgttctgggaaattgcctgcgttggtctaactctacatcttcagacagagatattggaggttcatcagtggaagtgccttcaaagtataactattagcctattttgatgggcatattggagatcaattatctttcaagcctagagctattgcaccaatttgttctctgaggctcattagttgatgttaattcctggtaatgtctgttttgaaattctggtttcaacagtaccactaccaataatttgatcgctcataatggtaggcaagtttcaatcatcgatattatgcagcaactggactgttttaatgttgcggcccttacttctcatttcatggatcggtacttcaacagctatttccctgttcaggtactttgagcaaacatgattttggtctcattacctgcatgttgaggtttacattgctcggtaggattattggaaagtataacgcagacatcaaactgcatatgctatgatatagtgtacagttgttgtccaagttcagtctaaaccattcttgaatggtgaaataccatgatggattgaactgtagtaattatagacgagaaatatcatgacatgctggcaaaatgaagggtgtggggatatgataattgataagggtgatttttcaagtgtctttttcagtctctggttcatttttcattggctatcactgaaaaagcatctatgcatgtcatattgtctctaatcgtactgtcatttatttaccactaataagccttctaattatctacttcaaaattacaatatgttaaatttgatgcttacaaggttcgctgaacgctaaagctaactaagtgttcattggatgcctaccacaattacacctagacaattgatcaggaacaggtgtggaagatggaacaaggtgatattgccttggttgctgcaacagatggctgccactccttgtgttgaagcctgaaggcaagccaaaaaataggccaggccttctgcggagatgcctgaagcatcgaactgcagtgtctcacactggttttgcagtactagcaggttaaaacaaatcttccatcctgcagccggtaggattgaaaaggtctcataagtaatgatgagaagttttgaaatagcgtaaacatattaaggggtggcgattatgtgatgttgtcagactctaggaaatcagtagaacatcaaggctttatggttgatttgaagtcgatgtggttcaacttctatccagatcaagtgaagggctttctgcagcattctgagaaacaaccacagattctactctctcttttttttttcctgatgagaaactccacagaaagataaagagttcttggttaccgaagttgggctgcatggtgaggcctgcaatgctcttgttcagcctggagatgatgctcttgttcagcctagagaagtggttggtgccaaggcataatgttgtggagttgttgatggaaaagatgttgacttgaactataatctcttctggtgagaacgatttcttagcaagatacattgaccatcgcaagggtagtactgttcatggactagcagatggtcatgctgcagtttgtgctgggaaagtgcctacaaaagccctagcttagcatatctggacctagatactggaggttcattccatctttctggctcataggctcatagctaagacctcgctgtaaacctggttgagttaatgtaattccttgtaatgtcttccaaatcttgatttagtattatagtaacaactaactatcttatccttcttagtgctatgcaagttcaattcgtggagtatgcagcaactttattatcttaattttgatgctctgctgctcctgtgaatatgtgaggtcttattgcttctgccattttgttcttgttctgataattttccaaatgtcattttcgcttcatttccctgttctctctagattatttactggattgtttgctctgtgctttgaaaaactatgttttatctaaaaaaattctactatattgcttagctcatttcttttaagctagtacttattaagtttgtttctcaaaatatttaatttatccttacgatcgttcactggaaagggattatgtgtgtgtaagatatttgtgactagtttattgaatatattttgataatatgtttgtttgatgaaaaaatattacatatttttctataaacttggtcaaacttaaagaagttcgactaggaaaaagtcaaatgagtccacgtatcctaattgagccaggccaacacaacatgaccaaacatctcactagaccgtgtatgggctctggtattagcacgtgggccaacacggcatagtccgttcggtgagtcgtgcctaatcgggcagcgcacaaacgtacctattatttatccctatactatatatagaaaaaaagataaaaattcaccgtctcaaaattccagccacatgagctctatttgaaaaatgggattaggacaaatattagaaacgcccagtagtgttccggttagctctatatgatggtgggctagctagcctagattcgaagcctcacaacttcaattcattttatattgggccattctatagtatattcgcgttttttaaagttattattttcatttttcagattttcaccaaacatgtttgggacctttgggtaggggtggggatggggcgaaattactaaagtaccctcgattttttgacgcctctgtcgtctcgtcagtttgcccctgcccagttgcccaccgcctccggctccggcgatccccatccatccggcgagcgagcagggcgccgtcgttcatcctgctgcttccgccgcatccatcctggtgagcacatcctccgccaccgccgcctgcgccgatccccatccatcgcgcgagcgatcgagcagggtcgccgtcgttcgtcctgctgctgctgctggtggtggtggtagaggaggagttgacggcgaggggatcgagagggagggagggatgcggcagcagcggggcaggggcgtggggcgtggggatcccgggctgctgacgagggcggtggagaaggtgttccgcctcgtccgcctcgccgagttcgagatcctcttcgtcctcttcttcctcatcgccttcgtcctcttcaaggatctcgtaagtgcgcaccccccctcgtctctcttctcgcttacacatttcacctctagtaacaacaggttatgtttagttatagagataggttggttcgtgaccgatttgcatggctttgatcaatttggtacagcatggccttgatgaactgaaaatattagaagatttgggtattttagttgaaggtgaactgaaaatatagaagattgggtattttagtagatgcaaaacactactgttcgatacataattttaaatcttgtttgatgttgccgactactgttcgacacataacttttgttttatgttgctgtatgacaagtagattaatggtgtttttgtcgttggtagatgatttctctataaaaatgtaaagataacctttcatgtgtatcagcgcaggggcggaatcaggcatggggcagctagggcttgggccccatgcctagctccataatccctattataatcttgaaaaatgctatgtaatttatgaaaatatttgagatcccattagctcagccctaggcgtggaaattttctggcaacgccactgtatcagcgtgatattttagttgttgccttgatatgcccgaatagcaaatcatgtccattttgttaaaccttgacatcaagtgtactttggatcatagtcttttaggtcttttttgggctggagttatgtcttctttaactattgaatgaatgaatttacctgcagatgtcacgaccagagtacaactcgatctttgtcaagaagcctgatctagatgggagatggccaggactcatgtaatgtttgtgtagtgtgatcaatgttgttctttttcctcttgcccaaagtacacttttgaggtgcttctttgacttcagttcttatgactactaatgttatctttcaagatgatgaatatagtttttgatgaattgccttctttggttttctgaaagaatcatttgcttaatgctattggcatggtttcttggtatgggtcttgattcttcttgtttgcaagcttaccgctggaattttgttaagtgtcatgctgaagttactgccaacagcccttgtttgcaccatgttgctgtccaattttatgggtgaattgtgatagccatacccatcagtcctgagagaagcttggtgtttgatgttttgataaccttgcttcttttgttaaggccctgtttaaatcccaccccaaaatttttcaccctttcacatcgaatgtttgaagacatgcatggagtattaaatgtggacagaaaaaaaaaccaattacactgtttgcgtgtaaattgcgagacgaatcttttaaggctaattgcgccatgatttgacaatgtgttgctacagtaaacatttgctaatgacggattaattaggcttaataaatttgtctcgcagtttacaggcggattatgtaatttgttttgttattagactatgtttaatacttcaaatgtgtctccgtatatccgatgtgacacgccaaaactttacaccctgaatctaaacaccccctaagtcagtcattttggttctgagactaattttgtcatgaaacctgtcctgttaggcttatagttgttgggtcagctattcaatgttgcctatttcaatctttgcacctcctctcaagttataactgtactgtaagtttatatggttcactgtaaatcttgccttctcgaccacctcttaagaatggtaaatttctatatgtatgtaattcctgtgaaaagaacagaaattttcatcttagtcataggctcatattgtcattgtagtgtggtactggatggttattcaagtcccaatacttgtattggaagtttgatatccatttctatacataattaaatagacatacaagtgaaactgggtcatcttaatattatgcagttccttgactgtcaaattcttcagttttgctcaaaactctgaaatgcattggctaaatgagatggctcatgcagacctgcaccatgtcaggcttcaagttctatacctgaatcaattccgtttatgagggacagctatttataaataaggatggcgaaatggcaactgatcctctagtaaatgaaccattcaaattcgtatgaattcatgtaaaatccctacattggtttcaaacccagctttgccttcatggatatatggacagcagatggattaatttgtttaggtgaagtgggattccatcaccttgcagttgttgtcttcgaaattcgtatggtctttgcgtcaaactgcgtgtatgttaaagaggtcttctaatacagattctagttgacggtgcactatcattgaagaaaacacatgatcaaaccatcgcatgtgcggacgcgttaatgtcgttattacgtgagatccaacctaatggaactggaaagtggcaaatagaaacaaataaattactattagagtaggatgttcggcaaagttgggctcaatccaactcacatgcagcgagtgctcgacttgcgacagctaaagaaaacgagctaagattttagtcactttaatccagtcaactcaatggtgggagtataaaactattcatatcaaaagtataaaagaagttctaaatttttcatattaacgcagaaattcgcaaggttttccctacaaactggagaaattcatttttggtaggaattccaagaatttctcttgtagccatgtttttttttctaattaagatgcagatgattttatctcgatttttgttaacacatttttcaaactactgtttctggtaaaaactttatatttagaagtgactttaaaatatcaaataaatctaacttttaaaatatataatagtaaaatttaataaattatgcgataataagggggtgttcggcacaactccaactcgaatatttttttctagtgccgagcatttctagctccataaattcatagagctggatctataattatatatataacatttgaatcaatcgttttgttttcattttaggtgaaatataaaattttgaatcactataatttaacataggaatttcaaatacagtgtataaacatgtggctgactttcttttttaaaattttaatccatctcaaacactggcgcgtcggcggtcagtggcccgtccactcggcccctcctctttttaactctctctctctctctctccggccgccaccccctcgccgcgccgacgtctcgcctccgccgcctcgttctcgttccgatggctagacgcgtcagcaccacccgcctcctcctcctcctcctcctcgtcgccgccgcggcggcggcggcggcggccggagaccaggtcagcattccaccctcgcctctcctcgcgccccgcgcaccacctcttgtctctcgcactctatctaaaccctgcgtcgtggttcatctcctttctccaggaggacccgcgtggcggcggcgacaacggcaccgcccgcttggatcgccgcaccaaggtgaggagctaggacccgcgcgtgtgcgtctgtttcgatgtccggattctgttcttggagctgtgggggttggtggtaatctcatcgaggcactggcgatccccgtcacagatgttcctgcacgcggcgcgggcgagcgacggcggcgccacggggatggagaaggccgggctgggtctcttcgacgccttcttcgctagcttgtccatgattctggtcagcgaggtagtaggtgacatttcgggatggaaattaattagtcttactactctagctgctctgaatttgcttttttctttttgtatctgtatctgtggagtgatcacttaacttagtgttgcttgtttatgcattgcttggtgaagattggggatgagaccttcatcatcgccgcgctgatggcgatgcgccaccccaaatccaccgtgctctcaggcgctctgtcggcgctggtcgttatgaccgtaggtgaaactgcagcttgcagatgcagcggttgtctgtcaaggcaagattgggctgcagtgtagagtctaactaatccttacttggctctactgttgtagatcttgtccaccgggcttggcagaatcgttccaaatttgatatccaggaagcacactaacagcgcagcaactggtatgactgatctgattgctacattattgcgccgtgataaagcctagtatgaagtgatgtgttagatttttctattgaattatgtatcacgagcctggaagtcggagaaaagtgatcgaatcatcataataaattaagtggtatggttaattgctccaaaagcatctacagacatacaaacattattaagactgtagtactggatttattgtttcaagttttcgtactatactgctgtgcactagatagtcagcattgccatagttatcaagggaccattgtcagaaaatcagatgttacagtttcacagtacatcacatgaaagttcagacatttaggcatgcacccgcattggctactagttgcttcaaaaacagtgtcccttagatatagaaacaaatagaagctgtttgaaatctcatgctacggtaattaaagatatatgcttttctaccgacttaaaaggagtccaagggcctccacattggtatagaaaagttccctaagaaaccaactcctctttggcatcccaactgtttgcatgccatccagttaattttaacaattcaccgtgctcacctaatattttgtatcctctttggtattttgtactcagtcctttatgcgttctttgggctacggctgctgtacattgcttggaggtcagattctaaggcatcacaaaagaaggaaattgaagaagtacgcacattttattacatttactctttgcctctacagatttgcattagcatttttcttttgacagaaaactgcattagcttaatattgttagtttatattttgttgcgttaattttatccttttttgtgcatattcagtatactagaatctctaatttgcagcatctattgttgttgtatccagtgtaactgaatatctcttggagctttctgactttggattactctctgctggaccaatttcagcatttctttgccctgttgtgcttaaaaaatagaactagactgctgaagatatttagttatttgggaagatacatgtttactgtattgaactattggtagtccttttaattactattatttggttgtttatattatgcattataattggctctgacctttgatatcgtccaattgtttggtatgctacttgaaccatcttatatattttgaatcccttgacatacacaggtagaggaaaagctggaagcaggacaagggaaatcaacatttagacgcatcttctcaaggttctgtactcctatttttttggaggtacattccgctcttatcgttataaattttggtgcttcttggcaaaagtgcatttgctgccatctgatttcagatggatactgaattatcaaacactcactttttaccaacaaatggttgataaacacgtgatccaatttgtgtctttttaaatgaattcatccaatgtgtatgaacgacttgaaaatgcagtcgtttgtgttgaccttcctggcggagtggggcgaccgaagtcagattgccacaattgcggtaaggcctacccccttttcagcaattttccaacacttctcttcttgctcaattccccagcacttcttttcttgttcacaaaccgtaaacttgttgcatttcttgccaatgcagttggccactcacaaaaatgcggtaggggtcgctgtgggagcaaccttggggcacaccatctgcacatcgttcgctgtggtgggtggcagcatgctggcatccaagatatctcagggcacagtggccaccattggaggcctcctcttccttggcttctctctgtcatcatatttctacccaccattgtgaattttgtgatgaactgatgacatcctaccaagggggtgtatattccgttgcagccaagcatgctggcttgaaatataaacgcaggcgctacatatgtgcagcagtgtgcaacctttgtattgtttgtttgaaatcacaaatctattctacgtaggtttccgattgaattagtttgcgacaaccggtgtacatttacgatatactctctctccgttttaaaatgtttgacaccgttgactttttaacatatgtttgaccatttgtcttatttaaaaaattttatgaaatatgtaaagctatatgtatacatagaagtatatttaacaatgaatcaaatgatatgaaaagaataaataattacttaaattttttgaataagacgaatggtcaaacacgtactaaaaagtcaatgtcaatagtgtcgttttggaacggagggagtaaattttagagatggggtgggggtgcatcttacctccctcgactataggtcaaattcgattcgtatccgtgaactgtaaagctatgtatagaggctgccacaacaattaaaatcggatcaagttacctatttcatgctggatggttttgatgatattttcctcctacgtggtagtcccgtttcaatagtcgtgaatcgaactcggtgaataagctgagggataaaatatggacttattccaatttcgggccacctacgtggatgggccgggtctgtggcccatccatccaaacaaggcctagtgaagttggaggcctccaaacaaggcgctcacatcgacctgttcggtccggagtcggatacatcaaacaggtcagccaattttggaccgaatccaattataatcggacctttatatttattgagaatcacaaattcacgatccagacgaaagggctcctccgtctccttcatcaggtgtgggccttctgctctcgtttgttggcttttggaggcttaggtgtcgctcatttttattgtcgaatctcgatctggatttgtagaatttttgtgcgaacgtagagtagatcgatgtgttgagatgatcttccgtagttgatagttgacagatgataaaaaaaaatcgtctcctttctcgtttctgaattctgatcgatattgtattatactgatgcttccacaggaattccggcgctggcgatggaaataatattttttaatattattttcatataatatgttataaagaatagtagctatagtagtatggtaattgcctacagagacatacaggaccaccaatataggagaataaatgaggaaacaatagccgtgtaaaagatgaaaaaaatcgatggatcctatctaacctaagcgtccatcaattcttaaaaaaaaggcccaaacaagattgatcttagttacagatgtcagaacattggaccaaagcttcgaaaaaaaccaaacggacatgggagatgatggacgatagaaatgttatgaatctttttaatggaatcggatgttttttctttctaaattcggacagttttttttcacattgcacggtgccaaaccagattttttttttttttacaaacggtggcgtttttctcgcgttgagtcggacagttttttcaaagcggttcttttataaatggcgatgttttttcgcgttgaatcgtacggtttctcaatgggttttttttctcgcattgagtcggacgttttttctaaacggcgtattattctaacagttaattcggagcgtttattctaacagtttcttcggagtgttttttataagggatttttttctcgtgcggtttatattaacgttgacattttaggccgattttaatatatgacaatttgaatgaataaaaaaagtaattcgaaaggggattttttttttcagccaaccttttttttcttgaggtaattttggaaaatcagccggtttttttagtggaatcggatttatttttaacattgcgtggaacttttttttttccactaacctttttttgggagggccgatttatacagactctttttttagaatcggaccgaaaccttttttcttcgcactatttttttccttttttagaaaagcgtatttttttcttttccggtacggtagggatgacataacttttttttctccagtaacgttttttttgaccggtttatacggacgtctttttttaatcggacagaaaaaaaatttcacattttttgtttgctttttttttaacggaagagtggagacggaacttttttttcgcgcgtttttttttacgtttttacagacgatggaaatttcttttattttcaagtagtatatataagagatagagatagagatgtgctaatctttcctattaataattgaataatacaaaagcttcagtttgcctttgtccggcgtggaatcttgctgatgggattcgactattccagtcgttgtcgaagccgcacctgaggcctgcgcccacagcaacctgttcggcttggagtcggatactacactatttattatcacaaattcacgatccagacgagaggggggggggggggggcgtctccttcatcaggtgcgcgccttctgctctcgtctgttggcttttggaggtttaagaggggcttaggtgtcgctccttttcattgtctaatctcgttctggatttgtagaatttctgtgcgaacgtagagtagatcgatgtgttgagatgatcttccgtagttgacagttgattaaaaaaaatcatctcctttctcgtttctgaattctttttcattaagcatggaagaaaataatgtttaaacaaataacaggaattctggcgctggcgatggatccatctgaggaaacaagtgcagggaaagatgatcttctggcgattgatgactctaaccaggataaggctaaacaggctacggttgtatcagatgaaagtaaggcgccaatcatagaaaagaagaagaaaaaaaagatggttcgctatactcaagagcagatcgaatactgcattgctaacccagaggagttgtgggacatcaaagtcattaagctgactgagttgttgagcaaggagtgcctggcccgaatggggcaggagcaagtagacaagttgtacgctatggaacgtactgaggaggagcagattgttagacggaagaagctacaggaagtcctccgcaatgaacgggagaacatctacaaaatccccgataaaccgcaggacgtcctcaagcagtactacgccaaaggctatgccgagtacgaggttgttgttgacgatggagatgtcgatgtcgatgaagacgatgaagttcctgcacgagttgctcaccctggccggagaagattccgcaacgggattgtcgtgaagaagaatcagtcaggaggaggaagtattaggaagataaactgaataatcgtcgttagtatttggcatggatccatcttagttgtaggggaaattatatttttcccctctatttatcagcataataataatagtactagtagtagtaataacgctgtgcgactctgtggtttgacttaattttatattcctgctatggtttgattctaatcgtgctaattgtattatcgttcagcattgatccatcatcttgttcagggaattttaaactaccctagactgaagtcagagaacagagtttgtttcgactggagtagtttttactgctctgtgctctcccagaggcattttcaggagtagttttgttgattgcattttcaggagaaatttggaatcccttgaaagctcctcgcctgaaaaagatgtacaatttggaacctcttgcaaaaactaagctggtctctattgacatgttttctcctacattattcagagtttcatgataaggattacaatggacaaaactttttgacatggtcatatgagaatggcactctgctaccatctgttactccaaatgccaatgcaagttggatcaacacttgaaatgaaaaacgagtcagtcaggcagttgtgcttgagacaatcagacataatttcggtttagcttgcaaagttagtgtagctatcaggtctgtttgatttataatctgtgctcacctctgccatctcttcttgatcgtggcggattgtccccaccttgtcaaacattaatgcttatcaaagtattttaccaatttaaaatccccaattccccaccatttttattcagcacagaattgaaaaaaaaaaagagatttggaggaagagaggccccctctaaacattttttaagaaaaaaatgtgagtgtgttgaaaattgaacacggaatctcgggtgaaactacacagcccttaccacttcactatcaagtgcatctcttcagcacaatataacgggaagctttgtggcatgttctgtaacatacatcacacacatcttttgttactttttgttatgcaaagcaacaggaatgctctttgatcttcagtttgggcagcggttggctgttgtgggagaggatctgcacgacctcggcccgccggcgccgactcctcctgctgcgccgcggacggtggtgatggctggctggatcctctccttctcgtcatccccctcgtccccatccctgcgccaccgccgcttccgtgggctctgggtgcagtgacagaggacaccgcggaaaaggagaagaggcaacggcgacacgcgtcgcggaggaccaagcgggccactccctcctctcccaaatcgccaagaaggagaggagttggcggtggtggggccgaggttgtgcagctccattcttgccagccgccgcgcgccgctgcctcctcgttgcgcctggagtgaggagaggggagagagatgaagagaggtggagctcgttgaggcattcaggccctttgaccgcgacgacaatggcttcatctccgccgccgagctcgcgcgctccatggccgacaccgacaccgacctccgcgcgatgggtctcaccggcgacctcttcctctccgccagcgcgatgttcctgccggccacccttctctcttccgcccgcggctgaccgccagatgctagcgacctttccttctcggttggcgtggtgctcccgctagccacctttttctctgtcgcccatgaccgaccgtcggtgaagtcgtggagaagggagaaggagaaggggaggagatagagaaaagatgggatgaggtggaggaagtgggtccactgacatgtgggtcccactatttttaattttattattttactgacatgtattttatttttaaaaaaaaattgttaaattttgcttcagacgttacgtcagatgaagaccgaatcaaattagccacataggcgccacgtcagctaaaacctccgtccaaaccgccatgaaatctatattgcatcagttttgatagttgagggacctacctattgcatctggttttccggttgaaggacgaaaatcggatttgttgacaagttaagggacctcagatgaacttattcctaatagtgatgtttgcaggtgatggataagttgtcatgggctgacgtgcagggcacatatgtaattgagcctgcgttctagttgggccggaatctggcccatgtcgaatccagctaactcattgttaatccagctagcccatatgtatatacacacattttgtttgaagagatcacatcgccaaatgccagaaaatcaacagttaaattaaccggctataataggctagtaaaacaatagctagttaatctagtagtaattaatcatctaattaacaatgctatcaataatcatcatcataataacagttaattagtagttgaaccaccatcgccagcgtccgatgatcttgccgacgtagttgtgttcatggggcttgtacctgcacacggtggggaacacgccgagcacgtgggcgcactccctgagcaccacgtcgccgacgagcctcttctccctccgccgcgccggcgccgccctggtggcgcgccgcccggtgacgaggaacatcttcccgtcctcgaacaggtagtggcacccgccttcctcgacgcggcaccgcagcgcgtaggcggcgctgctgttgaagacgacgacgtcctggaggaagttgcccatgtacccccacttgcagaggatggcgtacggcacggcggcggcggagttcggcggcggcggcggtggctggaagaaggcgcgctggggcttgtaggggtcgaggatgaagtagtggaagtactcccagttgccggagaaggcggtgcggcagctgaggatcatctggccgccggtcatggtgctcagcatggacaccgagtggttccgccccggcgccgccggcgacgactggtcgcggggctccgccgcgtgcggcgacagcatcccgacgatgatcacgatcgacgggatggcgatgaacacgaacgggatcgagatgatggtcagccgccggagcaggtccttcttcttctcctccatatttattatgtacttttaatttcttgtagaaaatgcttcagttttgctcttcttcttcctcctctctctcctcgaagcctctaatttatcgtgtggttgacgaggtggcgtgtcaaaattaggaagtgaccacacctgaatgcagatgagaaatatgagatattttgaccaaatgtatcaacgatttaaacttgctcgtagctactccctccattccataatataagagacagccacttttcttagatgttctataatataaggttttaaactataacatattttttattaaattactactttttttaaaatccttcactgtcacattctttaactttattggatgcatgcattatatttattaggatgatccaaactacaagataataataactatttcttggtctttgggttaagagtggttgtggcttatattttggaagggaccacctatacatttgtcgacaaattttctcctaaaaaaataacagatgtaattatagtataattgtagtgtaattacattgtaacttgtatgtaactacagcataacttgtatataagtttcacgtaattttgaatcgttaaatctattacaagatttgtttaggtgaggaagaaaaaaatcacagcacacacatatgtataaggatttgttctcacaacctccattttaccgaaataacatattacagagagatttttgaaagttacatacaagttacactttatttacagtgtaattacactacgattgtagtgtaattatatttgtcaaatttttaggagaaaatttgtcgttaaatatatagcaaaatcgttttcgaatggagggaatagtaatttggaatgaaccgattggtcgtttccttgaatatcaggctctcgatcaggacgccgcctctcgacagatcaaatgaagcccatccagaaaatgggcccatcaggcctgataccgacattatcaggttagaataagttcactttacgtccctctattttgttgcttagtccgatttacgtccctgaaccgcaaaccgggtatgacccgtcccccaacccccaacttacgaaaaccggacaagcgagatccctcggcagtatgaagggcggttttggccgacgtggcgcctatgtggctaatttgactcagtcttcatctgacgtggtattgacatggcgctgacatggcaattcgatctagaaaaatattaatccatgtgggacccacatgtcactttaacgcacaaattaataaaatgatgggccccatgtggatcccacatgtcattatcacccttctcttcttcctctcctccctccctcttcacggcgtcacgaggaggtccggtggtggtggccgacgacgcgacaacgacgaaacgggagaaggctgggtgtcggcggcgagagcgttggggggaggggctccgcgtggggggcgccgcccgccccgagaagctactcctcgtcttcgtccgcggcgccggcgcagagcccgcgcgggggctcgaggagttcagggccgtgcacgtgggcggagggatgcagcagcagttcggcgccacgcggtggcgccggagatgtcgccactcgccggcgggaggcagcggcgggcggatctccatggcagaagcggcatcgcccatcaacaaccggctcgccgcgggccgtcagcggcggcgccgccatggctgaattctcgtcagcgaaatgctgcatgaaatctcggcggacaccagaagcaacctggtgtgattttggttagctctgttaattaattaccggctaaataaacacatccttttcacttttttccttaaccatcgttcacgagcacggtgacagccgggccacctcggcctaccaccagcggcctcggcggaggagcgcacctcgcctccgcacgccggctgccgggctcttcgcaccggcgcggactccagcgtcatcggagcagctcactgaatggccgcggagctgcgcgaagggggagcaggcaggcggtgaggtcgtggcggtggtggagggccgctccgccccgctcgtcgcccgctccgccggccgccgcccgccacggaggaagacggagaggagagcaacaatggcgatggggagcagtgggggatagagagaaggagagagaggatagagaggggatagagataaggggtagtgaagatgacaggtgggtccacgtgggccccaccaattatctattattgtgtgtgtgaaactgacatgtgggtcccataggatttattatttttttattgaattgccacgtaatcgctaagtcaatgccacggcagataaagatcgagtcaaattagccacatatgcgctacctcagccaaaaccgggatcccgagggaccttatttaaacggtttcataagttggacgacctgtcgtacccgttttgcgatcaaggacgaaaatcggactggccggcaaataaaggtacccaaagtgaacttattcccatcaggttcgacattatcaggttgggccttggttaattagcacaaatcgaccaagcccaagacggcaaagcaccatcaccttccttccgctctcgctctcctcaaactttcgagctcgtcgcggattctccagcatacagctcgagcgcggggtgggtcgatccgaggcgctcctcgcgtactccggtaggttcgttctcctcccacattttgcttccctcgtcccgctgttcgtcgccgacgcgggggttggttgatcgcgcgcttggtgggtttcttggttcctgaatccgcggcggcgcagttcttggtcctcgccgaccttttttttttttcttgttggagcctctccatatggttctctcctcttcgttcgctttcttgatccattcctagtccgtagggttcctcttgcgattattgacgggttcgagttggcccaaatgttgatttctcttggcgattttttctttcttgttctcctcctcttttcctctctcgattcactttgtacgatttcatcccctagtccgtactggttctttggatttatggatttacgcgagttttttttctcttgtggttgttgcaattccaggtgtgatgaacgaggagaagagggcgagggtgggggatactgccgagaccccgcggaaatcccctcgcctggatcggccagctgcggcggcggcggcggcggcgccgttaaccagcaacggtagtattctgcggtgccaacacgtctttcgctttcttcatcagttcttggttcatcacgttcatcagttatttggggtttatggatttacgcgagattttttgggttcctgcaatttcaggcgtgatgggcgagaagaagaagaagaatgcgacgcgggatgtgagcgattggtgttggtgggggaaagcggcggcattactatccggcggcgaccgccgtactcgacggtgccgccatgtcttgtgtgagcaggctgacattgatgtggccataacactgatcaagacccgcgttgacaccccggtgtgttgtgttaacaagtgtgatgatactgaggggagggaaatctcggtgtgtttggattgccagttgagtttctgcacggcacacgggaagccgcacgtctttatgaacgaccattggattgctctggtgtacaagaggcccaatgtggcgcattgcttcgcgtgtgaagagtgctatttcatcagaaccgacagtctcggggagggaatggcggtcggtgagaatggcttctccatcggtacccataagaaggatgagaagggaatgacgacggtcaacaatgaggcaggtgttcatgcatctatggtgtctgattatgaaagcgccctcatggtggctttactcagtgatgtcggtactccacggtgcaggcatgacatgtataacaaggatgaggttgatttggtccaaagacggatcatgttctgcgatatcaccagaatgtgtagtgattgtgacaacatcagtgtgcttatgatctttgtgtgcttgggatgtgaaaagcctttctgcactgtacactccagtttacatgctgagagcaccaagcatttggttggtctggtgtaccataacccgtatgtggcgtgctgcttcctgtgtagtgaaacctttgtcctcattggtgagggggataagaggatgccagttgacaaagcggcaggtggttatgcatctgagtcagttattgggcatgcccatgctatcaaagggataccgaatcttggaaacacttgctacttgaattcattgatgcagtgcctccttgtgcttggaaaactgcgggcaaggatgttaggaccggacgctccatcagggacccttggtactgcattgcatgacctctttgagcaaacatacagtgtgaataatgcaacaggcctgctggagacgtcattgctcttggattgtgtatgcaatttggacccacagttcgtaggaggttttatgcatgataaccatgaattgctttgctgtttacgtaaaaatttggatgaggaggagaggatgaggacgcctcctaacatgcaagacagttctgctggtgcagtgcctcctacggtttttaattccattttcggtggtcagctatttgttaccagatcgtgcaaatgttgctcgttttgttcagtttcccacgctgtattctatgatctctcagtaccagtaccaccgaagaagcctccagccaaaagtgttgaatcaacaccatggattgaaggtcacagatctcaaccgaagatttgtatcaaccagtttgaagcaatacataagaggaacacagaaaagactcatagaattgttgaagatgccgattctgatcctgcttcagaattgaaagatatggtcatggtgaaaacatcagagccattggaagttggtaagttcatgcgctccgctcatgtactgagtaaaggaatggaaggcaatattaaacagtcctgcaaacgtgcatggtgtatcagaagtcagaacataaaacttttcatgattgaaagcaccaaactatggtagtaccacaaatatttgttactagcttttgttctagagaagacaaatgtcactttgcaaaatggtgctcttgtactagataaatgaagaaacttgttcaaggacttgattatacatggactgcagaaataccagaaccttcaggatgtctacattagacaagcaggatgtttcagcaaatttaacatggcatggctttttgttgcagtgtaacagtaacacttattattcacccggggaagatagctatgggtgttgaatgctcaatgcttcaactcttcatataataaattttgctcgaagttgttggttgacaagtacatgcagagatcttgaagaaaagaaacttcaaataatcaaatgtagaggacaaagattctcaaaccatgtagagaatggaggttgctcctttcatgaaggctgatgaggacaaaactaaaaacctattttcttgattctgcagattatactgaagtggaacagatctcacaaagcaaggactatgtacaagatcctcaaaatgtgttggctgatgtcaaaactgcaggaatggatgcgacaacaacagatacccgcattccagaatatatagggccacatccacctgtctctcaattaagggaagagaatgcacagttagaatcatgcaatgatgtggggaaagatggcaatgctattctcgaagttagttcagaacacaagatagacactttctcagcagaagttactacagaagacaaggggaaaacttgcagtagtgacgttgtttgtggaaaggcacaggatatcgactctcttccatcgattacgagtgcttggaactgcactttaaagcagagatgatagaatggacctgtgagaactgctccaaaggtgctcggaagtcagatgtcactgaaggtacatacagtgaacagatgctgtcaagtactaatgaggacacagcagttggtggataccagagggaacagtcagagaagataacatgccaaagtgagcaatccaacaaaaaacctgaatgccctgaaggtgttcaagacgctgtacctcattgtgtcccagctgagagacaggacaacctgttgagcagtcaggatcaaaatgccaccacactagatgaaggaaggggtaagcaaaagcttcatcatagtgcacaccaagtcgaagaatgccaaaatgagcagaaagataggaataaaggtgctactcaaacacggattagcaagttgccacttgtgttaaccattcatctgatgagatctttgttggggcctgataaggtgatgggacatgtgagctttaaggaaatccttgatatgggactgttcatggaccccaggtactgactactgcattttttttaacaaaattgtaactgttagcatttctatacagcaacttctaatgattctattccagtttaatcattttacttatttgcagtaagctaatagatattatttttcctaatttgttcctttgctttaagaatgcatctcttctacaatgagttgctttcagatgacacaagcattgctggtcaatgaataatctgtatgcccatttttcatgttctcttgctatgagtatgtcgatgattttattgtgcatgacaagatgttgtccagatgcctcgtgtaatattgaccataactaaataagacaagatgtacttattgatggctatgtggctccatctgctagtaattttcacagattatgatgttttgtgacaatttgattgtttcaactttatttaggaaattaggtgtgatttggattttataataatttgaatttgtgtgattttaagaactagatttgattgtagtattgtactctactcttgttttttcctatcctttaaagtcagattatacatccttagactaaatctaggtttgtcgataatatccatcatgctgaccaaagttaattcactgcagcagaacatcatttacttttatttggatacctacctccttttgttttgaaaaatcacaatctccttaagaaaccatccattacgatttctcgataacaatattcatttacaatgatatttaacctagaaagatgtgctgttgtttacatcgagctatatgagttaaagccacatctgctttatttttatttttttagctctgaagacaaagataattccatttatcgtctagctggtgttattgagcaccatggccgcggcaaagattcagggcactttgttgcttatgtgagaccaagtcctcggcagcagaccaatggttcttcctcatggttttgtgcaagtgataccgacatcagagaagtctctttagaagaagttctcaagtgcgaggcttaccttcttttctacgagaggatggaaggctgagatgtctggaatctatatccacaagctgctaatcagaatagcaatcaaaaggattctttggatgtccaaatatccaatttttgatttgttcgtactcacgttggatcaaaatcaagaagagttttgtttctttcagttgttcttaaatagctggtctgatttgtgcatatccaattctctcctctctttttttttggataagtgaggaatgcagtagggtttcatttggaaaaatatcagcatagtaggacatataggccttggtacagttttgtaggacggtactgttatttacgattgctttgcagtactggggaaattttggaacacattggagtatttgatttgatacgttgtgcttttcctcaatgtttttgttatggcaagctacattgtatgcaagatgattcaaatacaccttgaacttgaagtatcagtaacaggagcagcgttaccaaacccgtttagagtggggttaccgctgctctacggtttgacggttaccgcgaaatataccatggttttaaaaattgaaaatgttatcacacatgataaccgcacggttttataaaccctgaacatgatggcattaattttgccttcttttttcctttcttcattactccaaaaaaaaaatagcctgtttgttgtcggccttgtgggcttatggataaacccatacctagattgggcccataactccatgagtcagaacgatattggcccattagcccacgattaaaataagcaggctttttactcacgaggtcacgcatcccggctgattaacagaaagaaataagtccacttgccatcctcaacttacgtcgggtttaattgacatcctttatcctcaatacgagaaatattttcccctaaactatacataactgtacaacttgagtcctatagcagtagcaatacgcgcgtggcctggcatccctgctcatcggggcaggagccagccgcgtcggcagccaccatgagttaagaccgtagctagacggtgagaatggccattgctttcatttgaggagtggtgtggatatgggcatgataaatggcatcgtcacggagatgcctctcctcctccatggtggtcgccctccaggacggagcagggctcacggggccacctccgccttagagtttatgtccatcttcttcggcaccgtaaggagcggcgtgccatagtggaggaagctcgctggcccccttgtctccctcctcttctcgaaaaagctcgttggccacctccacctcactcgcatgaaggctaagtgagctcaagctcggacgagcttgccgaccacctccccctccctatcctgcctccgcctttctcgcacgcaggccgcttgagctcaagcttggataggttcgctcgctgccttcctcaccgccaccccataaacgcgcatgcgtggtttggggaaaaaaaaagagggtgaagaaagaagttgtggctgacatgtgagtccaatgtttttttttacttcttttgctgattaggatgccagtgctcattctacctaaattagacggttttgcgaaaatgaagggtggtgattggtgaagattcctagtatttatagggatttcaattaaacttgatgtaaagaagagggatgacaagtggacttatttctaacagaaatcgtccaagcccaccatcctcatcaccaccaccaccaccgccgccgcccttccgctctcgcctctcgcttcctcctccctccaactccaacttctcctcgcctcatcgcgacctctccatctcgctctctgctcgattccgagcggctcctcgcgtgctctggggtgagtcttcgcccccgcatttcctcccctggtcctgctgctcgtcgccgagtggtggttggttggttgatcgcgcatgttgggttttcttggctcccgaatccgcggcggcgctgttcttggtgctctccgggatgtccggtttcgccctgtattgttggcggggttctctctgcatctcttcttcgttcgatttcttggtccattccttgtccgtagtgttcttcccgaagttcttgattgatgcgagcttgatggcccaaatgctgtttttttttcttttgtttctcctcatttgctttcttggtttcatgagtccatcccctaatccgtactggttctttggatttatggatttaagcgaagtttttttgtcctgtggttcttgcaattgcaggcctgatggacgagaaagcgagggccggcaaatccccacgcctgaagcggcgctcttctggaagcgatccgttggaggaagcggcggggttaaccagcgacagtagtagtattcggcggtgccggcacgtctcgtgtgaccaggctaccattgatctgggcatagcactgatcaaggcctccattgatggcccagcgtgtgattctttcaagtgtggcaccactgaggagaggggaatcttggtttgcttggattgcggttcgagtctctgcgctctacacgcgagatggcacgcccggatgaaccggcattgggttgctttgatgcacaagagacccaatgtggcgtattgcttctcatgcgaagacgcctatttcatcagccgtgtgaggtttggggggacggccgatgaggatttcttcccaatcagtacccctaagaaggatgagaagggaaataaggttgacaatgaggcaggttgtcatgcatctgcggcgacaggggctggttctggaggcggcacaatggcggtgttaaccagcaatgtcagtccccagcggtgctgtcatgtgtataagaagggtgatgttgctcgggtcataaaaaggatcatgttaagcgatatcgccgcggcgtgtagtgattccatgtgtgataccactgggaggagcctgatcttggtgtgcttgggatgtgaaaacccgttctgcagtggacatgccgatgtgcatgccaagagcaccaagcactggaattatttgatttaccaaagcccatatatagtgtgctgctttgtgtgtaaaggcatcgttttcctcggtggtcaggataaggaggagatgccagttgacaatgcaacagctggtgatgcatctgggtcagttattgagcatgcccatgctatcagagggataacaaatcttggaaacacttgttacttgaattcattggtacagtgcctccttgcacttggaaggctgcgggcaaggatgttaagacctgaagatacaacggggaggcttggtacagtactgagatatctctttcaggatacggacagtgtgaataactcaggaggcctgctgaatccaagtggcctcttgcgtagagtacggatgtttgtcccagagtctcaagtcacttctatgcatgacagccatgaagcgctttgccgtttgcgcactaatttggatgaagaggaaaggttgatgaagtatggtgctctcagtgtagaggctcctaccgtcattgattccatttttggcggtcagctgtctgttaccaagacatgcaaatgctgctcacttagttcagtttcacatggtatagtattccatgatctctcaatgccaataacaccgaagaaacctctagccaaacgtgttgaaccactatggatcactaaaggtcgcagatctcaacggaagaggaacacagaaaagactcatacaattgctgaagacggtgattctcagaatgtcatggtgaaaacatcagaacctttgggagttggtaagttatgtgttcatgtacctaaataaaggaacagaagggaatgttgaacaggcctgcaaaaacgtgcatggtgtctcagaagtcagaacgtaaaactatgaccgaacacaccaaactgtgatagtaccactattatttttgattttttgctccagacaagaaaaagggcattttgtagaatggcactgttttactagataaatgaagaaacatgttcaaggacttgattatacatggactgcagaaataccagaactttcaggacgtctacattagacaagcaggatgtttcagcaaatttagcatggcaatgtttttcgttacagtgtagcagttattggcactgggaagatagctaagggagttgagtcctccttgtataataaatattgctccaatttgttggttaacttaagtacgtgcggagatcgttgaaaaaaaaagaagcttcaaataatcaaaaggaagtttgctggtttcatgaagcagctgatgaggacaaaactaaaattttatttgcttcattctacagattctactaaagtggaacagatctcacaaagcaaggatgctgtacaaggccctttgcagattcagaaggataaggtccaaggaaaggctgttgatttccttcctcaaaacgtgttgtcggatgccaaagttgagggaatggatgcaacacgagcagattcccacattccagaatatcttgctccagctccaaccttttctccactaagggaagatgatgcacaggtagcattaggtattgatgtggagaaaaatggcagtgctgttcggccagaagttagtactgaggccaaggtgaccacttcctcagcaaaagttactgcaaaagacaaggggaaaactcggagtagcaatattatttgtaacaaggcacaggatataaactctcttgcgtcgattgaggagtgcttggaactgcattttgaagcagagacggtagaactgacctgtgagaactgctccaagtttgctcagaagctgaataaaagtgtaattcaaacacgtcttagcctgctgccacctgtactagtcattcatctgaaaagatcattgttgcagtctgataaggtgaaaggacatgtgagctttaaggaaatccttgatgtgggactgttcatggaccccaggtactgattactgcatttatttcttttttcgacaaaaaatgtaaccgttctaatgattctctgccagtttaaataagtttctaatttgtagtaagctaataaatattatttttcctaatttgttcgttttgctttaagaatacatctctcctgcaataggttgcttttgggtgacatatttttcatgctttctttctatgagtatgtggaattgtggattatttgtactgtgcatttcagtgtgtcatctagatgcctcgtgtaacattaaccataactaaataagacatggattgcttgttgacggttttgtggccccccttgctagtaattttcaacagtacgctgttttcctgcgaaatgaaaacaaggtgacaatgtaaatgtttcaactgtatttggggaattatgtgcgatttggattttagagtaatttgaatttatgttattttaaggacccaattttgattgctctctactctcttgttctttcctatcctttagagtcaggttatacatcctcagagtaactctaggcttgttgataatatccatcatgttggccaaagtaaattcactgtagcagagtatcgttcactgttctttagatccttgtcttttaaaataacagcctacataaaaaaaccatccacaatggtttctcgctaacactatattcatttacaaagatattttagccaagaaagacgtgctgttgtttacattagaaaagtcttacgcctggtctgattttcccccctctaattttcagctcagtggacaaagataattcaatttatcgtctagctagtgttattgagcaccatggccacggcaaagattcagggcactttgttgcttatgtgagacaaagtcgtccgcagcagaccaatggctcttcctcatggttttgggcaagtgacaccgacatcagagaagtccctttagaagaagttctcaagtgcgaggcttaccttcttttctatgagaggatggaaggctgagatgtgtggaattctatatctaccagctgctaattagaatagcaatcacacaggattctttggatggccaagaatccagttcaaatttgtacatactgactgttggcttgcgatcaagatgatttctgttgctttggctgagtcattgcaggacttcaatttggccgcaacatatacgttccagatttcggttgttctttgactagctgatctagttacaggcattcttatctacctttttgtccgagaagaatgcattaggcctttggtacagttttgtcggattgtactgttgttagcaatttctgtacagtactatggaaaatttgtaacatatcatttgatttgttgagctacactgtatgcatggtgattcagatactcgttgaagtagcaataacaagagcattctttctttcttccattgctttctggaatctggatgaacatgacataacatgccaacatgggagggtgagaacatgctgttccaatggtcaccgttgattctgagatatcgtgcgttctgtttagcatcaccgttctcccaaaggaataatgaggggagggattatttttcttttcatttttaattacatggaggcatgtggaaagtgcaaacacaccaccacagacgcataccacaccacacactttatttttcttcagatcaaaaaatcagactagatatgaaaaacatataaaaaaaaagaacaagttttacagaatgagacaacactcggcgtgagtttgtttcttcgtattcctgacctccacttactccttttccatgcacacgcttcctaaactgctaaacggtatgttttttgcaaaaaaaattctgtaaaaaaattatttaaaaaaatcatactaatctatttctaaagtatttttaataataataatttttaaaaatatttttaataatattaattaattaatcatagaaggtttccaatcctagcaattaaacacagcctcaatatcgttacggcagtagagcaagacgaaagcccatctcatcgttgggcccggcccatcatgccgcgaggccaggacgacctcggcccattaggcccacgatcgatgaataaaacgcagggctcacgcggtcacgaatcccggaggtgattaacacaaaccggccaaaaagcccaacgcgccgcacgccaccgccaccctcttcttcctcctctcgctccctccctcctccgtctccgccttctcctccaagcttcctcctcggcctcgccgcgcgcgagccctcgtcgccggattccccagctcgagcgcgcgctgggttcgagattccgagcacgcgcgcggtgctccggtgagttctcgcacccgcatttcctccccccctctctctgtgatgctttgctgctcgtcgccgacgcggggggtttgatttgatcgcgcgcttttgggtgggggtttattggttcgcgaatccgcggcggggcgcgggtggttgctggtcgtcctcgccggaatggttcgattattggtggagttctctctcggtttctccgattatttcggtttctagtccctagaatctcctcgcgttgttcttcccttgcttaattaatggcccaaatgctgctcgccccttgctctcctatggtggagttctctcggaatttttttcccgatttctttcggttttttcttggtttggttgctcctcgcgctgttattggttgctcctcgcggtctccttttttggtgaactcatgcggcgtgctttgaggtttatggatttttccctaattcgttctggttttcttcggggtttattgattcacgcgagattttttggcttgtggttgttgcaattgcagacgtgatggacgacgagaagaggccgagggtgggggatactgccgagagcccgcggaaatccccgcgcctggtgcaccgaattccgacgacgacagatcaggccgaatctggagtcggtctcaagtccttgcttgggttgatcaaaaacaatccgagcaaggagctcgatgacccaaatgctgcctctctcggtgaacttctatgatcttgttctcctcctcctcctattttcgctttcttcagttcttggttcatgttctcatccctagtccttaccgataatttggggtttctggattcacgcgagtttttttggcttttgattcttgcaatttcaggcgtgatagacgtggagaagaaggcagcaaggccaggggatactgcggcaacggcgctggatgtgaacgattggtgggagaaagtcgtggcgttacaatggatggcatcggtcggcggcgactgccgtgctcggcggtgccggcacgtcttgtatggggaggatgacattaatttggccatagcactgatcaagacctgcgatgacaccccaatgtgtaatgctgacaattgtggcaatactgaggggagggaaatctcggcgtgcttggattgcgaatcgcgtttctgcactacacacgggaaatggcacgcctcggtcaacaagcattgggttgctttggtgtacaaaaagccacatgtggcgtattgcttcgcgtgtgaagagtgctatttcatcagaactgagcattttggggtggtaatggacaacgaggatgactatttcatcagtttacgtgaggaggatgagaagggaatgagagttgacaatgtggcaggtgatcatgcatctgggtcagttattgggcatgcctgtcctattaaagggataccgaatcttggaaatacatgctacttgaattcattgctgcagtgcctccttgtgcttggaagactgcgggcagggatattaggactagatgctccattggggctccttggtagctcactgcgatctctctttgatgatgcagacagtgtaaataatgcaggaggcctgctggacccagagaagctcttggcttgtgtacgcatgctgaacccagagtttaaaggcaatggtatgcatgatagccaggaagcactttgcattttgcgcactggtttggacaaggaggagagggcaatgaagctgtctaacatgcaagccggtgctcccagtgcagtggctcctacagttattgattccatttttggcggtcagctgtctgttaccagttcatgcaaacattgctcagttagatcactttcccatgatgtattccatgatctctcagtgccactaccacaggagtctccagccaaaagtgatgaattatcaccatggactaaaggtcgcagatctccacggaagattcgtatcaacctgctttcagcaatagacaaacacaaaagtgacaatgaaaagactcagagtcctgcttcagaattggaagatgtgttcttggtgaaaagatcaaagcctttaaaagttggtaagcttatatgcttgtgtgcttaattaaaggaagggaaaacaatgctgaacaatcctacaaatgtgcatgctgtctcagaagtcagaacatagaacttttcatgaatgagcacagcaacctttgatagtaccagtattgtttgttagtttttgctcaagataagaaaaaagggcattttctggaacggcgctatcgtactagctacatgaagaaaaatgtttaaagacttgattcatacatggactgcacaacaggatgtttacattagcaggatgtttcggcagttttaacatggcatagatttttgttacaagtgtggcaataattatcaccaaggggagatagctcggggttttgagtccttgttttcgtataataattttttttctccaaattgttggttaacttaagtacatgtggagatctttgaagaaaagaagcttcaaataatcaaatgtagaggataaaggttctcaaaccatgtagagaatgaagattgctggtttcaggaagtagctgttgaggacaaaactaaaaacttatatgcttgattctgcagattctaccaaagtggaacagatatctcatagcatggatgcaggtggtcctttgcagactagaaaggataaggtccaaggaaaggttgttgatgtccttccccgcattccagaagatcctgcttcaccatcatttgtttctccactaagcgaagagaaaaatgacagtgctgttcaaccagaggttagtacagaagccaagatgaccgcttcctcagcaaaagttactacaaaagacaaggggaaaactcagattagcgatgttgtttatgacaaggcacatgatatcaactctcttgcatcgattgagaaatgcttggaattgtatcttgaaacagagatagaatggacctgtgagaactgctccaaagttcttaagaagccaggcatcatgtcaagtactaaggaggacacaacagctggagaccagagtgaacagttagagaagagtgcacaccaagtggaagaaaaccaaaatgagcagaaagataagaatgaatgtcccattcaaacacgtcttattcgcaagttgccacctgtattgaccattcatctgatgagatatttggaggatttaacgaaggtgataggacatgtgagctttaaggaaatccttgatgtggggcagttcatggatcccaggtagtgacaagtgacaactgcatctgtttttttccgaaaacatatgactgatgatgtttattagatttctgtttgttctatgcccgtgtaattaagtttcttatttgtagtaagctgataaatgttatttttctcaatttgttcccatttgttttacacttctcccctaaaagaatgctttcagatgacactagcattgcaggtcaaagtaatttagtccatttctcatgttttcttgctatgagtatgtggattattgtatggtgtgtcaagttgtaatctagattctagatgtctcctgtaaaattaaccatagttaaataagaaatggtgtgcttcttgatggctgtctagctccctttgcaagtaaatttcaattgttacgctgatattatgaaatgattacaacgaaacaaggtgacaacgtgaatgattctgctacatttggggaatttaattgtgatttgggtaatcaaataatttgaattttgggtgattttaacatcccgatctgattgtactctcttgctcttgcctaccctttacagtcagatcagatcatacatccttagattaactctaggctagaagcttttagctctttttctttaggggtgtgccttcaaatggctaacctggaaacctttttattttgttagaagtccgggctgttcgatatagttctgttcttgtttcagtattttagtgtatgatggatataaacaaacctaacattttccattggattgttgaaattatgactgtttatttgttgattttcataacatcatggttatttgcttaagatgatttagaccagtctttttaactgacagatatctcgctaacaatattcagttacaaggacaggcgttctgttatttacatcgagctataatgagttaaaagccttagatctgctctgatcatctttattttctctaatcttcagctctgaggacagagataattcccgctatcgtctagttggttttgttgagcacctgggccctagcatgtatgcagggcattatgttgcttatgtgagaccaagtcctccgcagcagaccaatggctcttcctcatggtttcgtgcaagtgataccgatatcacagaagtctctttagaagaagttctcaagcgcgaggcttaccttcttttctatgagaggattgaaggctaaggtgtctggaatcctgtatccaccagctgctaatcagaatagcaatcacaaaggaagcagatgttttcagattatcaagcattatttgggcacgaaggattcaattttaatcagtgtacatactgtactgacgtaggctcgtgatcaagttgaatttcgttgcttttgtctgagtcattgcatgagcgcaacacgtacataccagttgagagatttgggttgttcttgaacaactgattatttccacttctcttttgtccatgaggacgatattaggaattcatttgaaaagaaaacatcaaagttggacattttgcattagaggattgagcaagatgaatatataggcactggtacaattttgtcggatgttactgttacttgtagttactttacagtactgtaaaatcaggaacacattttcttttataccttgagctttgcctcaataatttttgtgatggcaagatacattgtatgcaagatgattcagatacaatcatatatcttgagaagtagtagagataacaagagcaattctttggacctatcttttctgaacggatacaatgttttttttttgaaaggaaagaatggatacaatgtgacatgcaattagagtatgagaccctactgctccgctgatgtcttgatgatgagatggacatttgctttgtttgcatcactgctgttcttctgaagcaatcaagaggaggatttgtttttaactaactctcttggaggtgtcaatttatagcgttggtgttgcccaagtgttgtgcaatcgagttggcctgacatcacgaatgaaaaaactgaacctcatttggaaaagaaaagcataaaaaggagaacatggaattctggaaagagggttcttttaagtaaatttaagataacttaaagttgcataatccaaccttagtataacttgtggcatgcaaccctgaatttctgatattatagtcccaggattccagaaaatccacacccatataatccagataatatatttaattaaattttcatgccataaggtgtctacagaattttaaattatttgttttttaaaattcagatgattgggttaactctctattactttgaaatattatttcacatatcataaactctgcggttatatgccatgagtatatacatgctttctattaaaaagatactaaatgctatttctagcatagtagtttttccaaaaatgaagctatttatctacccacctgtcatcatctttaccaatcacacacattatccactaattttctcatctactttctctacttaactaatcacaactttccttcattattttcacctacttttttaatatccgtggtcaaaccattttaggacgaaggtagtatacgtgacatttcgaaatttactttcattttttacaggaggaaatatatactttccatgggctccgttgaactcacgacggccacctaggcccatttagcccaatatacacccacccgagcgccgccgtccccgaccagcgacgccgccttcgccgctctccccccctcctctcctcctccaacttctcgccgtcgtcgtcgccgtcgccgtcgcggacgcctcaccccgcggcgctagtcgactccgggtcctcctcgcttcttccggtaagtttcctcccacatttccacacaccccctaaaccccgctgttcgtcgccgatgggcggtttgatcggtgggtgttggtgtttttttttctattttttttggtgtgcggattcgccgcggcgctgttcatgttcgatttccgatcctgttggtggattctcactttttttttggctatgttgattgatctcgctaatctgtagggtttgaattggggtttaagacgcgatggaagaggggaagagggcaagggcggcggatactgccgggagcccgtggaaatccccgcgcctggagccgccggctgcgtcggcgtcggcggcggcggacgattctgagtggttccaggcgatgttgctggaggccagcggcaccggcgttgagcggtgcgagcacttcatgtctgaccaggatcacgtcgattacatcgtgtcggggctcaggttctccgaggacgtcccggtgtgcggtgattacacctgcgacgtcaccgcggcgaacgatatcatggtgtgcttggaatgcgagttgcgcctctgcgccaaccacgcctgtatccacgccatgcacgaagaagagcattcgattgctttgtactatgagagattgaatcgggtgtactgcttcaagtgtgaagaagcctatgacatcggtgttaaggatgatgatggggggatgactgacaacaatggggtgccgcgcgaagagagcccagcgaaatcagcgttaaggatgatgatgggggaaagcctacgacagaggtcacatgtgtctgggttagctgatgggcatgcccatgctatcaaagggatactgaatcttggaaacacctgctacttgaattcattggtgcagtgcctccttgtgcttggaaagctgcgggcaaggatgttaggaccggacactccactggggacccttggtacaatactgtacgatctttttgatcagacatacggtgtgaacaatacaggaggcctgctggacatgacttggctcttggcttatgtacgcaagtcggactcacggttcataggagcttttatgcaagataaccatgaattgctttgctgtttgcgaaaaaaattggatgaggaggacagggggacaaatcctcctaacatgcaagatgatgcagtgactcctacagttactgattccatttttggtggtcagctgtcttctcacatatcgtgtaaatgttgctcatttagttcagtttcacatgttgcattccatgatctctcggtgccccttccaccaactcaatccaaaagtattgcatctccaccgaggactaaaggatataaatctcaacagaagatccatgctgaactagaagttgacaagcgtaacccagaaaagattcatactattgctgaagacagtgattctcaaagtccttcagaattggaagatgtggtattggtgaaaacttctgagcctttgaaagttggtaagtttatgtgctcctgtgcctaatgaaaggaaaggaaaacaatgttcaacattcctgcaacattttttttaacagtgcctgcaacatgttgggtgtctcagaacatggaatttttcttgagtgaatgcagaaaactctgatattaccacaattatttgttagtttttgctcaatataagaaaaagggcatttttcggaaagagttaatggcttgactgttaaatatactacagaaatattagaacctgcaggatgtttctgcaattatagcatgtcatagctgtatgttacagtgcagtagttattcttgccactggaagatagctctaggtttttgagttctccttgtcttcatataataaattttgctccaaattgttggttaacttaaagtacacagaaatccttgaagaaaagaagtttcaaataatcaaatatagaggataaagactgtatttcagaccatgtagagaatgatggttgctgatttcatgaagatactgatgaggacaaaaaaaattatatgcttgattctgcagattctactaaagttgaacagatctttcatagcaaggatgctgtatgtcgccctttgcagactcagaaggataaggtccaaggggagactgttgatttccttcctcaaaacatgttacctgatgtcaaagttgaggaaatggatttgacaaaaacagatgcccatgttccagaagatatagggccttcactaaggaaagagaatgcatggatagaatcaggaagtgatgtagggaaaaatgtcagtgctgttcttgatgatgtgttcagtgagccagaagttagttcagaagccaagactgacactttctcagtagaagttaggaaaagtcggagtagtgacatttcttgcgataacgcgcagggtatcaactctcttgcatcaatagacaagtatttggaattgcattttgaagcagagatggtagaatggacttgtgagagttgctccaaggttgctcagaagccaggcatcaatctaggtaaatacagtaatcctatgatgtcaagtaccaatgaggacataacagttgatggagaccagagtgaactgtcagagaagataacatgccgaagcgagcaatccaacggaagacctgaatgccatgaaggtgttcaagaagctgaacctagttgcattccagctgagaaacaggccaacctgttgagcggccaggatcaaaatgccagcatactaagtgaggaaaggggggagcaagtaaagcttcatcatggtgcacaccaagtggaagaaaaccaaaatgagcagaaagattggaataaaggtggaattaaaaaacattttattagcaagctgccacctgtattagtcattcatctgatgagatctttgttgggacctcataaggtgataggacatgtgagatttaaggagatccttgatatgggtctgtttatggaccccaggtaccgtcgtaccgatacctcatctctgtttttttttttttgaaaatatattggcattggcgttcaacgacttctaattgtgttaagccaatttaaatatctatcttattggcagtaagccaattaatattttttttattaatttgttcctactttaagaatacacctctagcacaaaatgatgcttttagatgacaccagcatttcatatcaatgagtaatttatgtttccttgttctgctgttatgagcatgtggattgttgtactgtgtgtgcaatgctttttatttgtccaattcaacctgtaaagctctaaattgagcaatctcctgttccacgcaaaaaatgaattgacaccagagtaccagactgctgtattttcctggtataaccagttcgttttgtgtagcataaaggttgtttaggacatgggatagcactgctcttgtttcttgctgacagaccaacatggattaatgataaaaccaatgttttaattgtcatgggagcatttggtatggaatagctcattaagtaggcaatgagacaatttggactatgacaaattggcagtaaagtgaatagacattcttaagctgcagcagatcaatgaaccccctcccacatgggatttactgaacattattaacccatttaggatttttccctaggtgcacctgtgaatggctgtctggcacccttgctagtaaaattttgaatggctgtctggcacccttgctagtaaaatttcaatggttatgctcttattatgtgaaatgtgaaaaaagaaaacaaggtgataatgtgaatgattcaactgtagtggggagtcaagtgcgatttgattttaacagcatggtttgactgtactctgctttcttgctcatcctacctttagagtttagagtcatctattgtacaccctctctaactctaggtgtgtttatatgatatcacactcattttcctacctaaatcaacccactgtaacagagtatcattgactacactggattttttcaatcacaatctaattaaaatccaatttataatatctaggaacttctattctttccttttcttttgtcggtgtgtgccctcaaataactaaccaggcagcacttttatttgttaaaaaactgaattgtttgacatactttttgtttcagtatttttagtgtatggtggactcgtaaacctaatacctgtttaaattatcacagtgtgtcttatttgttgattatttttgtaacattacatggttattcacttaagatgatctatactagtagtattttgtataatagaataattattaacaatattcaatacaaggatattaacacaagaaagatgtttgctgtttacatgtagctataatgagttaaaatctgcttttcatcgttttttattttttctaatctttcagttcagaagacaaagataatctcagctatcgtctagttggtgttgttgagcaccgcggccttggcaacgatgcagggcacttccttgcttatgtgagagcaagtcctcggcaggagaccagtggctcctcctcatggtttcgtgcaagtgatgacagcatcagagaagtctctttagaagaagttctcaagtgcgaggcttatcttcttttctatgagaggatggaaaactgagatgtccagaattcaactaatcagaatagcaatcacaaaggaagcaggtgtgccagattgtcaagcgttctttggacgaccaagaatccaattctaatcaggttaatttggctgagtcatttcagggcttcaatttgatcgcgacatgggcatgctaagggatttcagttgttcttgaccatctgatctgcttacatgcatgcatatccatcctttttatgttatgaatgcgttaggattccatttgaaaacagaaattagtatagttggacatatagcgttagagaattgaacaaggttactatataggcacaggtaacagttacacccctggtacagtttttgtggatgttgctgttatttgcaattactttacagtactatagagaaatggaacatttactttgaaatttgcctcaatatttttgtgatggcaagatacatcatatgcaagatgatacaaacttgaaccttgaaatagcaataacaagtgcactttttttttctttcttcccttgttttctagatggacattatgtaacacctaatgatctccaattctccattgatgatgagagacatgtgctgtgttagcaaaaaatattttctccctaacaggccccatatgggtagaggaaagaacaaaaaaaaaagggggtccattttatatgttccattcatatttctcaatcgaaaatcagatatcaattgtcgttaaactgttaaaactagtataagtctaaaccagtgtaagtcaagttgcaaaatcacgatgtggcccgatttaattctgcctgggatgctagagatagagtagaggaaacggatcatgatgctaggggaaggggagacaaggagctcgagctaacgtggctgcttaagccaatcgctattcatctgcgtccaccaagggtagaggaggaggaagagatgttaatgacatattggtcccactattttctttctaattgtattcatccaatagacgtcacgtaggagatgacaaccggttcaatacaccatgtgggtgtcacgttaatcatcaaaaagcaccatccgaaactatctatggattttaagggtgtgtttggttgtaggcaagttatggtagtcacaaaagtgtggtgaataaattgctagccacagagtatggtaaaattggtaagaaaattaagtctatgacatatatgacatgctgttgaaaaagtgtggcgagtcacaactgtgacagtgaactaaacacatatctaacaaactgtggcaataaaaaatgtagtgtggcaaaatgtggccatgaacctaacacccctgcatcagctttaatttgctgtggttgaattatcggtggggagaaggcccagttaatgctacttgtcgtctcctttaatttgctatagtccagtaggacatcctaggtactcactactcagtccttcactcctttgtcgtcgattcgttcgtggtgctcttaaatatcttcgaaatatagggcctgttcactttggtgtcattttcaaccttactaaattttagtaaagttgccaaaaaagtggctacatttagtttgctgctaaattttggtaactatataagaaatcttgccaaaattttggcaagttaccatgccaaaatgccaaaatttgataaggtttttttttggcagcaaagtgaacatgcccatatatatcacgggttaaggagatggacggtttggatttcgctatcttttgcaaatcatgcaatagtttgtttttgttttttgttttttgtttttttttcggggataattgtgccatagttagtggcctctctgcctcactcgacatgaacaagaacagcagcagcaggaggagacgagggcaataacagcagcagcattttctgattcttctcaattggagagagtgctcagtgctctcctataaatcctactagcactagcacacccaaagcgaccaacgagtgatccgatccgatggacagtcgccgtcccttgcttattccgaatgagggtgacgagccgccgccgcagccgccggagccgccgctcgccggcgtgtccgacttccgagggcggccggtctaccgcgccacctcaggcggctggcgctccgcactgttcgtcgccagtgagcgtgtactgcgtataccgatgtttgttcggtttggttaattttgttccttaatttgcaaagtttgattagatttcatgagagattaattgattaatgaattgttgcagtgttggagatgggctgcagcttctcctactacggcgtgtcggcgaacctgatcagctacctgacggggccgctggggcaatcgaacgcgtcggcggcgaacgcgtggtcggggacggcgcgcatgctccctctcctcggcgccgtcctcgccgactccttctcggccgctacccattcatcctcctcgcctgcaccctctacgtcatggtaatattttatttattatttactatatattcctccatccatttgttattatttattgttaagattgtaaataaaactggtcactcttgttttttccaactcccacccaaagtcaatttgctgcaaaggctgacccaccaaatccatccgtgcacgcaaataaacaaaggctagatcagccagctcgatacctgttgtactctctgtcttaaaaaaaatataaattctagctatgattctgaatatttaatttttttagacggagggtgtagtttaaagcagaaagatgaacttgaataacttgagggttgaaggcaacggcgatgagccgatgagtagtgacaatcaactacggtcatgctctttccttcttattgaataatgcattataagaagtgaaattattattaaggataaaattgaaaaggttttgaataagacaactaacactccgtaatgataagtattttggaacaaaatttaaattctaaaaagaagtaatttaggataaaggtagtactattctaaagagaagtaatttaggataaaggtagtactatgggtacacgttggctgattggctccataatgataagtatttatcaaaaaagggtttgggtgattggcctttgtaacaaatcagcttttgagggtaaattcaaaacagaagtgataatttggtggtttattcaattttgtcaatgttaatttagtacttaccactcctcgatgaataataatggagtagcaccccgtatatgccagcatgtctgccatgaaattcgtgttacttctactaatactcctctgaccacttgttatattgcccattaacgtacgaacacaattagtaattgatagtacagtactagtaatcatcatcaggacaaaaatataatggaaaagatagaaatgtgcatatcgatctgcatctgcaagcaacaaagacgtggatgacgcgtattaattagtacaagcactgtcaaaagaagaaaactctctgctcacacatttggtccatccaattaattaagccctgtttgattcagcttataattattataatctagattattatgagtaagctaaaacaaacagatagcttattataatagattattataatatataagccagattactataatttggtaagccactctaaagatgcttattttagattattggatgactaacaactaacaaacagataataatccagagaaacaaacaactagcagcttattctatatcggcttattataatccagcttataataatctagttctataatctagattataataattttaagctgaaacaaacatggactaagtacttatatatctgaccctttcgcaactgagcgatcaaatcaaacactgtcaccatctccctgctccaccttatcttaatcctatcttaaaaatgttactcccactggtagagtattaatcttactcactaatatgcgtgcattcttaaaataaacaacaaatgtgatttaattgaaatgaacgtgcgtacgtccgttcgagagtgatcagtacccttctccgaaaaattcaaatacaaattttaaaaataaattaatttgatatttcaagcaactttatataaattttttttacaaagaatacaccattttaacaatttaaaaaatgctaagaaaaatctatatcttaagtagaattaaatggacaaaggttttgagaagaggagttattaggtagggaaacttgaacggcggaagattattattggttgaaaaaatgatatatatatatatatatatatatatataaactacgtacaaaggagttatattttatgataaattttaaaggtaaaaacttattactacaaatattttagaacggataaatacaaaattgattggatttcacgcgcatgggcgcatgattgcaggggcttggcatgctgactgtggcgtcctcgctgccggcgtgcgccgccaccgtcgccgccgccgccgcctgccgtccttccatggcacaggtgatcttcgtctacgtttcgctctacctcgtcgccttcgctcagggattcgacaagccatgcgggttggcgttcggcgccgagcaattcgacccgggccaccccagggagagcgccgcccgcagctccctcttcaactggtggttcttctccatggccgtcggcgtcgccgtcgccatcgccgccgtcagctacgtccaggagaacgtcggctggggcgtccccttcgccgtcgtgtcctgcgcctccgccgtctttctcctcggcacccccacctaccgcctctacgcgccgccccgtcccgacaccgtcatggatggcaagcgatcgtcgtcgtcggaggaggatgcgcgtggcgcgctgcggcgcctgcttccgatatgggcggcgtgcgtggcgtacggcgtggcggacgcgcagatcatgacgctgttcaacaagcaggggcggatgctggaccgccgcatcggcggcgtggagctgccgcccgccgcgctccagacgatcgggccggcgaccatcgtgctgttcgtgcccatctacgaccgcgcggtggtgccggcgctgcggcgcgcgacgggcaacccgagcgggctgacgacgctaagcggacgggggcggggctggcgacgtcgctggcggcggtggaggggcgccggctgggggcggcgcgggcggggcggcggccggcgatgagctgggcgtggctggtgccgcagtacgcgtcgatgggggtgtccgacgtgctggcgccggtggggatgcaggagttcttccacggcgagatgccggaggggcggcgcagcgtcgggctggcgctctactgcggcgccgtgggcatcggcggcttcgtcagcgccgcgctcatcgcggcgctggatggcgtcaccaggagggacggcggcgaggggtggttcgccgacgacctcgaccgcggccaccctcgactacttctactggctgctcgccggcgtcagcgccgtcgcactcgcgatgttcctctgcttcgcccgctcgtacgcctacaggaacaagacgctgcttgtaccatcaaacaccagtagtattaatactcatcatgcatgatactagtacgacggatcgatgcatgtacggacagacaatccagattgcagactgattaattgattatgcatcatgtaaataattcaccctctaattcatagtaattccattccatactggcatgctcaaaagcaaagcagtcatttgggtaaaaacttgctagtactccagttgtatcaagaagcaattgcttcttcaagatatatgctaaaacaatataaaattataattattttaaaacataaatagtactagtttctttctacgccacgtaggacgatagaccagatcaatgcaccacgtaagtagtttaaccaaaaccagcgaccaaggggaacttaatttgcactagttttataccttagttgtactctatattcgattttgcagttgagtgaacttttcaaaaaaaaaacaaacaaaaaaacaaaacaaaacacaaaagaactgccgctattcctcaattccacccctccatgtactccttccattatattggcgttcatccaaaacaaagcagggttaggtagcaaccatgcgatccacgcacatgaccacctctctaacaggaaactatttaaattttttttaatttttttaacaagataaattaatacgaacattcttaatttaacttttacatattgccaaaaaaactatttttactgttaatatacattaacaatttataatttaatttgttttttttaatttgtagaagttaaattttaacagtgatatatcacatatacttcttaattttttataattatttagatagcatgcaaacaatagagatatgccttctcgagagtttaaaatccactccctctttctttcgggattaggcacctctaccttcaaagaaacgtgtgtttgtcattgtgaacccgatgaaccatggacccacctattatctcaagagaaaatccaagaaataccattgacaaacacccaaatctaaaacatgctattgacgagtccgagtttccacaaaatattcgtacaaatgatttagtatcagaaatgccattgccgttaaggtttcgtccatcctacgccgttaaatgcattgtttattctatagcacttaatggaaggatgctaacggaaccctaacaacgatgatattttagagacaaaatctcttgtatattgatattacatcaaacttgtatttatccatgatatttgttggaatataaagtgaattgcccgccttttctcatcagcttaaatttttgggttgaactggtcggtgcatacaactcaatatggtattagagccagatgtctcgagttcaaatctggctgtcgcgcaattaaataaaagttgctgcccatttctattccacacttgcatgcaactcaatactaatatttttgaaattggatgcttattaattaccaacctcaactctcag

SEQ ID NO: 79506 - DNA, 4322 bp, Oryza sativa
tcggtcagaccaactgcttccaggcggtcagaccggtgcaactactttggtcagaccgcgatccgtcgaatttgagggtaacttctaattctgcaaaaagtttgggtttttgagtataccaaccattcaactctctctggttggcttagttcttgtgtttcgatcctacaatcacctcctcgattgaatcacatatatgcatgcaaacaatataattagaaaacttaatggtacaggaattaaaataaatatttaatatatgcatacatacaggccttatattataagacatgagaaaaaaaatggttgtgccttatattttggcatgtagggagtaatgatttttaaaagatgacacatgtatcagtgagagaggtttactgtagagatttatttatcttctcagaataggtgaggagtaggcaggcctgtactgatcttttcatgatctctaatgaaatgtaggcattaacggctatttttttattataacagcaaaggtgatatatttaaccatcacgatacctaatttcatactaattgatgataattattatatgttcatcaatattatcagaaatgtattaaaaaaactagtggcggagaatggattttaacatgatggggcccaacttattaaacaacagtgatcatcgaaaaatggcataaccatatatgattgtcttaagtttttcttggataataaaccaataaaaaagcaaagtgattacataatatgttaattgaggagtgtgcgtgaacaatttaagtccaaacaatttggcgagtagagaaataagttctcagtgggaatttttttccaacttgaaaacatttctagagcataatgttgcactagctaaacataataattcatcacacaccaatataaaatttggttggactaagaaacaaaggcacatgaatttgatgaaattagtgcaatgctaaaactgtgtttttagggatgtttagatcccctgacaagttttttcacccagtcacatcgaatgtttggacacatgcattaggtattaaatataaaaaaactaattacacagattgcgtgtaaattgcgagacgaatcttttaagcctaataacttcatgatttgacaatgtggtgctacagtaaacatttgttaataacggattaattaggcttaataaattcgtctcgcagtttacaggcggaatctacaatttgttttgttattagactacgtttaatacttcaaatgtgtgtccgtatatccgatatgacacggcaaaaatacggatatacggacacacatttaaagtattaaacgtaatctaacaaccaaacaaattatagattccactcgcactatgatatcggctggcaagctgggtttaactgcctttgagtgtttgttgggtataatgctggctgtataagttcagacttcagattggccccgagtcccccataactctctttgtaccaagctcgatgcaacaaagtataattatattcatttatcatgtctgcctcatgacgtaccaggagtatacttcggtgtttgatgtctgcctgatgacgtcccaagcatcaatctggcatttatcacatggctacttgcagattctctccaaaaacaacaattggccattgactcttattatttatgatagccaatactctccatttccaccatcattcttttgtgtttgataaggacatggattgttcagttttttttctcttttaaaaacattgtttagtttatatcccacttggaaggagaggaccgtccatcagagatgcaatcaatgatggtgagtcgaaggagatgaagaaatagaagattttaaatccagttgcaatcgttcgcttcgctcccgttacgactgagggggaatgttagaagtataatatgttagttagagataagagtcaaatacaaattatagagataagatatatcctagagatagaatcctagagataagatagagtcctagagatagaatcctagagataaatctactcttacttgtattgtactccaagtctctatcccctacgtactcctatatataccctacgagagggccgatgtaatagataagaaaacaccagaatacaataattagattttccacaggagagacatcgatttgttttaaatagtcatgagcctggtggtgatgaggatgaggagccccttgatttgtgaatgtcgtctaatgataatagtttatcagcctaaaataaaagtgatttgttgattgacataacaacttgaaaaatagaagtatccacttggaacactactagagaaaccatctttactcggtaggccaaaaaccacaatagtcccaattgctcaaaaaatcgtgactaaaaatcatttttcgtcccggttcaaaagcccaggcgtactttttgatctttagtcccggtaggtattattagtccgggtttaataaatggcaggaggtgtcagacccctctactatctttagtcccactaaaaatttatttttagtcctggttgttaaacaaccgggaaaaaaaggctctatccgcacgcgcatgcaagtcctctcccatcctccatccttatctccttctctcccatccagccatcctccatccttatcttcttctctcctcctcccatcctccccttccttcttctctcaccccatctcctcctccccttcctccggggggcggcgggatggaggccggccgacggcggccgggcgtggggtgacgggatggaggctggccagcggcaggatggaggccggccaccgacggccgggcgtgtggcggcggcctcgccctcccctccaccagattcggccggaggggaggcggcgggatgagaggatttgtttgagtttttcttgaatttttgatgatttgtggatgttgttgatttgtgaatatgtatgagaatgtttatgtgaataaatttgtgatgatgtgttgtgaatgaatttgtgatgatctgtatgaatgaatttgtgatgttgtggatgaatttgtgatatgtgttgtgaatcaatatgaatggagaaaaaaagggaaaaatcaaaggaggaaaaaaaagaaaaaaaaacatagatggttgtatctttagttccggttggtgactaaagatgcatctttactcccgggtatttcaaccgggactaaagatagcaatctttagtcccggattcatagtcccggtttgctacctaggattatagggggttataaaccgggactaaaaagggttagtgcaccagtgccattttatttctcccgctcaccacgaatctcaaaggacattggatggtcctaaataaacgggttattttaatgaaaccgatcatttaaaagataccaatcaacacgcatctcaaagccacatcagatatcttaaacatttttttagcaatatcgaatatttttaaaacacccaaatatattaactatcagattttattttggatggggataaaattattgtgtttgttttagcaaaaccaatcaatgaaaaaagtacgaaaatgctcattatcaagcgaccaacacaaggcgaaccgaccactcatttcctcatcctctctctctcttcttcttctctcttcgctctctctctctctcgcgcgcgcgcatccgtatttggcactcgcatctggtggcgccaccgcccttcttcctatccttcctctgcgtcattgccaaatcaccgcatctggcgccgccacccgtcgtagccacttctggcactgccacccgtcgtcctctcctctctccgtgctgctgccccatcgcctggaacttgggagctcgggagctgtggaacacgacgaccgagcttcattgtgatatcccagcccagggcttaataggattaatagaatactcatatcaacaagttgcaacttcttttctggaagccgatctctaaagaactctgaggttaagcatgcttggcctagagcaatttagggatgggtgaccgatcaggaaattctttccaggtgcgcactttcctaggaaagctaccagatgtagagagggcccggcctcggaaagtgtggggcgtcacattcatgcagcatcgatgatggtggatacgtggatgcggtggagctcgtcacgacatcgacgcggaagtggttgctaaccactggagtggaggaagaggtagatctaggttttcatcttgaattttttgatgtttcagtgcatgtactatgatgtttgattagttatatttgaaatgttgcagtgggtattcgatggtttttcattctatttctcgatctagaaatgaaacagttgggggccgaaca

SEQ ID NO: 79507 - DNA, 7267 bp, Oryza sativa
tttcataataaatttgtcttgggttgaaaatgttactacttttctccacaaacttgagcaaagttaaagcagtttgactttgactaaagtcaaaacgtcttataacctaaaacgaggggagtatttgatcttgaatgctacaagtgctccaaaaccatcaaaaggtaaaatttcttcattccaggccatacagagcacggcacacaagtactgtacatttttcttctcctttcggtaaattgctacatggtagatggtaggtagatggaataacaaatcatccaaaaaaaatatagctccggcctagttgattgcatgaaaaaattggcgttgagatgccatggccttaattacttggatttaaacttgagtatttagaatcgtttgcatagaatgtggtaacctccagtactagaaaaacattttcgccggtcgccgtccgcctgtagcccaacgactgcaaagatcgccgatcttcgcaggcgggttggcggtccgcctgggaagataattttcccaaacggagtgtagctagacccgtctgcaaaaatagataacggccgcctgcaaaaaataacaaattaccgcctgcgaaggtaggttaaaaattttaaaatttgatacaataataatttgcctataaattagttttcaattatttaattgaaattgatgcaggaataatattagtaaataacaagcttttgatacttagaaatctacatatattgcataagtgaaaagtgttgacaaaatattacaatattttttttttacattctcacttgaaatacgctatctaattatattttggcatagcattgctccactccagaagatgcttgtattcgttacttgtagctagggcaccctctgggtcgaagaactctcctttcacatgacaacactcacagtggatgaagtggcaaagatcgcgctagatatttatgatgcatgtatcatcaaagcttgttcgatgttctattcttggcaactgcatgcattgaagaaacacaatatattagtatcatctatatgtgaagttgtctagtccatagtgtagaaacttgcatcctctgcgttaaccatgtacctcccattaaccctgaggaattcgcacgcgtaatacccatagaggacagtgcctttaggttgcttgtgacacttcatgatatatcgtagaagaaaatagttaaattttgcaattagtgaaacaattggaatacattaagtgagtggagtattatcggccaatatgtatgtactagcagcttctcccttgttcgaatctgttctccacccttgaacttgtagtagctgtacgcactatatggatttcgtatcgtttcgcattaaggaggagatttaattataatacattcatagtatacatgcaagtgtcagaatcacttactattgtaagattgttagaaattctctgtatgactggtgacgataatcgagagggtccaagattgtcacggttccgtgcttcgggtagatgattaaacagatgtaatgatcgctacatattaacgacaatgcagttagtcgcggctaaaataaggcatatatgtagaagagaaatgtactggacttacttaaaattataagaggccaggacgactctcttattttgaaagtgcaagaagactcgtccaatgtactgtgcaatagtaatcattttttgcttctgcaagcccaacttgtattcagctatctcttcgggagtcttgtccttcagctactctgaccctagtgataacctcacggtatgttgtgtttgacagatcctaattggatccaggaatccgataagttcttttttctccttagcatccatgtattgcatcctacaaaagaagtttaaagaagtttgttagtaataatcacatggttttgtattgtacatatttttcatgtaattaatgtaaactcatactcacaggcacccagcagcgacatagttgacgtccatcttttcccgacgatatatggcgtggagatcttcaaaatctagccagaagtaaccgttgccgccgaaagcatctatcggtgatcgaactgttatattacttaggcctttcttgctagtgtccatataccatttatgtaaccttctcatctcccatggaccgtcctcaagtgcaaaatccggtcatatttctttcccatgttcgtatttttccgggcaatcatcaattgccaagtttttttttcccggctagtgcagcggccttcttggggtcatcttctctgaggttggcatgttccttaccccttctaaagacggataccatgaacttctccttttgatcatctttggacttggaattgtggctcctaagcactctaggcacttcagacttctcagtggccttgtcattgaccgggggttcttgcacctcagggtctttcgcaggattagggacttcaaagatttctagatctgtaccgtcccattccaaacctggtataacttctatatctgtaccgactattgccagaagttgcacatctagttgtggcactgaaatctccatgggcacatcttgcactgaaatatccatgggcacctccggcactgaaatttccttagacacctccggcactgaaatctccataggtatcttgggttcttccaccttatcagtcacctgcctcttctgaggaggtctcggaggtctcggaggtttttgcacccccggttttggcaccaccagttttcactgggcgccggtgcccaatccaaagaatatgtcattcttgtgccaaagaattataatatcgaccgcatccccaagtacggatacaccatcaggagtagggatgtcgatgtcgtacgactcaaacccttggtggaccacttgcgactgcactttggcatactcatcgggtatgaactctccgttatatgttctgccagggatagcaatggctgtagcggcctcaagagttcttccaaagcatctaattggaacgtgcaacttacagggtgtattctccttcaggtcatcaaaggggtaatctggctcaggttctttggttgcggggtcaggcaaaataagatgcctaatgcagaaatccatcatttgcctttcaaattccttagccccttcatcccttaggctatccttgtaggcgtcacatttcttgtaggggtcatgtttgaacccttccttccaactgagcttggacgatacacctcgaaccctaccctctgtgctcaggagtacccagtgtcatatttagcacatctttctccctctttggcttaaaaaatcatgtcttctatgcactggataaagactctattttattggcaaccccttgcagctcgaggtcttcaaacgaaaattcgccttcttgcgtgatcttaggagttctagcttttacccattttttcgatatttcgctccattcctccattggtacctgaagccccgccttcctcatttcttcctcctcttttgcccactgcgccacctttggtgcataccccccggagcctaagcgatgaggaaatctgttcttcttggccaactcagcaaacttcttgctcttggcaattctttcggggaggtcttcaacttaacatagtcgttccactgtgtcggtgttatattggcatatgtctcaaatggtgtccggcccgtcttcacgaattttgtgttcaatgtgtttttccaaccacgccacgacttgtccattgtttgcagtgcacaattcctcaccgctgcttctgatccatccgggaactggaacattttcttcagctcttttcataggacttccttatctccatcctatacatgatcacagtccttgatcatgattgtgatcctttcccttactattatgacacactgtgaactgaatctcgcacgtgcagtcagaggggcgagaggctctccttttggaccaacatgggtcacaacatagaacccttcgtcgtttttattgacgcttctctcgcccttcttttcttcgcctgtgctaacttatcggttttctttgagccggtggacttagctgggacctcgtcgtcttttgacttatctttcttcttggctaccgttttgatctccgtggccccgtttcctatgagtaggtatcaaagtttcgaattagttcgggctaatagttatcactcaaatagttcagatcttaattgtacttatcccttaatcacggggaatgtagtccttgtcgcctttttcaccctcgtcctttttccgtcatttcgggcttggacaaggatcacttagcgaggagtactcatcatcctcgtcagctacgtcgttgtcggaaccattggacggcggcaccgttggtttcggagcaaccacaatagcaagggatagctccactgtcggatgtgaagactccacctcccctacagataagttatcttcatttcctttagtactatcggccatcgtttcgtacttctaacataaaaaataaactatataattaatatcgagcccacatgtcatattaacaaatttaaattcgcccacattgccatatattaacagagtaattaatatccgccgcaaactattttctctgtcatttcacacacttttttcccggatgtaggttttagtggaggatcactctcttcagtgccatcgaattccgactacatcttgtggtacttgtgatttgtgcgtaggaaccgtcggtgccgcatgtatacaagcttatttgaacccgggagaggggcggagcccaatgggccaggggttcttaggcaccgggcccaatttttatatttagcggttacaaccccccccccggcgcggaaaggcacgtggcgcacgcagagggagccgcagcagcgcacgcttgcgggacggcaccacgtgtcgcacgattttttccccaccaatttttcctattcttttctggttttttctttctgttttttcttttggttttttccttgtagtttttttttccttttttatacgtacgggacgtaaagtttctgtatgcgtatacaaagtttgtgtacgcgtatacaaactttatatatgtggccgatttttgtttccgcctttttttctagttttttctttttgtttttttcggtttttttgcttgcaggtcttttggttttttgttttttatatgtatgggatacaaagtttctatatgcatatacaaagtttgtgtacgtgtatacaaacgttgtatcccgtacgtatagaaaatttgtacatgtgtacaaactttatatatgtgatgtattttctatatttttgattttttaatatatatatatatgtataaagtttgtatacgtcgtatataaactttgtatacatatgcaaaagtttatatacgtgtgtatatttttgtaagtagtagtagtatagtatagtagtactactactatcaccacctagctgcgcgtgtgggccccactagcagcagcagcagctagtaatccaagctgcgtgcacgggcccgctagtagtagcaacgctagtaacagtagtagtaagtagtacactacagcagtagtagtaggaggagcggactggtcgcgcgctcgcgcattaggggtctcccattttcaccacatgagaacccctcagcccaaattcgtgcaccacccctagcccatgagcgagtcgtggaaggctaggcccatcaacacggtgcgtcgtctgggccaccggcgggggagagagcgacgcctcgtcaatccaaccgcgccagcgccagcgccgcacatctccccgactcccttttttttcgttttttttttctttctttttacaaacgcgatacgacgtctgtgtgagtctgttcgtctcctctcgccatcactcgccgggacaccgtggcgtctactcctgccgctcagcgccttgtcgagatcgtcccgtcctggccagcaaactgccgctgctgttggtcgccctagctagccgccggcagcaccgcagcactgcaggtctgcaacggcacggcggcagcgcccagcgggcagccggagtactactactacagcctacaggcaaccagcaacctgcagccgagcaagcaaactgcattgcacaagcagtcaagcacaagcaagagactaaagagtaaaagataggtacttatttttcttttaactagttccagagaatttcaatttatcatctattctagttctagtcttatttttaatcctattatttgatttctaacttgttaatagcaccttttcaattatccagatttaatgatttatataagctagggaagaactgaaagtttctctggaagggacaaggacatctgttgtcctgtagtcatcagtccatcaaggcatcaaccatcacttagtaaaattgtaagcatactgtgacaccatcataattgctaaataatttgtcttttgggggtgtacattattctattgtgcagtgcacttatagtctaacataataaaactatttaattgacaggttatagacaagtaccttgaggaaagcgctcgatagttccaataatgcagctgtacggaattcttgtccagaacaagtcgatgatggtagttgggagaacgagattgaatatgatccaggcttgagaaaagagattgatgattaccatcctagtaagagggatatagtcagaaggaaatacttgcagaaagggccttgccaaccatgtctattcacttttccggttacaaagatctcaggtaaagacagaaagtttattgaggaatggtttgatgaatttggaagttggcttgaatataacaaggcaaaagacagagaatgttgttttagagatcgcaataagaaagaggatgggtataaagcctttgtggttgatggttggaatggttggcatagaaaaagtaggctaaaagagcatgttagtggtgttggtagcttacataatcaagccatgaaaaattgtgatgctttgttgcaaagagcccaacacatcgatatacatatgcaagtgcaaagcgaagctactaaaaatgcatattttgttcgattaaatggatcaattaatgttgctaggaggttgttaagctaggtttgccttttcggggccatgatgaatcaagtgattcatacaacaaaggcaatttcttagagtttcgtgatttcttagcagagcatgatgttgctttaggcaaggtagtggagaaaaaaatgcatcgaagaattgtcttatgatagctcctgagattcaaaaggatattgttgactgctttgccaaagaaatattacattccatt

SEQ ID NO: 79508 - DNA, 1883 bp, Oryza sativa
tgtgttactggtcaagctttctttggcccatgcccataataattgcctagtagacctgttatagaaaactgctggattttatgcacactgctactcttgaaaactttgtagagttcaattaattttattttagcggaaataatatttcaccaaaaaagttgccttgcaatctgaggcagcttgtaatttctctgctgcagagttgttcaagtccacttctcattatattagaggttgttttatctcactatctgtacttctgagcaaatttagctcaggaaatagtgcagtaattatctggatcatatccaggttatcttattgttatagttttcttcgcttagtgttgcggcctaaataacagattaagctgtgatgtgcttctgattaccttaaaagattgcagtatcacactatcacttatttatgttgcaaattaaggaatcagcttcagctgctcacaccaatcaagcttttgcttttgcaggatgaaggtggaggttcatttactggcgttgatgatcttgctggagcattctcaaaggtttgttttttttttaaagcatagctttttaaccacataatatacacaaatgtgatctaacagaaacatggtgtattttatttttttttttggtagaaattgcagaatgtagattatagataaataaagttgcatattactgttgtatacctatttgtatgcttgcattgtgttgttcttttttaactgtgaacttatttgttgatttctccactttcagttgaccagaagcatcaatgaaccaacacaatcgggaataattagtcgtgggggttcaatttctagacaaagtgagtgggtatttgatttattccatttttcaaggatatatgtaagattcgttacatctggccaatgggatgaacatatccattaattttccattgttagaatgtgaatttcaatacatttttacagtctttgttctcttgtaggtttagggcccctttgatttgtaggaaaaatgtaggaattttggaggatttcaatcctatggaaaaaaaatcctatgaagggctttgaaacaaaggattgaatcatatccaatcctttaaaattcctatggaatgggtaatcctatgtatattttggaggaaagttagcaagaggtctaacctcttggaaaatttcctctgagtctatctctctcatctgattcctgcgtttttcctctggtccaatcaaatggtcattcctgtgtttttcctgtgtttcacaatcctctgttttacaattgtattcctgccagaatcctctgttttttcattcctacgattcaaaggggcccttatatatggtttctgatttattaacattgtattctaatgttaatgaattcaatttgtgtaggttctactctggactgggcacaagattcatattggcctacacagcctatatttggagctgaaccagggctgaataatgaaagccggtggtctcaaccacctcatttagcccgctttgctgattctagactgcacagaacatcctcatcgccgcagcaagatgctcaatacaatcctaatgaacatattcttggagcaatgccatctctgttgcatagaacttcatcatacccacaacaagagcctcaatacagtcacacagaaccaattccggtacctaaatcatcattcattccgtaccctccatctggtgcagtatcccattcttcgccaggtcaaccacataacatgaacatgccatctcctcccacttcattccaaatgcctgtatctgcacaaaatgagttacaccatccccagtttcctcgtggtggtatgcctccaaggccacttggtcggagcatgggtcatttggaatcagcaggtttatc

SEQ ID NO: 79509 - DNA, 3427 bp, Oryza sativa
ggcaatgtaaagaccatgttaattggtgccgctataacactcttcccttttgccaacctcttcacctcatcggctgcagcatcatcggctacaggaacctgattcttgacatgccactcctgtcttggttttggtttcctcagtcgatggttgatttcctcttcaacctcctgaaaacgctccctgctcctcaatctctggaccctccttttctgattctccgtgaaaataccagaaggacaccattgattcttcctgatcacctcatcctcttggccacgatcttgattcatcggacccaatctttgacgaacagggagtcttgcctgtctcagccgattatccctattacgtgatcggtttgagctctcgatgatatcactgcatccaaggcagttttcgatagatggcaacctcatcccttcattccagcagaatctgaagaactcgcaatcccaatgaggatcaaaaccatcgtcgtattcttcataatgcctctcctcctgcttatcatacttcctttgatacttgttgataatcttagccgaatttacttgaaaaccctttgcacgggccctatcggctgcttgaccaactgtatgcaccatattaacaggaaaaggattcccatcgaccttcatcggcttcttggaatcatcaaacctaatctttcccccttcaatggcaacctgtatttgctgtctaaaaaccttacaatcattagtagaatgagacccagaattatgccatttgcaatatctcttcttgcctaattcctcagcagataggatcatatgaccagcaggaaactgaatctgcttttctcggagtagcaaatcaaaaatcttgtcagctttcatgatatcaaagtcatacttttcctcttttccaggactttttacccattggcatggtatgacctttttgctcctcacctattcagctgcaactatctcagaatcatcttcttcgtcatccgacccatatatatatggacaaacgtgattaaccttcttagagcttttcctgacttccgccgacctatgctcatgcaaggtcacctactgtatcagatgcgataagctatcgaagtcttcggacgagaatttctccctgattgaggaatcataccctggaaggccaaatcggctaactgagcatcggtcaaactcaagctaaagcacttgttcctcatctctctgaacctctgaatatacttgtgcacgggttcatcatgccactgcttaatcgctgtcaagtcagacaacttcatctcatgaaccccactgtagaagtagctgtggaattgcttttccaaatcggcccagctgttgattgacccatatgggaaagaggaaaaccaagtaaaagctgatccagatagagataaccgaaacaacctaactttcagagtgtctatagccgatgcttcaccacactgagcaaggaatcggctgatgtgctcataagttgacacgccctcttgccctaaaaatttggagaaatttggaaccttaaactgattgggaagaggaactctttcaaaccactcagggtaaggttgccgatacaaacttccagtttcttttggtttgagtccaaattgttcctcattacatcagcaatcacatcggcccatggtcgttgctgagctgctcgttgcggctgttgctgcatgggctcgaattgaccaaactgagatgcgaactgggctgagccaatccccctggctgatattgggcttgtggggaaggaggctgatattgatagttcaagttacccccttgataattatggagattcggctggatgttgcgcaccaagtgctcaggaaccatctgaggcatcactatgccgtccggctgtgcatggtgaaccaaatgttctaggacgacttggtttacaaattgctgcgcaagttgcccaccaggtggtgcaaacccggccgatgcatttgccgaccccgggtgctgaattggctgaatgatctgctgtctcaccagagtctgttggatcggctgaagctgctgccttggtggcgtttgctgaattggttgcagaggctgctgccttggtggtgtttgctgagctggttgtacgacctgttgttggattggctgtacaactggctggattggtggtgtctgctgaatcggctgctgctgcactggatcaacaataggtggaggtggcaaaaacatggcagcaacttgatcttgggtcggctgattcgcaatctgcccaataggctatggatgctccctcattaacaaccgaaggttcattggctggcctggcgccatagctgatgtaccaggcaggggagttgatgctggcgccgtcggctgaattgtgggtgcaacggagcgaaccgcttgaacagatggctgaacatcggtgatcaaagatcgataattcgggaagacacctccttgcaagtaaactgggcctgtagcctgatgctcgactatcgaaccatcggctattgtcttcatcatgtttgacaatgtattgactaataccccggactgattgatcagagcatgatgcacagcgtaatcaacccgatcttggaagttattgaaaaaatcttgtgctagctcgttactctgattaagatttcctccttgcggcccttgagcaccaccaccttgagctccatgcactctatcaccttgtactccatggaccccttgagggttgtcgccttgatttcctagagaaccatcagtagcacctttgttgctcggctgagccgagccttctggagcttttttcacctctccatatttagaagaaccggtcccaagattatcagcaaccaattttattttatacttctgaacaagtgtccccttgcgggtttgcatgaacgagttcaggaactgatctcgtgcttgctgcagcgtcgcttcaaactcctgcttctgctcaggcgtgaatttctctggatcgattggcatgacgttgtcatcaatgatgtcagttaatcccggcttcgacgccttgcctttaacggaacctgggcttgatggtggtggtggttgtttctaagccatgaggaagaactgacgtctgacttctaatcaggtcccacagggcgtgccaaaagcgtgttgacagaaaacacatggcctgggagatctgcttaactccagtgcaggtccaaagctcgccttcggatgtattagcatgccagttgatttgatcctataatcaacaagaaatagaaacaaagaaaccgtagttaaatctataaatgatagccgatcggctagatgccgatgacatatcatttatctatgggccgatgtcatctgtgtatcgatcggcagtcacgaataagtaaagaagaactaatctactcgatcggctgtagatataaacgatatatactcctcatatcgatatatacttaaataaagtg

SEQ ID NO: 79510 - DNA, 553 bp, Oryza sativa
gtagatgataactttattactcctatttatatttacaaagtgcaacaacaacacttcttacgaaaatcttgactaaactcgaaaccctaattaactattaactcaatgctctcaaaagcgataccgggaagcctcacgctccctctctatttatacataaggtaggcagcctaaagccacaaaccaaactcatactagaagtcctaatccacctaggaaaccttcctgtacaagaaacaaactttacaaactccaatcattccaaattcggactccttccaaattcgattccgcatcccatatgcacacaatacctccatcgtatgccatatgtaatcttcaccaaccacgtgcattgaactctagcttaagtatcccgcatgatatctgaccgtcacggacgtcgccttatccccaagtcgactcccgatccatcaccggcaatactctcccgaggcatcaagtcacctacacatgaatcaaacaaagaaaccatattctgagaccaaggtatctccaacttgacttattgttatcaaacaacagtattaca

SEQ ID NO: 79511 - DNA, 5339 bp, Oryza sativa
gtgaaccgccgtgaggtggcctcacgctggctgggcgagcaactcgcgaaacgcgaggaggccattgccggcgtgaggctcggcatctggagagtgcccgcgctgagtgccggcgatggcagtgagggcttctgagctggaggcctgggagaaggacctggaggcgggcgtgcagcccggcggcgcagatttggtgagccagcttaccacggctcagagcactatcgccgacctagagcgcttggtgcaagaccaggctggggagattgcggccctccgccttacgaacgagatcggacccgggcagttctccgatgccgtcgatcggctggagcgcgcgaggcgccgagtcggcatctccgtgcgccgggatagtaagctcccgcccacacagccggcactcgcgctccggctggacaggctggcggcggatctggagaggctggaggaggaggtcggcgagatcgtgaaatcgtcgtcggcttccttggcgcgggtcgcggtggaactggtcctcgcgagccaccaagcctgcgaccctgacttcgtcccatggcgcgcactcgaggatttccccccggggaccgaggcaatggctcgggagcaagtccgggaggtggccgacgcgatcgtctctaacttcgaggggtcggccccccggttcaccttcgggcttgcctcggacgaggagagcgggagcggagacgatggtgacgacgtcggtggcgaggactgggacgacgtcgttagcggcgccggcctcgggggcctgggcactccgtgattatccgcacttttaatttccttttgttgtgtgcctgcagcggacacttgtctttaggctatcgtgcggtcttgtctgtaaataaagcttccttttcgcactttctacccctttgctttctccattgaatgcatacggcacggaaagaaaaaacaagagcaaaagtatataattgacctccctgtgatcgaaatgccgttcttaccccatccttcccccccctcgggctcgttctcgcgaaaaggtaaatccgcgctcggtccgtggtacctaagtggtgaggggccagaccgtcgccccgagggagcgcatcctctctatcgcgcgtattttcccgggattagcttctatgcctcgtgaggagaccagaaaactgagtttgcccgccggcacaccgaacacacacttgtcggggtttagtttcacgcgtgtggacctaagactgtcgaaagtctcggccaaatcctgcaacaacatgtcctggtggcgcgtctttaccaccaggtcatcgacatacgcctctatattgcgccctatctgactacttaaagtgatacgagtcatacgctgaaaagtagggcctgcattctttaatccaaaaggcatagttgtataacaaaaggtgcccacaggagtaatgaaggcagttttttcctcatcttccctagccatgcggatctggtgatacccagagtaggcatctagaaaacacaaaaggtcgcaccccgtagtggagtcgactatctgatctgtgtggtaaagggaagggatctttagggcatgccttgttgaggtctgtgtagttgatgcacatccagagcttgccgttggccttcgggacaaccaccgagttcgccagccactccggatggatatactcgcggatgaagtcggcctctaggagccgcgccacttcctctcggatgaaggcctgttgctccggggcttgacgccgcactttttgccggatgggtcgcgcatccggcctcacggcgaggcggtgctcgatcacctccctggggacctcgggcatgtccgacggcttccatgcgaagacgtcggaatttgcccacaggaaggagacgagcgcgctttcctatttggcgtccagggtcccgccaattttggcggtcttggatggatcatcgccaagggggatctccttgacaggcacctcatcagccgaggcgaggcgcttcttggaggcgcgggacgcggaggcctctcgggcctgtggttccgtggccaccgctaggttgtcggcgctttgctccgtgcaggcgagggcgattttgacatcgccaaagacggtgatgggaccactagggcccggcatcttcatctggaggtagacgtagtgggtggcggccatgaacttcaccaacgcaggtctgcccaggaccgcgttgtaggcaaattgaggtccgccacatcgaagtcgatccgctcggtacggaagttggtggagtcgccgaaggttaccgggagctcgacgtggccgaggggccacgtgtgtcccggagtcacgccgatgatcggcagcgacggctggagcttcatccccggggccttgagcgcgtcgaaggcggctggggagatgatgctcaggctggctccctcgtcaaccaggacgcgcttcatcctgacgttgtgaatggtcggggagaccacgagggccaacttctcacctcgagcgagcattgtcagatggtcgctctggtcaaaggggagcttaacctccgaccaccgcgcctttcgacccgttttgtgggttgaaacgggggcaaaaagctctcgcctcatggccttgaagcctcagcgagaggtgtgagcgcaagccctctcgtcgagcgtggcgacagttccctgaggtatctggaactccagatcctcactgtcatcgccatcatcggcgggggccttcttcttggcctcccctcgctggtcatcggctgaggtcgtgggggctttgccctctcgtcggccctgccgcttctcctcatcggctttccggaaccgctcggccaaattcttgaccgagcggcagtcagcgagactgtgccgataagtgttgtgcaccgagtaccacttgtctgccgaccggccctcgccggatggagcagtggagctcggcttgtcgccggtggtctttcccttgcgcggggcccgtgcgggcccatcagtcgcaaggacatggccctcgtcatcggagcgggccggtttccttttgcctctcctatctcacgcttagagcggggaacagactcgggggtagccgcagccgccgtgccggtgccgggggagttccaggcccacgcctcctccttccgagccaccttgtccgccagctcgaaaagctcggcggtggtcttgggctcctaggaagcgatcttctccaacatgcggttatgccgcacgccattccgaaacgcataaacgaccgcgtgggccggaatgcatggaatggtgttgcggacctggcagaagcgctgtatgtacgagcgaagggactcgtcgtccttccgccacacaacgtgcaggtccgactcttctcctgggcggggatatgtgccctggaagttcgtgatgaactgctggcacaggtcctcccaggagtagatggagtcggggggctgggtcatcaaccagccacgcgcctgacccttgagggccatggggaaataattcgccatgacccggtcatcgccccttgccgctacgatgatcgtggtgtagatctggaggaactcggagggattgatgctgccatcatacttctccgtaaggttggggcgaaacttcgggggccaccggacgttccgcagactcgccacgaaggccctacaacccgtccctccaggggtgagcgtggggggagggccgcctcgtgaggaggaacgtggcactccagatgaggaggcgccttcccccatgcgggcagctcagcgctcgtcccggcgtcgctcgatatggattcgagcatcctgctccctgtagagaccgtcgtgatgcctccggcttcccgaggcccccgacgatgttggagccgtggaccgcctcgagaccatggccgaccaacaggccctcctccttgctgacgaggagagggtaatgggggtatgcaacgtaccggtgacggcgggtcggccgcccgcggccaactgccgctgggcagtggtgaccaagttggccacgtcgtccaaccagcgctggacaggggtctctggctccgagttcacggggggatgccgcagaagggcacccgccgcctaaagcgcgcctcggggcgagccgccgtcaccgtaagtgaggcggcgccgtgccccgatgcgtcgtggcctcccttcacctgggggcggggagagggccaaaccacccgaacgggtggggtcctccctccgcgagggttcacggcgggggggagttggagagttgcggcggcggtgacgagggccccagctctcgctagcatcctcactcccagacggagtgggggtgaataccacctcctccttctccaggacctcgaccatgatcgtcgagggcccagggaaacttgggacggaaggaaacgacttctctttaaagcgcgtgccctccccctacctggcgcgccagctgtcgagggatgatcctctctagcgggaggtcgtgagacccccctttcgtgagttcggccgggggaagaagctcgcttctagaaaccacgtatccgtccctaaggcccctagctagctcgcacacaatcaaattatacaaattcgggccgctgagaagcgtaataccctactcctgtgtttgggatttagattgagagttacaaaggttcctaaactcgggagaacactcttctcctagagcccaagttagttgagaatcgtccctttgctcggtgggcaaggtcctccttttatatctcaaggggataccacatgcaccgcctctacctactcttctttcgggtggggtcccaccctatcttgaccggaactcgacccgtgccttcgcctggaacctgaaccacagcttgtccttgaatggggcccagtgccgtccctcgcctgacacgggagacagccctgtcattccctcattaatgggtgaagacttgtggtggccgccgtccgaatgaccctccgatgggacgggtcatacctacctccactccgccggaagcaaatgcgacgtgggagcacggtcggtgtcaggccggtcacagaccggtcattcttgactatggcacgtcagtttagcacgccgcacgtctgtctcactgcattaaatgcgacagggggtagttgaggcattgcgcgtattaaaggaggctcaacctagaccctcacctcgctcgctccccccgccaaatggtggctgggcgtgggcctcggggcaaagcggtgcaagggcccgaggggcatgacgtggcaccccgaggccccgacccccccggctgctccagcggttcgcagactgcgggggcaggacccaggctgtaaggacacatggcaggatgggaaggtagattccccacacttcgcataaccctgggcccata

SEQ ID NO: 79512 - DNA, 4710 bp, Oryza sativa
aaggccccgacccccccggttgttccagcggttcgcagactgcgggggcaggaccaggctgtagggacacatggcaggatgggaaggtagattccccacacttcgcataaccctgggcccatatctccaacagagatggagcagaaaaaggtagccttctctccagatgatcatttttctttttataaaagaaaccagatagccatcttcattactgtcaaatattaaaaaggaataggggatcaaactttcaattgagttggtccacaagacatatatttactagtgaaaaataaatctagtgatgatcctaggatgaaccacgtcatctatctatcttctattatatactaaaagtctattaaacttcctataaacattctcaagccaccacgtggcgctctacaaacgctcctaagtcgccacgtggagctctaataaattagaaaaaaatcctagaaattttaagaaaaaaagaaaaacatctcaccattggttttcacttaaatgagtggatccattatttttaatcattagatcaattttaaaggaatatatactcaatccaacctatgggcctattagatcgatctcacggaatatgtagccttcccttcccctgctgtacatgccaccgtacgtaagtacgtatatatgtgatacgtattccatatgccctccccttttctcctattttctaaaaactcattacaaaatagtttaaattttaaatagctaaataatcatgattctcaatttatatacaacattaaattcatttgtactatttttatttgtaattaaataaatacattaagatcgatattgcatatattttgcgaggtaaagaaaaaactgaaatacgtttggacatagaccctagcgtggcagtcattaaacaaataaaaaaattgacaacaactataccatcttaaatcattctatatataaatatgtacattaaattaaatatcatgtaggacgcaaaccatcaaccgtcacatcctaaaaattaagaaatatcgttgaaattctatgagaaaaacaaaagcaaaacatcctactatcattttacacttaaatcggcaaatttattattttcagccattagatatatcattctactctcataagccactacgtatcacatcttaaaaattaataaaaatcacataaaatctaaaacaatgaagcatctgacctcgataaaatcattatttcagccattagatctatatttaaagaaaaactataaaaaaataaagtaccatcccattccccctccccctcacctggattaacaaagctccatctttatattatgaaattataaatatatagtaaatgaataaagatatcgttggagtatataagtataaaaaaaaacagggagtagctaaagaaaagccctaagtgcggaaatgctaatgggcgggtgatcgctccctcacccgcccagcgatcagacgcccgccccctcccctatactactagatacactcctccctcctctcctgctacagtacaccacacaaaaatttaaaaaaaaaacaaaaagttagaaaaatttatgtatagaaatactatatataaaaaatttaaattcaaattcaaatttgaatcgggtatgtaaactttttgacttataaactttgggtctataaactttaggtgtataaactttagatgtatagaaatactatatatagaaaatatttgaattcaaatttaaatttgaatcggatataattcaaattcaaatttgaatcgggtatgtaaacttttgacttataaattttgggtctataaactttgggtctataaactttagttgtataaactttagatgcatagaaatactatatatagaaaatatttgaattcaaattcaaatttgaatcagatataattcaaattcaaatttgaatcgaatatataaacttttgacttataaacttttggtctataaactaactttaggtgtataaactttagatgtatagaaatactatatataaaaaaaatatttgaattcaaattcaaatttgaatcggatatataaacttttgacttataaactttgggtctctatactttagatgtgtaaacttgaggtgtataaatttactaaaataagaaagtaatgcggtggtaaaaaaggaaaccaggtggagggggggcgtggggcgatcgctacccccatctccaggcgatcgatcgcccattaggatcgcccccctaagtgcttcaatcctactgcatcattagtcaactgctcagtagttttgctccctccgtttaaattatactattgactttccacattcgttttaaaatgttatatataaatgttatttattttgttgtgacatattttattattattaaagaaactataagtatgacttataatttagaatatttacactaatattttaaatagaacgaataatcaaacattattttaaaaattaatggtattatctattaaagaaaatagcagaggtagtattactaggggtggaaacgagccgagccaagcctagctcggttcggcttgcaatggctcgtaacaagctaggcttggcttggctcggttcggttagggatacgagctaaaacatgagctcggctcggctcgtttcctggctcgagccagctcgcgctagcttgcgaaccttccgttgaagctatataatttataatcattaagaaaagcaataacaaattatcaacatgtaaaattaaaataactttatatattcaattcattaaaatctagacgataaattatatattgacaaataataactcaactgcaaaataaaatcatccatacaaatatatgatggcctaggctcacgagccaaatcaagtggctcgtgagccagctcgggcttagctcgtttcagaaacgagctaaaaaggaggcttgggcttggcttgtttggcattcaagccgaaccgagctaagtgagctcgagccaagcccgagctaagctcacgagcccaagctttttttccacccctaagtattactaattagattgatttagggtagaccgcgagaggtggcggcggtcattggggtcacgtacaatactcctatctgatttgatctccaagacttcaaaacttggaaaagaaatttggtgcagaactgcagaactgcagacctgctccagatgattgccatgtggacgacgtggtgatcagacggctatctcccctcggctcctatgcagcgcgatatatatggtgaggatcgatcgatcacccttctccatatggtttcctattttaacaccgcattacttttctattttagtacatttatatacctaaagtttgtacatcataaatttacacatctaaagtttatacactgtcgacgacctcaaatttacacatctaaagtttatatactgttgacgagtgatactcgcagacaggataagttgagtattggggtatgtttgaatgagggtctatgtagtacaacatcaagcaaacagaagacgaggattatactggttcaggccccttatcaggtaatagccctagtctagtttatatgagattgatgatgatgagaacagattacaaagagagtagatgaaacaaacgacaccgacgagatcatagtcaatagattcgacgggaccgacgagatcatagtcgatagattcgacgagatctcccggtgacttggctccgaatacttcggcttcgtaagctgtggtgggtgtgttggcgatgatatttgatgcccttcacctccctctaggggtccgttttataccgtggattatcttacccgaagtaagagttggagatatgtaaactagtacgatatagcagatattctatcccctccaagtaggactctgatagtttcttaactcgtagagatatttttcataattcgggacagattcctaacggtgtatacggaaacgacccgtgcacgtgaaggtataccttatcggtatatttcataagtcgtaggttagagggtatgccttatccataatcctaacatacacctcaagtttagagacccaaagtttacaagtcaaaagtttatatatccgattcaaatttgaatttgaattcaaatattttttatatatagtatttctatatatctaaagtttatacacctaaagtttatagacccaaagtttataaatcaaaagtttacatacccgattcaaatttgaatttgaattcaaatattagtttatagacccaaagtttacatacccgtttcaaatttaaatttaaattcaaatattttttatatatagtatttctatacataatttttttcaactttgttttttatttttttttaatttatggtgtagtaggaagaaaagaaggggaggaggaaggggggagagagcgtatagggaggatggggatcgataagcgatcgatcgcccattagccacacccgaggatggaggagccttgctcggctggattttttcacattttagtactttttaaaaacttatcctacaaatagacctataaaaaaacttattctagaaatgatccttgtcgcggcgccaatgtcgttggcgccatgtttcaacatgacggcgccaatgatattggcgccatcctctccgccctcgggtgaaagtttagtcacaaatgtgaagtgggacggcgccaacgacattggcaccgaggaccaat

SEQ ID NO: 79513 - DNA, 6569 bp, Oryza sativa
gggtgaaagtttagtcacaaatgtgaagtgggacggcgccaacgacattggcaccgaggaccaatttgtaaaaaaattgaaaaggacctatttgtaaataaaaaatatttacaaataggtccacaaataggtccttggtatcagcgtcattggaactaaggacctatttttaaataatttttatttgcatataggtcctttttcagaaaaaaataatttggtcctcggcgccaatgacattggcgtcgtcccgttcacatttgtaacttacctttttcacctggggctaggaggatggcgccgacgtcattgacaccgtcatgttggaccacggtgccaacgacattggtgccgtggaaaggatcatttattaaataagtttttttagagatttatttatagaataagttttctaaaaagatcaaaatgcgaaaaatccagcctcgctcggctcacctcaaatcgcataggtatcgactcattggcctcagatccgcttttctcatcttgccggcgccatctccgccgtaaccccaaatccgtcgcctcccgacgtgttcccctccaactccctccgcagtcccatccacctcccgcctgatcccttcccgcgccgccttgtctctcgttcgctgccgggacgcgtttgtgcgcgcatcggggacggggaggactaccatggtctgggacctcggtctcgcatgaaacacagcacctcgaccgacgaccatcgatcaaatggtgagcaaccagcccgaccttgtcctcctccgcgatgcccgctacaacaacctgtatctgtatctgactaacggtgaattgctcataacattattcagagtttgttcataatgcattattaagagttgagagctagatgattgttctgcatatcgcataacattattctgcctgatggattatttgttgatatgattcttattcctgattctggtgttcccgataacagcagaacttatgcatttctcatttcgatttatctttatgatggtggttctctatcttctctgcagaatatatacagaagagggaaaatcgctatacctgaaaggactgtaaatttggaaaaagaggatggtgttgaaaaaattgtagtccttcactcctttgtaatatgaaataatccctaaattgttgcaaggattgtagtccagtcgtccagattgtaacctgaacagccttttttttttgttcaaattgcaagaatactgagttatccctttgtaatctgtagactgtatttttctatctggaatacatatgagcgtttttggttgttctgaaatattcaatctgatggatgtgttacaaaaactgtgattgtttatctaattacgtgagtgaataaaatacggaatattgtataatctgaatttttgaagaaatttaataagaacaagtagcaactcacaaggtgagttcaggcaaggaaaagatgaggataattaagagcaactcaagaactggtcgccacaaagtcaagtttttacatgttaataagtcacaatctccgtattaacgtaactaataaatccatggtcgcaactaatatcatcaatgaaaattcagtaaatccattgctccttgtcgtcatgcgcagcgcaggtgaaaccagccggcacctgatgagacgaaggcagaagcccggcaggtcgatctgttcttctccaggcctcctcgtcctaccatcactatcgtcgacggcgtcggcgagaggtgattccggtccgattgaggtgagagggcgagggagcgatcgccgcagcgcgtccgcaaatcgtgctcgccgttcgatctcttttttatccacgcgtccaccatcggcgcccggggctgcagaggcttcgctttgcaccggtgtatgcaccaattttttttcaaatcaactcggactcggttagtcgctttgtactgccgcgcgcgcgcgtttcccatctccgactcggattacacgtaggcgcgccgcgcgcgcctatttatagccgctgtccgtctccttactccatgcattagcctgattgctagttgctgctagcgcgtggcacaagagcagcgagaccagcagtaagctaggcatggcggcgcgcgccggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggtgctgaggtcgccgcccgccgccgtgtgcggcgggctcccgagatcgcgtcggcggcaccggcggtagatgactggcacgagcccgatccgatcgaggaggaacaagacgaagatgatgatgatgatgcccgggaggagcgcagagcgaggataagggagagggcgctgctcctgaggcggcatgaggaggagcagcttcttcttcttcacccgcagcatcaggaggaggaagatgaggaggcgtctgagtctgaagagacggcggaatcggactccgacgtcggcgagcagatggccgtcgtctacatggccgtgccactgtttataccaaagccgcggcgtgacaccatccggctcaaggaggaagaacggcagcgacttgaggacgagctgcaccggaagaggctcgaggacaggaaggctcagacgaggcagatcctgctccaagagatcatcaacgaagagctcctcgccgccaacacagcttcagatgaagccgccatcaacggcgtggacaccgacgacgaggtggaccaagccgaggagtacgagtcgtggcggcgccgggagatggcgaggatcaagaggatcagggaggagagcggcatcgacgacgacaagtcgatcatggaagacgagaacccggttgctgatcgtcccaagaagaagatgaagatcaagaagcagatgaggttcatgcaaagatactaccacaagggctgcttcttccaacaagacgccgacgatgcggcgcagacggcaggatcatgcgaaatctaccggcgagatttctccgggccgaccgggttggacaagatggacgtaagcgtcttgcccaaggtgttgcaggtgaagcactttgggcggcgtgggggaaggaagtggacgcatctagttaacgaggacaccacgtacaggacaccacgtacggtgagtgattttgtatctatccccacaattttgtaaaatttcaaaaaatgtgagcagcggcaagttatttttcacccccttgtgacgtactcatctgtattttaatgtatgacgccgtttactttttgaccaacgtttgatcatttgtcttattcaaaattattatgcaaatatataatcatgtgacaaaaaatttaattgtaataaataaagcggtataatcttatcttagatgaatagttttggagaaaaagtattcttacatggttgcataatgcatgctagtagatatcttcaaaactatagcccaatgcacaatatttggcaccatagatctttacttgaaatgatatctggaatggagacattagacattttcatagattgttcgggtgggactcagtcaaatccatatgtgacaaaacatttggaagatagtgttaacttacctctacctgctcaagccttagatgaatttcagcagctacaagttgaattgaatgagttacaacttcaaatacaaagggagatccttagtctgtcatatggaacagccgtgtttgttcctcagaattttcacgggctgaattttgtgaatcattctccccctagtcaccatttggctctggaaaactaaatgtgtcgtcaagaacaaagtatttatgtggctgatgttgtatgatcgattgaataccggagacacgttggacaaaatcacaaaaaactattgtgctctagaatgcagatctaccttgtgttctttgcttactggttctagggagacaacaatgcatcccttcttcgatcatgtgtcgagaccgtattagagtaagatggaatgctaatcttgagtttttccaaatggtggtcttggcacgaccgaggtttaggcaaaagagtttcttggatataatgttcatagcttgctggcatatattgaagcaatgaaatgaaataatctttcaaaaattgttaccagaagaagacaatttgttccattcttttaacaatgaaattctcttgcatatgtgcaagatgaataagccccttaatttagtcatttttgactgattacaacatttacaataattattttgatgtgatactcttgcgtttaaatattttactgttttaaatatataactattaggcaaagcttgttagaatttttcataaaaaaggatcaaataaaaaaatatatcatgttagatcaaatactcaaacgcaaaacaatatctctcatggtagatcaaatattcaaaaacaaaacaacctttaaatagtaccattactatttagactagagtcgaagcaaaatagaatatcaattgaatggatcaaatcgtaagtatatacataggtataagaatttgattcatacctatacctagcaacaaacaacttaaactcaactttatttcacaattcattattacatacctaactaattatatgtttgaatgttatatacctagaaccaaaatctaaccaaaaaaatgtccaaactcagttcaatcttatttgaacttgttagtaaagaagttaatgttcatatctaaacatttttttaaaaaatcatactcattaaaattgggtatatactcaattttaatcttcgagcccgagcaccatggagccccagttaattttaatacacatatgtatatatacatacacacacatgacggtgacactggctctatatcgagaaatagttatatgttaaaaaaaactaggaaggtagccagcgcatacgcgtgggtatgttgtttaatcttatttgaacttttattacgaatttttatgtgtggatgatatttttgaaatattttttgacactattttaaacgtatgtttgttaataactggtttgggcatattacttgaaattgtatatctattaggaaaaacgtgtcataataatagagttagttcatatctattttaattatgtgtgattcctttctaaaaatttttggactttccaaactttatataacatttttattttgtatgctatacatgaatttaagtaacattttaaaaataataaatttaatctaatggtgtaaaatgaaacaactaaattgtattgtttttattttttttataaatgtagatttaaattagtgttgtatatttgtcaagtgatatttgaaaccctaaaacaagatgtgaaataaaaaattatcatagcaataattattatatatatcatcctcgtatgctaagataggatgaataaagattattcatgggatatttcatatttataatataaatttagtttaactacgtatatttacataaatttgtagggtaatatatttatatttaaatagtagataatactattttaaaagaccatcgatctttttcgaatgatacacatttttttgttttattgtttttatagtaagggattttgaaaatactatttcaaaagaccattgtgcatagatttttcttttccaatggatagtaggtaagctccaatttttttccaagtcatatgtatgtacggacaacttatgtttttttttgtttttctatcctaatagttatatagttctccagtatacgtacacagagtaatatggtattagtttataaaataaaatactctaatggtctaaatattgggttcatcaatttaagtgaaaatcgagggtgatatttacttaaatttatagagtaatagattttatctttaaatagtagaaaactctattttaaagataattgatttttttaatggtactacgtatggttttttttcctttcgataaacagtagataagatacattgtattttagtcgtatgtacgtacctattgaatacttgtgttttttttccggtgaacagcaaggtattagtttctattttctttttcggtgaacaataggtattagtttctttttaaataaaatacatctaatctaatttaatggtctaaattatcgggtccaccgattaagtgaaaatcgacggtgagattaggcattgtcacgtggcggtccagaagcgtttgtaaaagtgccacgtggtggcttgagagtgtttatagtaagtttaatggacttttagtacttcctccgtttttaattataaggctttctagcattgcccatatttatatatatgttaatgactctaagcgcgcgcgcatatatatatgtatatatatatatatatatgtatatatatgtatatatgtatatatgtatatatatatatatatgtatatatgtatatatatatgtatatatgtatatatgtatatatatgtatatatgtatatatgtatatatgtatatatatatatatatatatatatatatatatatatatatatatatatatatatatgtatatatatag

SEQ ID NO: 79514 - DNA, 28622 bp, Oryza sativa
aatgcttcatctatatcttttgaggatattgagaaaagtatttccaattggaagattcctaaggttaatattaaggaaatatatcatgtaggtactttttcgttacttagtgactactatattaaaacaattgaaaaaactattccaattagttctttgcatgaaaccctgcatcttctttctgaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttatatctctaattttaatgaagataagattcccactaaagcaaggcccattcagatgaatagtcgactttaagaaatttgcaagcaagaaataaaaaacctgctagataaaagcttaataaggaaacgttcctctcctttgagttgtgcagccttctatgtagaaaatgctgctgaaaaagaacgaggagttcctcggctagttattaattacaaacccctcaataaagttctacaatggataaggtatccaataccttataagcatgacttaatacaaaggattcagggttcaaagatatattctaaatttgatatgaagtctgggttttggcaagtccaaataaaagaagaggatagatataaaactgcttttactactccttttggtcattatgagtggaacgtaatgccgtttggtttaaaaaatgctccttctgagttccaaaaaatcatgaatgagattttccttccctttacatcctttattatagtttatatagatgatgttttaatattttcccaagatgttgaccaacattggaaacaccctaatatattttataaaatcatagttcaaaacggtttagtagtctctgctaagaaaatgaaacttttccaaactaatgttcagtttctcggttataaaattcaatatgatcgagtccaaccagtagcaagagtaatagaatttgcagaaaaatttccagatgagataaaagataaaacacagttgcaaagatttctagggtgtttaaactatgtctccgatttttataaagatcttgcaaaagacagaaagattttaaccgagaggttgaagaaaaagcctccagcttggacagctaaacatactcaagctgttaagaagatcaaaggtaaggtcaaaaccttgcactgtctttatatcctagatcaagatgccttcaaaattatcgaatcagatgcctcagatcatggttatggaggaattcttaaacaaaaaaaggattccagagagcagctggtcaggttcacctcatatagatactgcattcctatcctcatatctggtgactagacccctagtcactgccctgggttagagctggtatcagagccaagtgctcgtaacctccccaagccatcttctccgaaaggggggggggaagaggggtcggatagcgtgctgaagtcgcggtgatcccgaacggtgtggtggtgttctgaagtcgcgaagttcccgaacctttgatcggttgcctgaagtcgcgttgccttgttgagccgcagaaggcgtttgtcggcgtaattcgttgactgggcacttatcaaaggcaaaggttgaacttaattgtgggaaatattccctgccgttgactggaacacatcatatccaaatagcttgatcataattgtgggagatttccccgccgttgtctggtaactacctacctatcttcctatctttcgtataagatgtcttggttggttagatcacgaagagccactgatcgatctgtagcctcgtgcagtagcgagaagtctattggcactatgtcgataaagaaagcttcatctatatcttttgagggatattgagaaaagtatttccactggaaagattcctaaggttaattttaaggaaatatttcatgtaggtcctttttcattacttagtgactactatattaaaacaattgaaaaaactattccaattagttctttgcatgaaatgctctaacccagggcagtgactaggggtctagtcaccagatatgaggataggaatgcagtatctatatgcaatcttggatgtgagattagtacgtgacaattggatggcaatccaggttgttaatttttttttttatttttttttttatattattatgcaaacatgaatgcagtacaggaaataaagataagctgtaaatacgaattatgtacaagatataaaattagatatttagaacataataggtttatatagaacggtccaggtgttcattcatataccttgataggttgaaggtagatccttctgaagattacaccaaggacttggtacaacacgttcgtaattatacaggtacaggactctcacaaggactcttacatagactctcacacttagactctcatgagtcttttatttaggttctactatagtactaacacttagttggagtggagtggagtgtgatggctggtggagaggtgagaggaatggttgagtgagatgtgttgtgtgtgaaatgcgatgcctgtgaaatgtgatggtgagccccttatatagcgctcggtagagaatattcatgatatctcttcttgaccttaaagagtttatgatacccctttagacttcatggagagaatctttggtgataacgctttagacctttaataaagatgtcataatatcgctttttgactatggacttatcttatctggaatagtgtagattccttatcttgaatagtgatctttgtcggggatgacaagatctttattcattatcttcgttgattatcgtgggtgctgattgcaccgtgtcaatctctgacggctctgatttctgaaatcactgagccaggcttctgtagtaacttttcttggagcattcatttccaaaatccggtttaattatgcgccctgctcccttgaagtattcataactttggttgtaatatttgctgataaaaatccttgtgatcttgttttggaaaaccagctgatattcataatctgtggtgatagcttcttcaatttctgcagcttcagaaaataatctccaattttcatgattagcaattgttgtatatatttcttcctcttcatccgatagtttgctaggaccgtcttcttgaaaattaaattgtccattcatgatatatatataatgaattgctggacgaacaggtggtgtgaattttggtggtatggaggagaagataatcctgtatcttccatttccaagtctcctgcagacatctttcacatcgcttccaaaatcagattgaaggatctgatcgagggttgcatagatggaattcacaagaccatgatctataatggtttggagagatatttcttcatggttgtatgtgggtaggttccggaatctttggagatttatctcagctttgagaaccaggaatctataggatgggtcagagattgcctgatcatctagccttaagagagggagcatatatatgattactcgtatggctgggtttctttctcttccttctaagagatcaaagaaataatcttggagtccaaggaatattttcatttgtctctctttaaacttttgccaaacaagatcgaggatgtcttgcccaaagcaagataaagtttgctccgtcttgaagcttaatctaggttggagattttcgtatgtggtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcgaagcaggatctgttgagatcaaaatcttatctgagaataccttggtattcttatctgttgccatagattgttcaacttccatgggaagtttatcttggccatcacgggatttctcctcgcgataatctagtaatctctcctcatgatgagggatatcttgtagtttagcccttttttctgttatcttttgatctgagggcacgaaatttttgaaataatatgccaggccatttaaggcatgagctttttcttttttgttttttgcctgccacaagtggtttaataacccttgttgtagctctgttactctgaaattgtgattaaatcgttctccatggcctctaggcagttggggcagtctccatgaactcatattcgtgaaccattcagacttctgtgaagccatttccctgcatatatattcaaaatttttagtagcttttaataaatatctatcttcccatgatgtcttacatggcaagtccatagattttggaagatatgatgggaaagaattgtcatgcaaatatattgtattcacaacttgttctcttttggtctaaacaagctggtcaagaatctcatctgtgttagacgaaaatcttaggctcacctgtttgcccattatctcaaattgaatatcttcggttgtgacaaggaagggacgaatgagtgataaaaacggtgttcctaaaataacatcttgcttaagatttttaacgagtagaaaagatgttttaatgcaaacttcagatatgcaaatatagatttcagggatttgatattctactgttaaaagtcctccatctgcctcacgaattctgtgggcggctttacagaaatatttatgagggataataccttctcgaatgcaattgacatcagcaccagaatcaattaaagtgatatgctgaaagtaggatccgtctataaaacgatacataacttctgtgtaccatttttgcttcatatatttttgaatggttccaacaacctgatcatcttcttgaattggttcgtccttttcttccatatggaatccttcttttaattctaacatgtatagacgctttcttatttcttctaaatcttgtttcataattttttggtcttcgaataggctcatcaaatctggtttctcattcttctttttctgttcatctaatcttttgaacacttcatcaatagagaggaatttgctcttttgaatatccttttttagtttatccttatcagtcttgactcttgaaaggaatttttcgagaactcttcttttttcttctggatcttgaatggtttcaaaagtatcgagaacaaattcttctaaactggttaaaacgagtatattttcatcagactcttcttctgaattatctggctcataacaagagcaaccactgtcttggcaacaattaatctctgcatttttttcttcatctgaacatgagtcattgtctatattatttagtattgtttcaagtttttctttaacatcttctgattctgaatctaacaaggcttggatctcttttttaactttggatttgaaacatctgttagctatgtgtcctttcaagccacatttgtaacaaatggtttctttgctttcagtgtcttgtgttcttatattcttattgtaaattctttttggttttcttttggtagcttgaaagctcatcttgcttttatcatttggttttgtcctaggtttggaatgggtttttctttttctattgacataaggatcttgaaaaccaaactgatagcaaaaatctctcatttctcttttaccaagaatcctttgttttttaagttgatctttgatttttaggtcattgcaaagctcagcccctactaattgtatcttttgtgtgatttttccaatatctagatagtgataatttatactccctcccccttcttttctttgggaatttctaaccttttcagcaaataaaggaggtaaaccaaaaatatatttttctttccaaaagtcttgattaggttctggtagggtatatagttttgacaagaaaatatctttataccatctaaaatctgacattgttttacattttaaatttatcaattgctctctatttttttcatagatatcatgatagttttcggcaaagtaataaattatgttatagattaaagtggctaaggcatcagaaatgttaccggttggattcccattaccatctctatcgggcaatggccttccttgatcatcccttttaactgcgcaaagaatctcctgtctttgagtttcatttaaataattattccaccatccttttaattgaccagaaaacccaatgacaatcatattggcagcttttctttctttgtttccattagctatgcaggcattagcatacataatcatttgatgacataaagtaaagatttgatattcagtaaagccatctaagttccattctacaatttctttgccattgtagtaagtcatattttgaatctgaggaatttcctcaaactgtaggtctgcataagttggttgagggtaataattcctagttgtggaagtaagagtagaaggtttaaaaatcttgttgaccatatcatatttttcattatcagaaatctcattgatatttttatttacttttaaattatttagttttaaggctagctcactgactagttcttcagaaattgtgggtccaaaagccttttattttccaagtttgatgttaggatcaattgttgggacaaacataggactaacagactgagaactagaagactgagaattagagcgaatatttatctttacctcaggtcttcctgttttgtagccttccataaggattgtctctattcgatctgtttgttgaccaagagaacgtagagatatatttgcataattttgttgttctaccaaatatcctatgtgttcaacctttgttgtttctccatatgtatttttagaaatactttttagtggacaagcttttcctccattatgagataattgaatggattcaaatggaggatgaacagagtctaccttgtttccactggttgtctcccattctgtagaaaccttcttgataacagttaaatcttttgcttcggatttttgctcttttttcatcatgttttttcctttgaagaattcttcgaagtgtctgacttggctactttcataccaatcaaagaaaaagatgttcttcctttgttctctcatttctttgtgccaaagttctcttatttttagtctaaatggttcatcgaccctttcaaagtatcttttcatcttgggtcggttcttttgaagcctgagttcttttttaagcaaatctttatcaatttcaaactcatcttcttctatggcaataacaaagccaacatcaagctcgataacattgatatcgaagtctgagattgaaggttcgtcggagttgtcttcataggtagcatagacaacattttgaggttttgtcctaggcctagaatctagactgacagaaggtctagactggagaaaggctttttgttttgaagtaaatgttatctcaacatctccgtctggtgtttcaatcaaggattcgacttctgattgatccatagacttaggttcaacagcttgagataaaacccatttctcaggcagggtgatctcatcccatttcagggttttgggggtagtacatctgttattaggattggtttgaaggagagtggttaggccttttggtgtataatgtttggcacaaggtgctaaagttgtcatggctttgtagtaaactctgtaggtaacggagatgttttcactccctggttctagttcataaccagatgtttgtaagttgagagtgagaactttatggatatttgtgtctgagagggatacagaaaaatcaggaaagatgttaaaataaacaggaccattactgaggctagcttccaccatgccaagtaaggaatctttgaaccttttatttctgcaatctcttagacaaggcagaacagagacgttcaaaccctttctagttaaggatctgatagcaacttgtataagaccaaaatgaaggtagtgatattgatgtttagctcttatagaattgatttctctttctgaaagaagatgcagggtttcatgcaaagaactaattggaatagttttttcaattgttttaatatagtagtcactaagtaacgaaaaagtacctacatgatatatttccttaatattaaccttaggaatcttccagttggaaatacttttctcaatatcctcaaaagatatagatgaagcattctttaccgacatagtgccaacagacttctcgctactgcacgaggctacagatcgatcagtggctcttcgtgatctaaccaaccgagacatcttatacgaaagataggaagataggtaggtagttaccagacaacggcggggaaatctcccacaattatgatcaacctatttggatatgatgtgttccagtcaacggcagggaatatttcccataattaagttcaacctttgcctttgataagtgctcagtcaacgaattacgccgataaacaccttctgcggctcaacaaggcaacgcgacttcaggcaaccgatcaaaggttcgggaactacgcgacttcagaacaccaccacaccgttcgggatcaccgtgacttcagcacgctacccgacccctcttccccccctcctttcggagaagatggcttggggaggttacgagcaattggctctaataccagctctaacccagggcagtgactaggggtctagacaccagatatgaggataggaatgcagtatctatatacaatcttggaatatatatatatgggacagccatatgggacttcatggtgtataggctccaaacctagctgccgttggatctgatccatatctatttgatcgctctaggtgttgggtttaacgggtacacccgtttgtacattaaatatggaatgagttatatatggattaaaaactaccgcatgcaattgccctattattgtgggtagtaacgatatgcatgcatgtttagataaatagctatacttgccatctatgattagtaatttccttacggatgtacgtgtcatgtccaatttttaggcaacaaatatgataggaattaaccatataaaataaagagtgttgtgcagtattttttatatggaatgtgattgacacatggtatatagctggaaattcttggagagtatatggcaagaaattcttggagatttatttttgggtatgtggtaaaatgtatgtattacccatcactttttaattttgaggaacaaatttaaggaaaaaataattatatacccagatttggatttatacacgtattaagtatatacgcatttaaacaccgattaggtatatacacatttaaacatcgattaggtatatatacatttaaatatatacgcatttaaacatcgatttggtatatacccattcaaggcatatacccaacaaaatatgtatatttggtatatacacattaaaaaaattaggtatatttggtatatacacatttttaaataattaggtatatacccaacaaatcacgtgtattatttattcagtgtatgtgataaaaaaaattagggcacatgcaaaaaatcggtgcattatgtatatatttagtgtatgtatctagaaattcatgtgtattatgtatttagtgtagcgtatgtacacaaaaatcacgtgtattatttattcagggcatgtgccaaatattcaaggcatatacataaaaatcatgtgtcttattttatttagtgtatgtgcccaacagtcatgtcatatacccaaaaatcgtattataactagtgtctgtgccaaaaattcaaggtatgtaaagaaatagagagagactagacaacgggaaccgttactacagggtactttaagtgactcctaactgctatccggtacccaggtaccagctggtaccttataccctagtatcgagttggtagctagatatcagaacttggtacctgagtaccaggcgtgataccccaagagagagcaaacaagacgccaccgccgaccatcgtgtacctggatatatcccggcttcgcttgagacggagagacgccgccactggccgctgcggctgctgctcgcacggggcaagaccacggcggcgcgcacagcacgtggcagcgtggcacctgggccacaccttggagaagctcacgtctccgccgcaggaaattttgaggtgtacattaatcatataatacttatgtaaatacccatatacactaaattatcacgcctaaaaatattttttgacatataaatactcccgattccgatacgttcacacgtgcaaattagcaaaaccgattggatatacttatgtaaagaattcaatccggattatgttcatcctgtgcgtcgttgggtgtgtgtcccctttggacttaatcagtgatggttgagtatatgctgtcactaataacttaatcagtaatcacagtagagatttagagaaaacgatcgaatgacacacattgacaaatcaacattttaactgatttaatttctgggtatcctgttgataatgcagccatacaaacatattattcggattggatactgaaataacaaaaatgaggtgctaactaaagtataatacacactgtttcaagatagattacactgtaagtgtaacacgtaaatatcaaacaagtgatgcttagtactccgatggcttacatttcttccatatataccttccaagatgtggcttccggctttactgagttgctccggcctgtatacgcgcttcatatggttgctatgcagtagatatgttctcagcatgtgcagcaaccttcaatggcggcggtgaacttcgcagacgaccggcagcggcgatgacgaacctcacagacgaccgcagcggcgacgatgaacctcacagacgaccgcacgatcctcatggatgatcgatagtggccacgaaagattacagttgaccggcgacggcggccacgactaacctcgcggacgttcagcgacgtaacggcatggcgacgaagctcgcagcgacgacaagcggacaaggacgtatgtaccttgatcgagtgtatgtatctaatcttttcgaacgcatgtatatgtgtctaatctaaattctacaatttgcaataccgtcggaatcggatggtatatatatacacagaaaaaatgaacgtccaaatctgtatacatggaaagaaatcaattcaacggataacgtaattgacgggcataattttgtcataatcacgttcagaatccatatatactttatttggaactctggtggagagatggtttgtagtcccggttggtaacccctttgtagtcccggttttccaaccgggactacgaatccgggactaaaaatcactatctttagttccggtttaaataaccgggactaaaaatccatctttagtcccaccaaccgggactaaagatagcagcgcagtcctggttggtcaccatttttttctttttttttatttttattgtttctttccaaagagttgctccttcccaaatctccccaaatatcccaaaatcaaagtatcatcccaaatcaatgaatcattcacatcacaaattctcaaaaaaatacaactcaaattcttaaagaaatacatcacagatccacacatcaaatacatcacacatcatatacatcacagatccaaacatcacagatccaatgaatcacaagttcttatatccaaatgtatcacaaatttgggaaaaaaaagaaaattgtgcttcgctgccgcctcccccctccggtagaggagagggtgccgccggtcaccagctcccgccaccgccacgctccctgccgggccgcctgcggccacgctccctgccgcccgcggccagccgcccgccgccgcccacggcccgccgcccgccactgccccctcgaccggcgccagccgcccctatctcgccaccccgcgcccgacgcagctggccgccgccctcccgacctgcgtcggccgccgcctcccgcccgacacagccggtcgccgccgcctccatctcgtcgcctcgcgccaggccgccggcggcggcctccatcccgtcgccccgtccggggccgccatggccggcctccatcacgccgccccgccggaggggaagggaggggaggaggagatggggtgagagaagaaggaagagaaggatgggaggagaggaggagagaagaagataagatggagagaatggctggatgggagaggaggagataatgatggaattaataagagacttgcatgcgcgcgcgtggatagaggctttgttttaccggttgtttaacaaccgggactaaaaatcctaactttagtcccggttggtgttaccaaccgggagtaaagaaagttaggatttttagtcccggatggtgttaccaaccgggactagagatcacgggagggcctgacagcccctgacaacatacaaaccaggactaaagatgatctttaccaaccgggactaaagattaaatatgcccactgtagccactaactggaactaaagatgatttttagtcccggtttttagtggaaccgggactattgtggattttggtcgaccgaccaaatatggtttctccaccagtggaaatacatgcatgcaaataaaaaaaatggaatgtacgtatagatctttcttatcgggtaaaacccgctaatttttgtaacactgagtttttggtttgcacaaatcctaaagcagctggatggtggatgattttggagcccatactccatggagcatcaaataatttacctatatatatatataatagatagataatagataatagatatcaaataaaatccaaacgttgcataacaaaatatcttcaaatatttaaaaactcgtcaaaacatatttctacatattcaccaccttccacttagcttctgaaatttgcacctcaggcacttttcacctctaccatcatcagaacggcacatacgcttcagttatttttaccgctacaatcaaacttgcacgtaataataattccaaaaaaaccgaaaaagttcgcacgttttgcccgcaggccgcagctctctgacgaattggctgtctcggcgtgtccccacatataccagccaaaaaaaaaaaaaagaaagaaagaaaaaaaaagaaaattcccctctgccctgaatcctgattctatctctcgagcgggctctcctcctcgtcggcgttcctccgcctccgccgtcttctccgccatctcctctttcgagctcgctccctccccgatccgttccgctccggcgccccctgccgccgctccgttccgccggcgcgcccgtggtcctgtgtgtccccccacatcttctggcgcaaccggcaaccctagccgcggatggcggcgcagccttcttcgtcggcgtcgacgggtaatgcaactcgtctcttctcgtagattgcccctagatggagaagatctttcctctcgttgattggattattagtgtttgggacggtttatgcttgtggccggattagctagctaaccgaggtgacttagtttgggttgtttgattcgttttgttacttgtatatagagatctagccacgaaatatgttgtcacttgaggggtggagcacaccaacaaacaatcccaactcaaaatagcttctccttttacctttaaatgaaaggagtgtggagatgctgtaccattcagtactgattcccgggctctttgattgtctctggctctgtgcaggcgctaccaagtttgatgcatcgcagtatgctttctttgggaacaacgcggtggaagaggttgagctaggtggattggaggatgatgatggtgtcgatgctggttttgttggccctggtgatgaagaatacccttctgcttatggaagggatatgtttgaggtaatatatatgacagttcatttatgtttgatgcgacaaacttccatccattatttattactttccgtttaaaagaactttttcacaggaaatcagtgttttttttatgacacagtgtgtccagtatgtaattttgtgattcccacagcattcatgactttggtagtaaacgcccttttgtgttcagaacatgagagagagagaggtgggaggtgctcctaggggttattttgatcattccgttttacttcttgtttgttttcgttgttgttcaatccaacgggaattaatactttgtatatcatggttcagtaagaggtagcagggtccacccgaacactagagatttatgttgaatgaagagtaaatagtaagcatcggtgttatggtagcttcagaggatgcacatagtccctgagactgtggactcatgatgcggaagccttggaccatgctgtgtcaaccattgaaaggagagagggacatcagttgaggaagggaagagggagagctaagcttagacattgttgtttcttgccattgttattgctggaacttttctttggttctgtcactaccatgatttctgctcgcccttgcaattcattttctagagtcacttcaggttagatagcacctttgttaggcattgactgctgtagcatccagcagagagaagcagccaatcaacagaagggtaaatttgggatggactaggaaagtagcaaatggggtgtgttgagttggggtgtttcgtaactatcccaatctgcactggttaactgtgtttgatcagtatttgttacagtgtttgagaacacgttttgacattttgctttattgggtaaaaactggctagaaactgaatataccaacaatactgaataacatgaacctggccttttggtgtcttgtgtgctgcgacatgtttctgtctccgcaagcccagattgatagtcttcttggctcagttgcccagttgaccaactttccaacaattagcggccacttgttttgaccggccaatactggcagcaaaaccaacataagcacctactattgcttgttcatgttcatcagtaagctgcttgagtgattgtcactgttttattatcctgcatgtggttgtgtgcatgcatggatttatttctcgtctcatttgttaactgtcagctgtcattcttagtttgtaattatgttaaaaaagagttgaggatcagctttacagatcatgtaaagccgtaaacttttgtaaatatggtatttaccagtgtggaaccgaaacaatttgtatctaccaatagcacaataacgatctgtatttttgtaaatataatgtatttaccaaaaaaataataccatatttaccacacagaatttaacgaaaatactgtgttgaaaggtaggggtcgatgttctgtttcatcggtttagtcaggtcgatttcttctgttttcataaaatttggtttctcgataatagccaccgaggaatttctttttacgaatataaaccgagccgaaaaaaccaaataaaatcggttcggtagttacagcgaatggtttttaccgaagaatctcataataaggcgacaggcgcttgcgttgctgtcgagcctctgcgttgacatgctgaggtgcagctgtgggggttccagctctggagagctcctgccctgcgcacagcccccactctgatgggctacggagccagcgcccagtccatgatgctgcccgtgccgctagcctcactctccgcctgctcacgctggctgctcatgttgcctgctgcctgcacgcctgcgccaatgcaccacccgtcttctcctgctcgcagcttgcaccacgcttgtctactaaagaattgagagatgtgagagatttgccgtgagatttgtggctgtggcatgtgactgccttatcagcttatctccaccaatgtgatatggctgggttgtgggatgcatggatgagccttgcatcgactaagctcacattaaacttcaagtgagctcagtttgagccaagctggatcctgagctagagaactggcttcattttttagtagagaataaaatcaaggttcaaaattttatgataggtacgcagcagttcaccccccctagtagctatccaaggatcactgattcagcagaaactgctgttccctacacgatttgcatgtcatacaacatatcggaacctttcccctgccatcacctcatggtaagtacgatcacctgggggagaagaaatagaagcagatttgctatctctgatagcaaggtcgagaatttggggaattggaggaggggtaacagctggaaacttggcatgtaatggtgggggagaggactgggtgaagtaggaagggaacataatagtagaatgcgccttggaacatttggcaactgcagtcacgtggtacggagcacggcttcatgtctccaagtgtcaagttaatataggttactttattgagtgtactctcctttcatttttctttatttcaatataggtttgctgactggccaacagcatgcaggaagcagtgggccttatgtgcgtgtatttaggccttttatgtatacaattttgggaccctcagtagtttacctgttattttattgagtagctgagaatgatcacaaaatcgttttactggtatcctgcgttggtgttacataggtaatgattatatttcataacaggcaattatgcagcaataggcagggagtgttcattcctcgtatatgcctgagtgtggaccaaagggatctaggagttggctctggaaggcatatgttactggtcaagctttctttggcccgtgcccgtaaaaaatgtctagtagacctgttatagaaaactactggattttctgcacactgctactcttgaaaactttgtagagttcaattaattttattttagtggaaataatatttcaccaaaaaagttgccttgcaatctgaggtagcttgtaatttctcttctgcagagttgtttattaacacaagtccacctctcattatactagaggttgttttatctcattatctgtagttctgagcaaatttagctcaggaaatagtgcagttattatctggatcatttccaggttatgttattgtcatagttttcttcacttagtgttggggcctaaataacagattaagctgtgatttagaattatgtgcttctgtttaccttagaagattgcagtatcacgctattacttatttatgttgcaaattaagttatcagcttcagctgctcacactgatcaagctttgcttttgcaggatgaaggtggaggttcatttactggtgttgatgatcttgctggagcattctcaaaggtttgcttttttgaaaagcatagctttgtagccacatagtattaatacacaaatgtccaattattgggatttgatccaacagaaacatggtgtatttttttggtagaaattgcagaatgtagattatagttaaataaagttgcaaactcttgtatacctatttgtatgcttgcattgtggtattcttttttaactgtgaaaactgatttgttgatttctccactcagttgaccagaagcatcaatgaaccaacacaatcgggcataattagtcatgggggttcaatttctagacaaagtgagtaatgccctgttttgctcgattgcaattggaatcctttgctacttctttatgtgtttcttcaattcacgtgcatgggtatttgatttatttcatttttcaaggatatatgtaagattcgattcgttacatctggccaatgggatggacatatccattaatttttcattgttagaatgtgaatttcaatacatttttgcacagtctttgttctcttgttgggtactgcaggattatatatggtttctgttttattaacattgtattctaatgattcaatttgtctaggttctactccggattgggcacaagattcatattggcctacgcagcctatatttggagctgaacaagggctggataatgaaagccggtggtctcaaccaccccatttagcccgctttgctgattctagactgcacagaacatcctcatcgccgcagcaagatgctcaatacaatcctaatgaacatattcttggagcaatgccatatctgttgcatagaacttcatcatacccacaacaagagcctcaatacaatcacacagaaccaattccggtacctaaatcatcattcatttcgtaccctccatctggtgcagtatcccattcttcaccaggtcaaccacatcacatgaacatgccatctcctcccacttcattccaaatgcctgtatctgcacaaaatgagttacaccatccccagtttcctcgtggtggtatgcctccagggccacttggtcggagcatggctcatttggattcagcaggtttatcaactaataatttgcaacagaatgctctaaacagtgggccagttcgtccaaatggtgccatgcttacaccaggtttggtgcagcacaatctgcagcgtccaaatggattggtcccacctcaaatgctgtcacgccatccacaacatggaatggccccaattcaacactctccgccacaattctcacagttccatgctcagatgcttggtcctcggcatcctccaccaaaaggtcgtcagatgtacaatcctcagcattcatcacaaatgatgagtggatttgatgcaaatttggcaatgcctgacttgagtgatccgagagcaagagcaatgctgcaccatggagtgcatggccagcattatctcccccaaggttttgagcttgccggtatgaggatggataatgggtggccgcggttcagatccaagtacatgtccacgcctgaaattgagaacattgcaaggatgcagcaagctgctactcagatcaatgatccgtacattgatgattactatcatcaagcctgtttagctaaaaagtcagcaggaggtcaactcaagcaccacttctgtccgaccttgattagagatccatcatcctgtgcacggagtaaagatgagccacatgcatatctccaggttgatgctcttggaaggttaccattttcttccatccgcaggcctcgtccgctcctcgatgttgaacaaacctctgaatcaagtgatgacgttactgaaaaatctgcttcaaaaacacttgaccaagaaccaatgctggctgctagaatcacaattgaagatggcctctgcctactgcttgatgtagatgatattgatcgcttgctgcaatttagccagcagcaagatggtggcttgcaactgagaaacaggagacaggccctccttgagcagctggcagaatccctgcaactagttgatccacttacacctagtaacaatgcacctctctcaccaaatgatgatctggtgtttctccgaatagtctctcttccgaagggccgcaagctactttctcgttaccttgaacttgtgagttctggcagtgagcttgctagaattgcttgcatggcagtcttccggcatctaagatttatatttggaaatttgccatctgatagtagtgctgttgagacaacgacaaaacttgctactgctgtatcaacctgtgttgttcggttggagttgagtggactaagtgcttgccttgcagctattgtgtgttcttcgctgcaaccccctctgcgaccccttggacatgctgcaggtgatggggcttctttcatcataaagtctgtactggacacagcaacagagcttctcactgatcagcatgtggcctctacctacagcatgcaaaacagagctctatggcaagcatcatttgatgccttctttgggctgcttacagagtactgcatgagtaaattcgatagtgtgattcatgcattgcaaacacaacctgctgtggcagcagttataggcagggaaatgccagttgaattgttgcgtgctagccttccccacacaaatgagtatcagcggaagcagttgctcggttttgctcagcgcacggtgcctgttaacaaccatagttctcatgggtccagtaatggacccatgacatcagaatctatcccaagttcagaaagctggaaaatatgagtgaaagcatagtgtttttgcttctttgggtaatcagtatactagatacaatggctctttaaaatggagactcttccctcattttcccagtaaagaaaagtcaatagtaatatgaatccaggaaacaaagatcgagagggttggagcatcgataaacagtggtaatataaggcaccaagtttactattgttgcgacatgtctggtttattatgttttgtagggatgcaatctgttttgcatgtattatgcagatggatgtgtttttgttactgggaagtttcttcctgagttttgttgctcatgaaacctgcctggtatctatctctggctgtagaaggtgcttgttgaagacgctgtttgattgtgtacttgaagatgctgtttgattgttcttcaagacaagtgtcctggaaccatcaaggtggtatttcaatcaagactcaaagtgtcctggtgccatcaaggtggaatttcaatcaagccgccttctttttctcattttgttgtgttgaagggttgaaatgttactagttgatcatgccctcgtactgaaaaaatcctagctagcattggtatatggtactatgttttgttattattatttattaatttctctttcccgactttttctattctagcggaaggtataatttgggattttagctgagtagagatcgagaatgtagtagtagaaacttgggtggctgtaatgatgtttgcaagtttaaatgcaacaagtcagaagtgatggtagtgttaggcgtggcattttctggcgccaattgttaaacatttcaatttatatagaatgctttatagattcaacttgtttggtgccactcggtttcgtccagttttccctctcaatccatcttatatccgctactatttatgaatgaactactctttgtctcataaaaaataaatctagtacgaaatgtgacatttcctgttactacgaatctgaagaagaggtagctcttatctagattcatagtgttacgatgtactaggatgtgatacatcccgtaataggtacttttttttacgggacggatggagtacctgctttctctcttctcaactatgcttatctatctttgggtacatggctctgatatgcttccatcaatcatttgtttccaccgtcgatttcctagtgagtgcatttaatgatcatacatcttattgtgtgttttggtttaggacaagcaagtttaaagagtgggtgtctatgggtctctaggacaagtagctaggctcacgggatgactcttttgcttggtcatagatcatactccctccgtcccactgtatagcaacgtagaactggatttgacatatcctagtataacgaatttgggcatatccctgttcagattcgttgtactaaaatatatcccctcaaattctagatttgctatattttgagatgggggagtaagagcatcatcaagagatacccaaataaatctgctccctagatgagttttcaagaattcctaaccagaatttatggtcctaaaatatcttccctccaacagattagataaacatattatttataataaaaaaagtaggaccacttgcaaaactaccaatggttactctccctcttgaacaatgacctgaccgatatgaccacatgttggtccctctttctttcctcttctcttcttcctctcattcttctacctctcgcgcagggccgagactagagtacagcgagacaagttagcaccagcggtaggtgacagcaagggtggctagagaagggtgcgaaaggatcccgatggccggcagcacaaatcgaggctcagtggagacacgaattatggtcgtgaatggctagctgtggacgagctctagggtcggccgtggtgcaacttggggcttgatagaggagcgaatcgagcatggcgcggatgagctcgggggccggctgtggtgtgaattgaatcaacagcggatgagcttgtgacggctagtggtggcgcaaattgaagcagtgacgaacaagcttgcgacggcagagatatttcacccatgtgcgcaaattgcttgtgattggcagattgggaagcggtgctcttcactacacgtggagaacgagaatagcggaaaagggattttcaattctttgggatgttgattggagatctattggatctattttttttatacataactacaaaattttgagattgggaatagaattggacatctcttgggcatgctctaactattactcattagtctctcggtgcttagctaacgatggtgtaatgattgtttcatgcatgctatttatgcggagatagaaagtatgtgtttcaatgacagtaggtgacggagtgctcggttgtgcgactcagccaaacaaaaggattggcccagggcattgtttgttggtcgaaccaaacacacggctgattattgaatgaaatggattcatcatcacacttcattagtcaaaagcacatctagaaagagaccgaggaatgtagttatcatccataggccaacacatccggcaacaagttgtatttctttaaagtacaaattttattttggatagtcttttattaccgatgtttcgctttaaaccattttttaaccaatgtttttattctaaattgagtatttgtatctctatggttctttggatcttaactcttttatccatttacatccaacttgttatatcctaaagaaacaatctttcatatagttgtgaaacaatctttcatatagttgtgagagttctttgatgggtaggagccgacgtactcaagatctttcatatgcttgagagagtcaggtggttcaaaataaaacaaagccaagattaaccggtccaaagaaaaaatattagttaaagagtgattcaaaataaaacattggtaataaaatatgatcaaaagtgaaatttactccttttttttcatctcattggttttttaccagccaccgaaactatttatttaacacagttatgatccatattgatcacatttaattgtgtggatccactgaacttatgacattaacatattcttacatgaaaatttgttactccctccatttcatattataagtctattttacttctttttcctaagtcaaacttatttaggtttgattgagtttgtaaacaaattaacatctataatatcaaattagcttcattaaatataacattgtatatattttgataatatttaggagtattatgtttttctatacatttggtcaaacttaaaggaagtttgattaggaaaaaatgacaaagcaagttataatgttaaaaagtttgactaggaaaaaatgacaaagcaaagttataatgttaaaccgaggaagcatgtgattttgaacaaattaattactcccgtcattgtttcctaatttcatgtcaaatagaataattgcatatgaatttagaggagagaaaaaagtaatgagttcttaccttattattcttcattatatttagataattccgcgtatttactagtatttaaaaatcaaaatcatttgctccatggagttttttagggcttgtttgggagcatatatatccccatcaagaatccccgcctaccccacgtgccctttttttttatcattgttggtgggatataagacctctcaactgacctacttccttaataagacagcaaagccaaaaaggccaaagatatgaaggtgggtcaggcatatccacaaacataataatacagggcacaatgtagagtataattaagtaaatgtatgcgttcatttataagtttgattgaatctacaatgctacaattcaatatatgatcaaactcagcaagaaaagaataatccaatgtaggatctgatacccaaaaaaaatcacgcagcataggtttgttagtgtaatttacagaatacagacaaatttccagacaaccttatgctgtttatactattccaagtgtgggcataaaatgtcctaaaatatttcaaatgaaacatgctttagttctttaaatttggggtagtggcaatgacgatcatagatgttgcattacattaaagatgaccttttctccctaggttacccagttacaatctgttctgtgcttgatcaatcagcacttaaatcacaacacttgttaccataagcactaagaatgaagggaacagaaagacctttaaggtgcaatatagtatcgaaatatcttttcagcatgaattaagaaataaatgtgacaaacagtaagatggaatacatgagagatcgtgcatgaaacccagcaggtttccccacactatgtgctgcagagctttgttttactatggcgtcctccctgatggataggaaactaaaggaaagggaaggaaaaggggatttacaaatgccagtcatccatccattggttagcaagccatgttcatttgctgctgttcccgttgcactggtgtaccacaccattgctgggtgtattaccatttgcatagatcccattgctgctgccaacatccttgcgcttcagattggccttctttaaaccccatatacgaattgtgtgatcatcacttgcagatgcaagcatgtgcggattcgcaggattccagctcacacagttgaccgtgccggtgtgaccaggcagagtttcaataagatctccagtagctctatgccatatatagatctgaagtaggaaaattattccagattttgaggttacggaagttgcagaagacaggacaagatatatagatgcagatgataggaaaagatgcgtgacaatctagtggttagaccacgctagacagcacatagctccacactttgtttgccataacaattttgagacttaactagctccatccaaagtaatttgtagcatttcatctttcttcttttccatattaattttgtatatcagataatgggtgccattactggaatactaaatggttctatctggtagactactaattatcagtataaagacagtaaattctgacgaaatatcccaacataataatgcatatttatttggattaaactttaaactcatctgtcacctctattctaaaaataaaatcagcagcagccgttccaagtcattagacttgataaaacagcaatcaatatttatgcattcataacattttggagaaaatgaggtggtcgatgcctagataacaagaaaacacagtgtaaatctgaagaacaggcctaaacattaatacatttgcggtactgtgcaaggttccaaaagtgaactagatgtagtgatgtttttgtatacagtgtaataatccaatgtattgaggatgtttacgtatgctatgactatattttccttacatactgaggaaatctagaatgcagaatgccaatcattagcacaagtaatagaagaacactgtaacaacgaaatttaacaacatccatatcattattttatagtgataggtggccatcaagcaaaatcaccatacctgtgaatcttcactaccactagcaataaaggcctgctcggatccaccaaaacaagaccttatcacaaaccggctgcgcttatgaccagcataccggttaactcgaatggggcaattccttatgttccacaaatgaatcgcctcacttataaggtttacaagcaagaaatcaccatcttctgaaagagaaaatgatgtgattgtattgtcctcctcaatcaatctctcctgttttgtctcccgatcaaataaacgaatggtggactctctattcatgcttattataagcttgccatcgtttgatacggcaaaatcagatgttttagatgatctctggcctttccaacaatctacttctttaccatctaaatcccacaagcaaaagttatgatcagttagaccagacaatatatgctttccatctggaaaccaaccacatgagatcagaccaatgccagacttttcataaacatgaagacatttgccagattcaacatcccaacaccgaatgacttcttccattccacatgtgagaagctggcaatcatcagggctccatgcaaccatcatgactggcttgtcatgaccagtcaatgtgtgctttagcaatagctctccatcttcatcaacctagggaatgatagcatatgctttgcatcaagagaatatcaagaaaagaccctttacatcatgatcaataacaaaaacaaaacatataatgaagttctctgcaacagattatatacaacatactaatttccataagacaaagggaaaatcttgtagaggagattcagtcactaaaataaagcattgttgcaggggagaaactgtgagaccaagaaattaaaattttattttatgccaacctgctgcaaagagatctaatgaggattcgaattgtgaagaagacttgacgaaaaaaattgaagaataagtttcaaaaatttaatgtccttgggcatagatataccagatgactataagctcagctaattaaactgaaaatgacatgcataagaaccaacttagattaggtggaatgtaagacagactactgtgaccagatgagaaaatatgcactttcatggcaatagttacaagctaggaaaaaaggtgttatactacaagttcatagggcaaaattggcaaatatctatattagattccttgctgataaagctagctggagataactctcaagtagactgatgaaatgatcagataaatggcaatattttatcttaattttcagagatcgttttttttttcagaattcacttcagacagaagtaacagcagagacacaaaacctgagggtgtacagaagggattgttctaagaatgtctcggatttaattcaatgaaaggatccaaatcctcccacccaatcaggcctgaatgaacttgtgcaaaatcatgatttgacgaaaggtgcaaaatgggaagttcagggacaacaggctattggactgctaaacaaacagctccatgcaaataagccactatgttcatggatagattcgtaatttttaccttccatatgattgcggatttatcatttgatgctgaggctaaatactttccattgtttgaaaattgaagaaaccatacttcatcacggtgtgcacgcagaacctgcaacaagaattttaatgtgcgattagtaccagtgaattttgagatatggagctgccagcaaagagaagtcttggcgaataacttaacgggaaaaaaaaaagcagttgatcacccaacggtaaaaaaaatgagtatatgacaaagcatggttatagaaaaccacaaagcaaatccaccttgcacattagggcctgtttggtagagctctaactcctaaatttagctccagaagtttggtctggagtggagttgtggagcagcctaaacccagctaaacctctctagttcattttgtgtgagtgctccacccagctccgctcccattttaggtggagctgaaactgtttagctaggctccagctccagaagatgtggagctggagctggagctggagctgtgccaaaaaggccctatgtttacatttctccatgcaaatttcccacaaaaacacaccaaagcccagccacctagccacaacacggattcaacttacacctcatgtttagcgtttagacaggcaaatttcccatagcaaaaagctaggtttccatctaattttatagtaaaggcaatgttttccagaatgagagaagatgagtagcacatatttcttatttgctctatctgatataaaaattttaagccaaatcttttcttgatccaaatctgaattttgcatcaaactatgttactttatctaaatagtaaatatatatatttcaggaatatgcaagaaaaacttggtccatgcctactacaactgcaggctgaactttttaaagttgaagttttcctgcttccatgtaaactgttctgtaacttctgttttactatccaaaaacacagagcacttgagcactcacaatagtgcagtttacttgtttagtaggaggggagggaagggagagaactttgacacttgcatcagtaacaagttagcgctagggcccaagatagcattaaccagttggactacagagaagctcattactatataaagcgtattgcagagccattagaagtgatacacaacatattcatgctataataaatctattgtaggacctttcgtaacaagattcagtaataagctattggactgcttttaacaaaaatctcctctctagtctggtaacaacattatagtaacaacctactgagaattacttcatggtggccaaaggcagtatttgaggaatgttttaaataaaattgcccagtggtggatcaagaaaataatttaagtggttaaacagaacaacagagcagtaggccaagaaatcattcttatgtgggtgtataagcagtcaagacaagtatacaaccttcattcataacactataaactgaaataagcacttatataagttattacctgcaccgtgcaagatggtagctgatccttcccacagtgatgatcagtgtagagtgac

SEQ ID NO: 79515 - DNA, 5486 bp, Oryza sativa
caataagaaaaccaatacgaaacatttgacttcctttaatttaaaacgaaggggacaaaaagtagtagttcctgaaaggaccttgatgtcgcctagagggggggtgaataggcgttcctaaaaattatcacaacttcatagcatattagagagataataacttttgattcaaatcgaaacttccggtatgggattggaagttccggtctcaatcgaaaagttcagcggataacggaataaacactagctatgaacttatagctcaaacaaacaaaatgtatatgaatcaaaaggtgacaaataagatatctaagcaagatataaggtcaccaactaaatcaaataagcatgcaagtagatcgggtaaaaacaagctcaagcacaatatgagagaatgcaagaatgggcaaaccaagaagggagacgcgcgatttatttcccgaagttcggatccacggatcctacgtctccgttgaggagccacaagggccgagcctatttcaaccctttcctcacgaggttgcacaaatgcactcctcggtttcactcttgatttcttcccttgcggaggcgaaatcgaagccttcacaaactttccgtggcacaccacaaccttgggtgctcaccggcaacgcctagccgtctaggagaccttagtccccaagagtaacaaaacaatcgaagatttgcttgctatgaactcgagtgctcaaagtatggagtgaagctcactagctctcaacttctcaatcactcaatccaactcttttcccttctcaaatccctctcataaagaggcaccacaaaggatggagtgaagctcactagctctcaactcctcactctctcaatccaactctctccccttctcaaatccccctcacaaagaggcaccacaaaggtagggaaatggggatggctatttggctttggatgtgtctaatactccccaagagcagcagccactcaaaggaggggtggaggggtttatatacccgagcccctcaaaaactagccgttggaggccaagactgtaattttcggagtttccgaaaagcattttcggacaagtccgaaaacttacagaagcaaatctcatattcgcagccattttcggaatgtctgaaaattttcggagttatccgaaaaattttcggagtttccgataatttttcggactttccgaaaagcgaagagtaaaacgactataacttttcgctcgggagtccgtttttaatgaacttggactctatggaaagctcactcagaggactacccaactcaaccaacaacaaggtctaaaaccactcaaaggatatgttaaaacttgggtttctctcaaggtagcactatgataggtcactttgagcaccgagacatacacaaacacctcgacgttgcatccctcttaatagtacggcattcctaaactcaaatgtaaataagaagagaactataccattaggaatgcctttttttcatctttctttcattgtcttgagggacgccaatgccgataccgtttcaccatatattcttcaaataattgatgcggttacttgtagctttaaatggtctcacacggtccatcatgacaaagccgtcactcgcccttcaccaccggatttggttcttcggcgccaagccccttgcttgcccttcaccgccgcatggtccatcgcgaccgagcatcgcttgcccttcaccgtcttgtcataatagccacttcgtatcacacatcttcaatatcttcactttgtcattcttggtattgttagatgtaatgatattacttgagcatcaacacctttgtaatccttgggacctatttctttcattcaactcaataaaattattagtcccaatgatccggttgtcaacctacacatgttgaccaactgatcgcaagtataaaaggatatgaataaatgatgagtattaatcaacaccacaagtgtcatatactcaaatatatgttcaagtgtaaagatcccaattaaatgaaggtgaataatttggatcgattacatgcataactaaagtataggatttgctccccctaaatgtatgcatacaaaatatttgtgtgaagcaagagtatgcataacaagatagtaaacattgagagcttatcctatataagaatagaaggcatttatcaaatatagacaacaaaataaaaacatacctgaaagtgcatctaggcccctaatgattttgatgattgattacaatgcgattagagaggactaacacttttattcaagcaaatgtgaaggttgttatgtcctcgacatgttgtaatgagatgcataccccatgaatgcgacatcacgatgcaatgcggcaatgatcaaatggtatattgtatcttttaccttgcattgtgtcgtaggaatgccgtactattaagagggataccacatgcatataattggtagaacactagtgctcaaaatgcttcatctttgtgtgagttgaaaaacctaagtcaaaatttcaatcccgagttgtttcacttgtcacaacacttacaccgggtttctttgcaagtttttcaacatctcttgaaggttttggaccatgttttatgttgggtttgatagcccacgaaactagcattccatagagtccaagatctttgaaatcggagttcggagtaaaaagttattgcagttttacttgagcaacatcagactatccgatttgaaatcagactatccgatgtatcggactatccgattcttcacagaacttcactctctgtcttgatttgaaaaaatcctatcgagtgagtttttctaagtatcggagtatccgatgtcggatcagatagtccaatgatacagagactccgaaatttcatagaacttgagtctctgtttgaggacgaagtttttgcttctaaaatattagatactccgatttaacattagatagtccgatgtctcggaaagtccaaaatttcatggaacttcgttctctgtttctagttgccttggaggtttaaaatatcggactatccgatcttgtatcggactatccgacgtgggctgaaagattcccctccaacagccacatttttggggatctataaataccccccacctaacccttttctagggttacccaactcatttcattctcattcactttgggttgagcttggtgctaaggtgctttggatctttgagctctttctccctctctcaaatccctccttgttctttgtgtggtggatcttggtggttgtggatttggtgtttgagggcctagtgtgtgtttcactcgatcttgagcactagggtttgaccaagagttatgtggtgtttgttactcttggaggttgagggctcctagacggctaggtgtcactcccgagccacaaatctacgtgtggttggccgggagaagtttgtgaaggccggattcacctccgcaagaaaagagataccccttagtggaaggaggagtgcttagtgcaacctcttgaggaaagggttagcaaagacccggctcttagtgagcttctcaacggagagtagaatcccctcaaggatttgaactccgggaacaacttcgtgaacttcatcattggtgatctcccttcatcctctttttagctttgcttaattgtgccgctatagatctagtcgctgtttgtgccttactcttgtttgtgtgatagatctacttgttgtgcttcattggtggatcagacagtctgatccaacatcagactatctgatattttcggatagtctgactgtggatcagactttccgaccttatttcagttttagcttccgcataaagttttaaattagcctattcacccccctctaggcctaattgaccctttcaattggtatcagagcctaatctcctaattaggcttaaccgcttggagagatcatgtcgggtcaaacggggaatggcaaggatggtgataagggagctacgtttccttatgactatccctccgcatctacatcttatgtgagcacctatagcggcaaagctccgtacttcaatggtacggactatgccgcttggaaacataagatgaagatgcatttgaaatctattaaccctttgatttgagaatagtcgaaaaaggctatgttttgcataatcctgaggaacccaccaaggaggacgacgagaacgagcacaagaacgctcaagccgctaatgcaattcttagcgtcttgagtggaagtgagttcaaccgtgtggacggcattgagagtggcaaagtgatttgggacacgcttcggaatttgcatgaaggcacggatagtgttcgtgagtcaaaggtggagattctcaaggggcaatttgagtggtttgtgatgttggatggtgagagcccaagcgacatgtatgatcgattgagcaagatcgttaatgagatcaagggacttggctccacggacatgaccgatgaggttgtggtcaagaagatggttcgggcaatcactccaaggaactctaccttggtgaccatcattcgtgagcgtccggactacaagactctcacacctcatgacttgctcgggcgtatccttgcccatgacatgctcgagcaatagtccaaggaggccatccaatacatcaaccaaacctcaaccacaatcatcaagaaggaagacttggcattgaaggcgaaggaagaagaagaagagagtcgcaagagcaagagcaaggcggagatcgatgatgaagagatggctctcttcgtcaagaagttcggcaagttcatgaagcaaagcggcttctttaagggaagttcgtccaagtattcctctaacaagtcaagtggaagacactccgcaagggtgtgctatgtgtgcaaagagcccgggcacttcattgcggattgccctcacatcaaggattgcccccacttcaaggaagacaagaagaagcttgagaagaaggagaaacacaagcatagcaagcatgatcgctatggccaagctcaccttgggatgatcttcggctccgactccgagtcaagctgaagtgaagaagaaggagttgccacgttcgccgtcaagccttcatcaccaccgagactcttcaactactcaagtgatgaggatgctcccatttgcctcatggcaaaggagcctaaggtaccctctcccctcaagtcatttaatgttgatcttattagtgatgaggagaaagatgttgaggatgaggttatggatgacgagttgttcaaatccatagcaaaggaatccataccacacttgagtgagttgcttgggagaattgagaatcaatatgcaacccttgagaggcaagaggaattgctcattcgtgagaaagagtggtctcatgaactcaagagtgaactttctaaggagagagagagaaatgaggctttggtacggctttacaagcaaaccaaagagtctcatgctaatcttgaggtgacaaacgctcaacttcaagagagagtggatggcttggat

SEQ ID NO: 79516 - DNA, 1947 bp, Oryza sativa
tttattaaagtcaaagtaatttataatctgaaacagagggagtatctattagtgggtctaaaattctacctacctgatgcatagactgattacataaaaacaaccactacacatgcttcgaaaacatgtttcgtctatttttttcctaccacattacctaaaaccattagatctcattttaaacttttttaagtttatttcttaaaatatttaatttatttatacaatcaaattgatacttcactgtaataatgtgctcaataatctaaattaaaacgacctaatggcccagagagcttaaaatactaaaagttgctggttggtaatcggcttctaagaatttgaaaaaattgaatttcccagtttctgatttctagttcattttgtttattttacaactatagtttctcagaatcttaatgaaaagttgactgtttatgggagcttctgaagaagctgcatctgtcagaacttagaagctccaaaaacatgctcttagtcatcttccttttggattatgtgtcaaatacattctttcttcacaatatatgttttagcagcgtctaactgtatggtttatgtcctttaagtgtaaccccacgttctcatttctcttctttaattacgttgtatatgaagaaatttcctatatgatatacaccctccgtttggatattttggttttgtccaaagtcaaacttatttaaatttaaccaagcatatagaaaaggtatagtagcatttataactccaaattaattttattaaatctatcattgaacatatttcaataataaatttgtttggaaatattactatgtttaatataaattgggtcaaacaaaagaagtttacttcaaataaaataaaaacatcttacattttgaaatagagagaatagtccttagatggcattgtagtgggttataataatctccatgggtacaactcgttttatatttcaaagtggaaaagtcttcttttctctaataaggggatattctcttattttttgcatgccatttaaatagttatgaaaatttgataatatagatcagcacataatatatcactccacgaacatataattttaaatttgatttatactccatccgtcccataatataatggatttgttcccagctaaaaacaaacctctctagtctaatagcaacaaacaaaacgaagattgatccccaaaatattgaagaaagcctgcagatatctaggttggaaagcgtacattccctttgtcagaggttagtggaggaggtaatggagtaggtgtttctggtcgtggcttcggtggtactggtcacgggacgggaggtgccatttatagaaaagattggctacaatagcactttatgcacttacttttggctattctacatgggcaaccctgggaaatgggcttcattcaagtcttggtcttttcggattcacttatttacgtgcattttcttaaggaaagagcctatctacccaaacctgatagatggatgtaatgaacctagcatagcgaattcttgaagttgaatataagaaagaaagcctacaagtatagaaagaagtgctagtatcaaataaacataagtagttgagtcagcataagtagtttattgcttacgccctttgcttcttctttttctcctagatcctatattgcttcccccttatagtaatgattttcaggtcagtttgagttacacactaagctgcttattacaaaagggcaactcgcttacgatccaacatgccaagcctggtagcagaaaaggcatgcaacaaatacctagcttgaaaactagagtataaagtagtttagtgaaaaggaaagtagtttagaaattgttacaagaatgaaaacaaaaactattaataaactgaatgcaacaaagaatacaaagctaacacccgaggaaggaccgccgctcctttcatatg

SEQ ID NO: 79517 - DNA, 9982 bp, Oryza sativa
  unsure (1)..(9982): unsure at all n locations
atggtctgctaactaattctggtgaacccaatgatctgtatgaggcacttgatgataaaaattggaagggagcaatagatgaagagtatggtgctttaatgcgtaataacacatggcacttggttcccgcaactcagggacacaatttgattgattgcaaatgggtttataagataaaaaggaaggctgatggtactattgatcggtacaaggctcgtttggttgctaaagggtttaagcaacgttatggtattgactacgaagagactttcagtcctgtagtcaaggcggccacaattagactaatattgtcactagcagtctctaatggatggtctttgcgacagctagatgttcaaaatgcttttcttcatggagttcttgaagaagatgtttatatgcgtcagccacctggttatgaagacaagtcaaagttggattatgtgtgtaaattagataaagcactctatggtctcaagcaggcaccaagagcatggttttccagactaagcatgaaattgcagaatcttggatttcaaccgtcaaaagcagatgcttcgctcttcttttacaagaaaggtacaatctccatatttgtgttgatatatgttgatgacatcattgctgctagttcttgtgaaaaagcaacttcggcattacttcaagatttgaaagaagaatttgcccttaaggatcttggtgcattgcactatttcttgggcatagaagttaataaagttcatgatggaattatcttgactcaagagaagtatgctactgatctgttaaaacgtgtcggcatgcatggctgcaaggagatcaatacaccgttatcaacaatagataaattattggcgaaagaaggtgagcctctaggtgcggaggactctacaaggtatcgaagtattgttggtgcgttacagtacttgacattgaccagaccggatatagcttttccggtaaataaagtttgccaatatctacatgctcccacttcattgcactagacagcagttaagcgcatattgagatatctcaaaggatccttgggacttggtcttcgaatttgcaagtcagattcaactctagtaagtgcgttctcagatgctgattgggcaggatgtccagatgatcgcaagtccactggagggtttgcagtattcttgggagctaatatgatttcttggaatgctcggaagcaggcaactttttcaagatcaagtaccgaagcagaatacaaagccttggcaaatgctactgcagaaattatttcggttcaaaccttactcaaggaacgcggcataactcagccgcgggctgcatgcttgtggtgtgacaatattggtgcgacctccttatcagcaaatccagtcttccatgcgtgaactaagcacatagaagtggattaccactttgtgcgtgaacgagtgtctcaagggttgctggatattcggtttgttcctttggagatcaagtagcagatggcttcacctgtaacctacctagaaggcaatatatacaaggcggcctccattgtggaggttaacacgcttcatcaataggttacacaaatttacagtgctaacatgactgcatctctacacgccagcatctccactgtgctcggatcactgatatggtatatcttcgacactcagcagtgacaaagtttcctgtattatcccgtgcaacaattcctgcacccgcaactccatccttcaagttcagtgctccattagtgttcagtttcatccatcccaaagcaggtggagcccacttctgaaccacagccgatgggtcctcctgagatggaatctccagagatttaatgagctcatcaaccaattcaacagaccttaacgactggtacttgacatcgccatggttgtagctgtttcggctcccccagatggtccacattacagagactgcaattgccgcctcccgtttgctcatgatatctgcatccaacacgtcccacgaccatgtagctgggtttaaccgtggcatcttgagatcaaaaagatcctgagccgcactccaaaacaattttacatgctcacattcgactaatgcatgaaactttgtttcattgtcattgccacagagaggacaattacttatttctttcatatggcttctgcggagttcagcagcacagggtagcaaatttttcaccacccgccaccagaacactcttatcttaggcattatccggagtctccacagtgctttctaggtagcctcgttacccgtggacgatcccgtagcaggttcagacaggccacaacgctgaatgagttccctgtacgcagatctcaccgtaaatatgctcgttttgtcccatgcccaagcccaaaattcatcttgctctgttctcggccttggcatgttcagaatagcagccgcatccaatggaaggaaaatccgctgcaccttctccacatcccattggtttgtattatgcaacatgagatcggcaactaactgaactggatcatcagtcattctccctaacggcttcattgtttagtagtccatctatccattgatcatgccatatttcagtggtacgaccatctccgatcctacagatcaatcccattctcagtacctctcttcctttgatgatccaagtagacgaggcacctcgagggcaattagcagatagaatatctcctcctttgctgtatctccccagcaaaacacgtgcacaaagactatcgggcctgtccagcaattgccaagcttgtttggccagcacggcatcgttgaaactctcaagatcccgaaaaccaagtcctttttcattaaagaagcaaataaatgacttcaggggcttgtgtgttgattttgttttgaacacatacttgaatttctccttgctacctaataagagttcaaaagaaaggaaggccctattccagtcaaaagtactctttacgctcacgagcagtcctatgaggatcccccctggttctgactatgattcactagggcgaagatctaatataatctggttcaagttttccttttctatcgggccatggatcaccttccttttttccatttttttaacttgatcacgcaacatttctttctgctttgacccaattgatgactttgtcaaactccgtaggtagggaggagtggtctttcaggattggtccttgtgtttcactactgtacacggaggacctcctcttttttatgcatcttttgatttagtttttgcaatacctcattcacttcaagggcaccccattgcaactaatgaataatgaatttgctgtcttctatctaggccgacaccgggattcaccacaaccctttgttgtattcttgaagtcaatccatagtcatgagttctgattaaagaaagcaagccatacatacatcagtgggctgagaagcaaatagttcccccgccactccatgctatatttcctgccttgaccctatcaagcaagagaagagggttgggggtgtgctgtgatggtcttactgatatagaacccttccctcattgaaaagaaagatgccctcacccgatagttcttcttgctttagcttggataccggataagttgatctgattcaagatatcttagaacacagcacattcagtgcataggccggccatcatctctctccttggataagcaggatttagcaggaaatatcgacagcatttcctatagaaaagaagcctacttggttgggtgggaggatgaaaagattctcttcctactggaagatggcactgttgaagtctggagagcggaagatatttaagtaaggatgttatgccaggtagcattcggtacaagagtgagacggaggtagctccgtagaagaaagtagttttgcaaagaagcttgttcttcggagtagattggcactacggcactactagcttttgaacagaagaaagagtttgttttctcgtcataagtgccaccaatctcgttcaggcactaaactagtttctgggaggatggatggttgtcccttcttctcaatagaatccgatagacaagaatcgaaagctgcagatttttttattcctcaagtaagtcagttgatgattcaattccatcaaagatggcaagagcggggcatctagattgattcgtttttaaggttgttataccgaataaaaagtattctgattctctgttgaggcaagctattcatcattaacaggaaagatcccaaagctgttattgcaaacatgggatagcctgactctacgctacaatctctattttcttatgatattgaatctggcttctattattgaatcaggcttctattattcaatctctagttaccgtgggaaaagaaagagataagagctcttagtgcatgcctttttttttgtgattcgagcagttcttgtcacaagatgatgggccagagaaaagtttgataggaaaggaaggcgacagttaaataaaaaaaaagaaagggaagatgatactgatataagagtactgctctttgccctaagattacgatcagtcactttttatgtttcaatcagctcctcacttcttattaaggttttcgcgaccgacacctagttctttccacatcactccactgtttgagcaatttccactctccttcctggtcaaacctatcaaaaccttcgttcaagaactcattccagcccatgccttctctgactactcctttcactttttgaagtgtatttatttggaacaactttaaatacttctcgcacttgtcaacccattccctcgttctcccctccattaaacataggaaatttaaccccaatccagggtcaaacgaagatacttgttagcctagcatcatgtgtatctgtagccttccctatttttgacaatctcctatttcttcgtagcacgtgtctccttcctatgttccgtcccctgttactggataagtagattttctgtttgaagtgcctagaagatccagcaaacggaggttatctctcccgccttgagtttcggtcttacgcattcaagcctagaataaggcctaacaatagggtgtaaactttagcgaacttccatgcttatataatccaatcaattgcaccatgattaatccactagacaaaaggaaaccacaatcactacattaaccgagctatattagccgcgctttcaagagcacacatagaaaccacttaacagtgactccttctgttagctattcatttcctgggagttcagactgacggttaggttctttttctaaatttacttaagaacttttgggcaaaggatacaccggaaaagaagaggagcctttgttcgtttggcattcgttggggattcatttctcgttttgcgattagattcattgctcgtcgatatggtttagtaaaaaggttttttctttttgaaaaccagattcatgcccagaagaggatcctctatctgctctcgaagcagtcgtcagcctaagcttaggttttaaatccttaggttgaccctacccctttttcttcctttccctatccaacccgagctctatcggtcatggctttctcctctcttcaattctttccgcccaaactaatccgcactagccccaaaccctagccctgttgtctggattcccgatctctctcctacaagaaaaacctattccactaacgactctctttgtcttataacttgctaatacccacatgagaaacggtttcccctcgctttcagcctcccattatgtcgtaggctctccggaccttccattatatttgagagatgaaatgcgtaattcaagtcatcaaacgagcataatgaaacatccaatgcctcgagagaggaattttagagacattgctgggcccttagcctgccagtcaacttcagcctgagatgtgcccgtcaaaccactcgaaggcggcgatcagatgtgttacacattcaggagacttgacaaaaatggctaaagatctacaacctctcaaatatccctaactcatactcatgtgaatctagttcccaggatgtgcactagattcacactttcatcttaagcatgattatacatagcaaacacaactaagatgaaagaaacttaagacttacaacaacttaataattacataggccgaccggccaaatagacttattagagaacagcggaagcttgactacccaatcacaagcacaccgactaggggtttaccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctactatactacatgtaaggcatatattcaaaggaaggcaatatgtagttcaatttcagcataaagcaagttttgttttgcaattcttttgtaaaggagttgatgcttcaattaacaaagacaagttntaagtttcattattaacttcttcataattccatcataaacaatctctttttgccatacttaacaataagtcataatgtatcaccacatacacaactcaacacatttatcaatttcaaacccatgtcacatgatcacatttttaaaacatagtctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagagcctagccttgcaccagcacgatacgtgttcctccatcctaggcatacttggaatatacctggaaccgttaagtggcgggcccacgccttaaacttaacgccgtggtggcggacacgacgggaacccaccacgtggcacaataccgttgtattggacacgcttagtcacctaaactaccacgtcggggtaaataggaagctcctctgaattatacgaactcatacacaccggcctaccagaatgcaaagctagtcctaaatagattactcagcttaggccatcccatactagcacatgtggatgtacgaataactttaaatgggtgacacaagttcggtccttatcgacttgggcaaacactccccctatcggtatgcaactaacaccatatgcacaccacttgccgcccaagtataaaatcacattttacatattttagttcgtaaatacccatcatattcattttattccaacaaaggttcatatatcaaaatcatattttaattatagatggaatgagcatttgcatagttctaagcatggctaagcaagtagttacaaatagagcatatataaacccatttgagcacaaagagtgtactctaaccatttctaggggttcaaacagtaagaggatcaattattcaaggtggggtatgcagcaaataggtcataactaccttaacccaattttaaataccgatataatctaagttcacatgcagctttgcaaacaaacattttcattcctcaaatcatgggattcaatgtgttcaaaggatgggaggagaaaacttgccttgatcagagaattgttagcacctaatccacttcttcaccgattatgcaattatctagaaaaaggacacgacatgcaattaaacaccggaagaggtgaaaatccaaaatgctctaaaatgcatgatttatgcacagtgggttggaaatgatctaaaatgaatttaggtgaaataattcctattttattttattccatttgggagttatgaattttagaatttttatcggtttacaatagtatagtcttaggtagtgttatgaaatacttttgtaaagtgatttttattagattagacttcacaggggtgtggagatgtgttttctaagactaacacatttggtttcacaatttttggaattataatgaattctttatgcattttacaagttataacgtgttttagacatatagtgttttatatgttcatgacttttgagttataggttcagaacatgctacttcctgtttaagttgaataaaaggaataattcgcttaactaaaacatttttagttcacatgtttatggtctttactactatggttcatattttataaactagagatgctctaatctaaactagcaatatattatattaacctagaaattgttatatgagctaagttcttctaagttttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaatggctgctctatgttagtaaattcttatatgaatatttagagacttttactacacagcaagtatataatcttatttcataacttggaaatacatgttttagtgatcctacataacttaagtttattcaaattgaagctaaattgggttctacatgaatttctaaagtttagcttatctaaaactaatcattatagagataatagttttagaggcatttgatgcaaagtaagtcattacttttatttaacctaatcagagagtgtctgatgatgaatctgcagtttttgagtttgtttcaaaatgagttgaaatgaattttctatgtattttataagtttgtacatgttttatgcatgacttatcttagataaatcttagagacattatttgtacagtgagtgtcaagttttatattcctggaataaagttcataacttcaagaatctacagcaactggaatcacttcaaaatgagcttcatttgattttatatagattttacaactttgtgcatttttctgctaaacatgtatttgtttgggcattttcctaatttttcttcagattttaaaggatgggtccacatggctgtgagggaccaatatgcacaaaggcccttgaggtttctaggaatcaacccgcagtcctaggcccatatgtcagttactaatattttgcgcaaaaacccctggtttctcgggaaatagatcccgcagtcccctagttttaggtttgtatgcaaaacgatgcttgagttttagtttatttacagattattactggtcctacttgtaagtgactgttccagttgttaatacatccctgggaatctttaaatttcaaaagccatgcccttgctctggacagagcagagcagcagcacagccgcgagcttcacagcatcaccagtggcgaacaacggcgattcagcttaagctcccaaaacaaaaagtgtagagaacaaccgtgtgaacctattggtggctttctggcaagatttggtgctctatagcggctgttagggtgttagaggcggtggctaagctcggcttgcacatgcatgtgggttttgaggctcgatttaatcgtgcatgcgtatgataaggactctagggactactaggaggctcaccaagaatcaaacgcggctcggcgaagtcttggcgacggtgtactggttcggcgacggcgcaactgctacggtcgtcgtcgacggtgtactcccgggcttctactgcatatagagggtgcatgcttcggtttagatcagcacaaggtagctctaggcgaaaaatattgcgccgaagctcaccagagaaggagaaagaaaggaatggcgtcggcggccagagttggaaaaaaaaaagaagaggatctcccaccgtggtccacctcgcgtcgattccttcgggattcttgatctacagaagttgatgaagctc

SEQ ID NO: 79518 - DNA, 725 bp, Oryza sativa
aataaattcgtctcacggtttactatcggattctataattagtttttttattagtgccccaacaccccatgcgataccctatataatatctaatgtgacacgtcaaaactttacacctatagatctaaacacaccctaagctctacttgactccaaatgacatgtcttaatttattctacttcttcctatagttggccccaggatgatatgccgaaatgcaatagcgacagtgattcgaagtcgatcagcttcattcataaaggggcaaaccatgggcaactcaatctcccgtctatatcgtactagtacacatcccggcagaataactgcaaggttttaatttcaagcctaatttattagtgagttctggacactttgagaattttgtatttcatgaacactgacctggtcgtgaattagtgatcataatcgatcgacatatatcgcataaggactttgcagcaacactgaaggtttctttactagcggtcaaatttgttggtccacatttgaggaaaaatatttctcaggaactaaaacaccaagggagatataatgccaatattaattggaagatgtaaggcagtccgacaattagtgtagtttacccatacttgttacgcatatccaaaaaggcaatcagggtgtgtttagttctttgggtacgtgtaagtttttaaagtatatgagcacatatttgaagcctaattaatcgtagactaat

SEQ ID NO: 79519 - DNA, 13621 bp, Oryza sativa
tgaacggaaatggagctcaccggattgcgacggcgtcgaggacttctctcaccggcgccggagttggcacccccgttcccggcgaatccgaggcggggtacctcggttcttctgcgaaacgagacaggggcgagagagagtgagagttggtcggccagtcgggttaagtacggtcgccggcggagatggggaggaggagctcgccctcttccgcgctcaacgcgtgctcacacgcgtggcgcgcggggtctgagtcgtgggcctgtgtggagagggatgtgaggctgacaatggggtcccactaggcaagagagaggtgtagaaggaggaagtgttggacagggctgaacctagcctaaggtactgacaagtggggccaactcgatggaaactaggccagggagagagatatgggtagaagactggtaaacttgatttttagattaattttcggaattattttctcctctaactttgtaactacataattcaatgtgtggaccaaattaattagtgttgattttactggaggtaaatgattacacctagattccattttctttggttgcactaaaaaataatgggtggactgctcacagaaattaaacaaagatgggctattagaaagctagattgaatttttaggaggcttaaacagagaaggaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctaatcattgtccacataaatttttccatgattttatcttgcacaaaatattttagagaattaagttgacctttatttgtatatgtgttcccacttcataattgcatctaatattattatagggattacattaaacttcttttagactgagaagatgatatttgagtttaatattaagtccacatgttatcacccaagattaactataggtttgtttagtgaagtaattcttttagattatgctcatgggatctattatagaatgcaagaccaaaactccaaatgcacaaagaactcgagcctaggcatgcattatgtacatgtatgcttggtgacatttctagtctaatgttgggaatgaaaaggttttattttgttctcaaattttaatcatgcaatggtttaagttgatcatcacctaaattaaaacggaaatttttggctctcaaaattggagaaattaacctctaactattttgataagaaattttaagtcctaaaatttcgggtatgttacacattataagctagatgactctactgtgacatgttatgacgatctggaagcccccaaccatagatagatgctttgatcatccaggttttgccaatccacgaactgcatcgtataataaccgcggatatcaggcgtaggttgaccttgagtggttcactgaagggtagggctatctcttccctttccatgcctttgattcatcccggattgtgttgatgtgcacatgaacaaaagtgcacattcctatccccgaagcaaataaatcagatgacttttccgaagcaaagaagaagatgatggctctacaaggcacaacaccaatggaacagtggaacgggtatcttttagcaaagcaaagggaaaggaggtatcataccaaggggttgaagaaagggtttaaccagcggattcgcatatctttttccaatggcttccgcatccctagttttttaactcctggtttcgggtaacggttatgggtttggcccccttcccttggcgagcataagaaccattcgtatacgttaggagcagaagttgacgtgggtatactcttcatttcatccttttcattgaatcccctatcctattatccagcaacgcccaagctgtcgatgatcacctagctcttgttggaagcaattgaagtatactctacatcaacatgggattgaaaaggtgagggcgtagcgagcgctagagctattcctacgaaaaggggagctattcctatgattcctagtatccgttcatcgatagactgtcctcgggcaagggaaatatactaacactattactcaacccataataccctttccaagggctcaaaacgggtctttgctacaatccaatccattttcaaacaaaagaaaagagcaagttcccacaggcgaagagctgcttccgagaaatatttatcttcttttaccccctttacgcccttcgcggctgctaacaatgagctaatacacaggaacggcacggctcctacaccgcttaactccaataacagaacctggtcccacatcccttgcatttgataatgaaacaatcagaatttgttgaattgaacatatttcaatctcatttcttttacgtggttttggcaactatcaattatctctttcctcggcttcctacacggatatagccgtaaacggtatctagtaggcaacctgggaactacattagcttagggggatcgggtagcgagcgctctcctcggcaaagcacatgattgagatttgaattattgtattgtgaataaaggcatgaaaggaatttaatagtagttaggtattaaaaagaagatctaattcaagtggtaaagcaagtatataatgatgataaagtccagaggaaaggaatattgtttcacgcctgcatagacaagtaagtctgccacgaacccctgtccctgccaagtagaaagctagtaagcaagtactgaacttcaatcctgcattctcactcttgtttttgtcgctcaatccaaagaaagaaataggaatacgaatcctcatccccaaagcctgggtcctagactactacgaatagaaagatttctatggatatcctttgtatcaattttataatgcttatcacctccttctgagctattcccacggtgcctgagcagttgccattgagaatgttgtggggaacgattgggtgacttagcacaagcagcgcgtaacaggtcctttgcagatggtaagtacctggatttcagaggcattgctagatgtgtcgacttgcgagacgagattgcggtgtagctcttgaaagaaagaaaaagaggggctcagtaacggcaatcaacggctcctcggaggcaacctagccaattgagtagagatatgaaatgacgagcgaattacccgattcctattatgctacgccccgggatagtaatagccttgtttcggattttctagcgatgactagccctttgacggctcctatccctagacaccggcccctggtaccaatactagagatttgccttggctgtagttcaaagaagttcttcggctttgggaagatgcgaaccttataccattgtccttggatagatatgaaccttacgcgggcagcggatgagcatatccctagaatacctgcctatcctacctaacgctgggttgaacctaacgctagagcgagtactacgatgcaagctccttttacaagcgatacctttgtctttggtgcttgagttgtcctcctagcggtgtgctcctcggtttcggaaatgacatattgaaccggtatctttagcaaagcccaaatccggcagacccctttgacggcatccctcctctaaagctgcttccttccttcaagcaacgcattcacgaaccaatacgtagtacacgacgtagtaaatcaattaaataatgcaatccgggttaaagaaatgaaatggttgttgccttctcggacaagaaggaaatatcactctctatctaaatgatagaagtatttaatcaaatcagaaagagccctgggatttgaccaaaacggcataattgaaagctctcgtctctgccgctcgcctaagaaaaggtatcgggttgctccgtgatgacgaataagcagcccagaaatgaggggaggagactctgcctccatagtataagttgctatccacttatgcttggtttgtgcttgaccacgaaatcttgcctcccaccatcatgaaagacagatgatgatgtcgatttcttactgtcgagacagcctgtccgaatccaaatcatttgacttcctcctttgcagtggcgaggtcgttgattcctataaatcaagatgttttgttgcctgcttctttttatgagccttctctcttggatggtattatccactggtatattgtgaaagtctctacaaagacgaaaggaccccatgccttctttgaaaatgatatccctcttcaatgcttccgctagccctagactcggaatactctgcttaagagatccccctctccggccagagaggatttgagtacaacattgattgcggaagatctttgttcctattatttcaaagcctaactaggcgcgcagcggtgagtgcgagctgctttcaagaaatgctggaaaagagccagtaacgctatcagtgaatagagctggtgtaaagtccggctaaagtaccatacagccccacaggtttagccacacattcacagagcatctaatccatcttttcccatgccaaggaaaaacaaaaaccaaatcacctcttagtgttgcttagtgctcatgtgcatcctactgggtagtcctaaacttcagtagttctatgaccactacatgatggaatttaggctatagtaacacaagttaaggttcccacagcaatgagggctttaaaatatactccctccgtccctaaatgtttgacatcgttgacttttttaaacatgtttgaccgttcgtcttattacaaaacttttgtgaaatatgtaaaactatatgtatacataaaagtatatttaacaataaatcaaatgataggaaaaaaaattaataattacttaaaatttttgaataagacgaacggtcaaacatgtttaaaaaaggcaacggagctaaacatttagggacggagggagtacctcccagcccttcatctctaggacgtcggactggtcaagcggtactatgcacccccactttggtataccctcctaagaggagtacttgacagtaggtggtgggtttttggggatagtatgactcggcccctggaccatgccaaccaagacttcccaccaggttttcctatttggggaaaattccagatatgcaagacgcatatgcatgcaatgcttaggtgtagtgaggtggtgtgtgcttattgcaaataggttaacccttagtttatacaaactacatttttcacaaaggaaagaaatgggaatgttggtgaattttcaagtcaagccatttatatttataagccaaaaacctttgatttaaggcttttattcccttgtggagtcgcgtgttgtacgcccgcattttggcaccgcttgccacatcatcattactttggccacctaagcaacccagtagaagaaaaaggggtttagagtcgccacctgaaaaatcactgaaaatttggaataaataaatggatatatatatatatatatatatatatatatatatatatatatatatatatatatatatatatatatatatatatatagtggctatcttccttcaagtgagagagaggatcgagaaaccatcgcccaaaggtgctttcacgaaagccggtctccgggggtaaagaacctttcttcactcttccagccttccaaaccatccactggattttcatgttcgtaagttgaaaggaatatgtgtgtgttgtatataaataaaggactttcgatttagcgttgtcatttttacgaggttttagataatccaattttctgtgagattactttcattttgactgaatcacttgaatcagttaaaggagacgaggcttctggcccagccagaggggctggagaggagagttttgaccgcgggggaggcaggtccagttaacggggagaatccgctaggctgaggttaaaaaaatcttccaaaactttttctttagagatagaattcctcccgagaacacacgaaacaaaaatatgaactaggtaaatagaaatggaaaagagatgtttccaattcatcacaaaatctaaagctttttctacatccatatgatctactttagtagattggtattgcccatataatgaaagcagatcttggtccatggagtcccaagaaggttggaactccaacctgtccgatgctttttcggccaaataaatagaaaagtgggaccagcacaatgagcaagctgcgcgaaaaaccgcttctttttccggttccgcaacaacttgggcgaaatggggttctaccgggaaaccatggtcgagtttttgaccttggttactggtcgagccactggataagaatctctggagatctttcctctccacttacttgtaacaggctttccctctgtataagacttcttccgaatggcataattgtcctgtcctattgacacctcgatctttaaagaaaactgactcctccttctcttttaggatttgattgttgttggtccttttttcagtaatgatctcaccatagtagttcgcgcgagggactatcttttctatcgcttgcttttcactctcaagacaacggtcggtctctctatgctataaagcgaagcaaagcgcatggcgctgaaagttaagaaagctcaaaaacacacacgaacacaatgcaaggcatagcataaatgagaccgctgatcattttgcttgacctttttctatgctttttttgggtgactcaccaaccgaccgagcagtgatcgatgacaaaatggtacgaacaaatcatagtcgttgaccattataccgtgctatggcacactactagatagattgtatggctccgttggtgactttctgatcacgggtttcatttgaaaaactccaacgccattcatcttgcgtccggtctttcatgcaagagttttatttttggccgctactacgttcgtcgaaaacttcttgatggcaccatcatctcattaccttatttttgcccttcgacttcggctatgaccaatgccccacctagctgaataggcgtaacaaagctacctgaaaaaggcaaggtgcaccttagattgaaatcgacaaattgcgttttgccagatggattctttagaaagattcccggataaagttcagtaaaatatttagttagaatctaaataaaggtgcatacgtgggcgggcagggggccccactacttcttcattcaggggggctagcctcatgacttcccactgggcgaggggtgcgcctaacccacctactcattcatcaattacggtgttcagctgacttgcacagaaagacccctattgtttagtaatttggcgccccatcttttttttgattgactgttgtcaactaatcttttcaatgttcgattctactctatgttagaacatttctgtgaatgctatttcgatctaagtggtcctattctctgtcccgtgctaggaagcattactcttcttttcattccaaattcttctataagactgatacgattgattggtctgtgcatttctcttattacttttttgtatccccttgttcctcggatacaattcgatccttctacggccaaatctcaatttgtggaaagccttcgatggcttccttatgaaaacatccatttgtatatgggtatagacggtctttcattattcttagtgatattgaccacatttctgatccctaattgcatttcagtgggttggtctggtatgagaagttttaggaaagagtatattacagcatttctaattcgtgaatttctaatgatcgtcgtgtcctacatgttggatcctctactattctatgttctttccgaaagtgtgccaatccctatgttgtgcggagctgagcatcttctattcgctgggatcaagcttttcctctgcaggggccttttgcagtaaaccccctacgggcggtcccctgtcgtcgtaaagtagtaaaggtccccgcgaagctttcgggaagaggggtagtcttgtgtgtaagcatagcatttctagtcgaaccaccgaaccacacatctttttttggtgggagggtactccgagtagtgggtacctcgtaggacctcgacccgcctactcaggtcttgtatggatatgcaggaaggggtgctcctaggtgtgtgtagggggtgtgtttgttcacgagaaaggattcctcgtcaagtcagggggagggggggtgtggacacacttgcgcgaattcgggtaacggctacaagggataaaaataaaggaaactgtacccgaccagggatggacgtaaactcgtaagctaccaagggtagggataatcatctaggtcttattgtttaaaaaaaagccgccccgccacagcaggcaggttagttcctctgtcgttgccagagagttcttggcgaagagaccttaggataagttgctaaaacaaacgggggaggggggggatcgacccgttcagtagaattccgaagaaagactgttggcagcaggtggagacatttctttggcccccttccaaataaatgcgggcagggtagagctcggcggagggttcgagaatagggtagggtcctgtcctaataaagaaaatcaagataaataaaggggcgggtccctttatgcatgcatctttgtacaagtggaggccggaaagatcaaaccaatagaaccgctcacatcacagtagtcgtagttgcgtaaaggccgtcagtcagggggcgaccataacataaggcaatgactttcacagatctctctatcgttagatataacgaacgggcgggtttgaaaggtagggtttttgacggccctaccactagtcctgctagccttctttcgggcaggaagcagaccgggcccgacgagcgggcatctcccgctatgcaagcagcatggttcgccaccactcgagaagcaaaagattcgagagtcaaggcggaaaagacaagcatagtggtctaatgacaagggccgacgacggaagtctaacgtacagttccctgagaagggagtggctacccactggagctttgaccaaccaccaccggtcaattccgctttggggccacccttgactctaccatcattataggggtatggggttcgagacaaagaaagatcaaggcagcatatcagtttttcctatatactttactgggatctgtttttatgctattagctattctgttgattcttctccaaacaggaaccaccgatttacaaattttattaaccacagaatttagtgagcggcgccaaatccttctatggattgcttttttcgcctcttttgccgtcaaagtgcctatggtaccagttcatatttggttacccgaatcccatgtagaggcacctacggctggatccgtcatcttggcaggaattcttttaaaattgggaacctacgggtttttaagattttcaatacccatgtttcccgaagcgacactttgtttcactcctttcatttatactctaagcgcgattgctataatatatacttccttgaccactttaagacagatcgatcttaagaagatcattgcctactcctcagtagcccatatgaatttggtgactattggtatgtttagtcgggcagcggccgttaggtcacctattttgagttatggacacacaagcaaggccaaaacatgtgtgccgggcgtgcgacccatcaacctactagcaataggggggaaaacttagcatgtcgcaacaaaagcatcgattcgaggcgtcagcaaaacaccgccgtctgttcctaaaacaaaaccccttagcgccccggggcgggagtgggggacggccctatgcagacagcaacagcaccggctctacgaagtccgaattgaatcttttggttcccttgaataagaattgttgggcgcggcgaagcgagcgcttctagctgtttcgcttgcttctttcttattgtggcggctattatagcgtggctgaaatgaccgaaaagcgagatgaacctttcaaatcaattgatatagatggcctgatctgttctggtagatcgaaagggtatctatcaataataagggttgacctctttctatctattgatgatacaagatatctatctattctggatccatcagaaagaaatcgatatgtatctgatggagtctacatcgtatgtagagcgcccaagcgcttttttggccagctcaattctattatccatcggtccaatgcactggcgcatctcatgggggggggaagcaaatgtagttagttgtcttgttgttgttcgccgcctcgacacattccccggcatcgtcccacacagaaagaaagagcgtggagccccagcccgacctgtaagtccgctaacgtaaagtgaggagttgagcctgaactggcgaaccgaagtcactttcgtaaccatacttcctacagctaacacgtgttcggtccagcgggaacgcgcagcgcaaacgaacatgagctgctttaccgaatatcccccgctggccatcggggacctagtggtaaggccatgatccgcagtgcaggggaagggatcactcattcttctattggggacaggtgcacgaacgacaactccaaatgtcagacatccgtcacctatacctaccgtttaggtggcaccagcgagatccagctaaggtaaggaacttcgtgtcgcggctgctccactccgctgcggtcttttgaacagaacttcgttgccttcccgcgcgcgaaacgaatgggcgcagtgtcgtgggtcagttttggggcggggggcagagagagaccagaagaatgattcatttggatcaacgagccattcgcgattcagtagaatgtctctctatccatatctattctatctttatatgacgggccataaaaaaaagaagtatttttttatggcatgtgagatgatcgcgcctagtagccacatatcagctgcgctcaatttgcgggatttccgttggatctgatctttcgctttgacgaattcggacctagcgaatggaccgtagaacggaaagcgccttctaaacaactcggtagaagggaaggggcctatgtatttgcatgacccctgcggatttgaccctacctacacccggagccaatcccctagcggtcctgccaccacgccgcagaacaggagctcgtgtggaaccttggatttctggcgtaacagcggtggaagttataaaaatattacggccacataacataggggcctacgctaaggtcggccaaaatatggacacccgaagggcctggcacgcacaatcctatcctatccgagcccgtcattgcatgcacttcggacagccgtctgtagcatcataaagagcacctccctttcgaggtacccaaatggaacgggctttatttgtgttgttggttggtctttctcaacgtggtctatagcacgaaaaaccattctttacaagatagggccgttcacatgaaagataagaaaaaaatccattcttcatggtcgggcgcatttctccaaatcctccaggatcacaagtggaacgctaagcaagggtggggaggctgcgagctccatgtcgaacagaaagaagcaagcagggggtgttgccatagcgtgtcggggagcaagcgtaggcaaccaaactaaataaggctaaaaaacaagtagctagcgtttttaagctggctgccttttctagcgcgcgtactcttctgtggagtcgcacggaacgagccttgtcttccctccaacgactagctcccttttcttgttccggtcacccttctcttgccgtggaaggacttttgcctgtggtgtggtccaacccgtgggcggagtcgccctcatccccccattgctcagtgctccctgcagcttcgctgggctttacccgcgtggacgcgggcttctataagagaatgaaaagctctctctttacaataaaatgcgaaccgcgcggagcccacccttttttgttttctgccgccactgggtggccgctggggaaacacagcccggccgcctgtcgggaaaggggggtggggggatgggcctacctatcctgagggagcatgttgagaggttccatatgccgagccaaagggcagaacttcagtgcgtgatcgtagtatgtcacctcgtctcgtcctcgcagcatcgaagagtacttatgcactatgttccgattcactgataaggaagatagagttggggtggaggtctacaatgtgatactatagtatagtatgccccggggggaaagatgcgcaactcaaaacggaagcaggaagcgtgttgtaaaaaatgtcggaggttaccagatctctgagactaccatcgatccgatagagcggatcgaccagaaaagaagtggagttagaaagccgtatgataggtggtaactatcttgtacggttcggagggtaagcggcgtactctgggggaatattaggctctatcgaacatacagggaattgggggtagcattttacttatgttaagtcatggactggtttcttcagccctttttctatgtgttggtgttctatatgaccgacataagactcgacttgttagatattatggaggtttagtgagcaccatgccgaatttctctaccattttcttctttttcactttagccaatatgagtttacccggcactagcagctttattggggaatttctaatcttagtaggagctttccaaagaaatagcttagtagccacattagcagcgcttgggatgattttaggtgcggcgtattccctttggctatataatcgtgtggtttctggaaatttaaaacctgatttcctctataaattctccgatctaaatggcagagaagtttccatatttctaccttttcttgttggaggggcgaccgtccgttgaactaccaaaaaagggtcaaccaatgtgatcatgacattgtaggtgcttgcgatgggacggatgcaacttccctcataagtaatgggtggcatagcccgtagcagaagtcccctttttttatccattttttattaccacagaggggcccgccctggtgggaccgagagaaagaaaggacgggggaggggggggcgaccatacatggcaattctcgaccgtgtctccgagggacagttgaacgagcgactcatgaatgcgtccgggtcggacgagccaataactcgaacgtgttcggtcagttttttgagcaagaatcacagcgttaccttaccttcaccatgatacggactccaagttcttatggaagagcacgaggagtttccttcaatatgatgatgagaatggaaaccagaagcacgactgggtcttcgtagtctgggatcaaacttatatatcagtcacagtaacgtaagcatgagactttttggtagtaccggtgaaccagatggccgcggcaagggaatctgggatggaggactcgtaatatctctatagatctggcaaaagcgaaagacccctaacgtcaggggctgaccactgagctcactcaggcctcgctgggcgggccagagtgggtgcgaactggaattgccatagcttatggttagagcaat

SEQ ID NO: 79520 - DNA, 2605 bp, Oryza sativa
acactctcaacggatcctccatgcgctgtgttgggcataccatagttcttccgtgcgtctttatcgtggcggaaacagaacaagagggaaagacccggctgactcgcccagggctcgagggcgagccattcgagagtgagtcgaattctgtttacgttctcggtttggtttgggcccctctcgatcttttgcgtataagggaggggggaaggagtctaaatctatggacattaatgaaccaccattgatggacgttgcacatgacacgatcaattcgacttgacggtccggtgctaatagaagtcgcttactctccgtctagcgaaggtgccaggggcagggcttttttgtagtaatagtgggtgggtctcatgggatttcatctatgccggccgtcagaatcaaacgagggtcgaaggaccattcgattcattaagggggacggcccatttgtaaggcgggggccctgatggacgacatcccccggcctcgattcttttgcatagtctgggggccggccgcagcagagctgcagggcatagcggcaccctcgcctggcgccattctcggacctagcagcagatgggcgggccgggcctgaatgaagagcggaccacgcactcagaccggaagatcccagttgtcctggactagacaagtacgtagagatcttcgtggaaccgaggagggagtctcaatcgatcttttctaggattcaaactcacgccacgcacgaagatttttctattgatagagttaagggctcggctcccctgactctaaaaggttaggttactaccaacttgcctctacggaagaggtgtactttgtattgtctgggggttatattatgggacggagtacaagttgaagaaaaaaaatattaagtacatattagttatagctaagaaacggtgatattgtttttcatatataacccttaaattgatacccgagatcttctatagctgctgtagtagatatatccatttttgcagtaaattaattattaaaaaaatagggcacaatatagcacgagtagtgcacgagacaacaaagaaattattgatgaggtagctagctttaagctgttgtgggaggtcatcgcctcaccaactgcatgctaaatatatcgatagatatattatgctttgttatattctgtcttgcctaaccggccgcatctcccccttcctccactcactttaagcatcgatcactgcttggtactactacgtcgcttaatcacttcttgattcctttgctaacctactactccactacttggcctgccacagtttgatagctagcttagctagctagcgatcgatcgacgtcgtcgttgatccatcgccaccggcgccggcggcgatgtgcctcccgttcctctgcggcggtgacgaccccgtgaaaaatagcgaggtacggccgccggcgaggcacccgagagaaggtccaaacgacggcgacggcggccacaagccatcaccacctccgcatgccggcggcgccgtcaacggcaacgggggagctgctccgcctgctccggcgacgtcgccggacaccgaggtccgggcgcccacctatggcgataaacagatcagtcctccgaaggaaggcgcagctgggaagccgcctatggtggtcccggcggcaaatcatccgcaagctcccaccggcgaggaggctaagaaggctcacggcggcggcggcgccgtcggtcgccgcaatggaatttcgtccacggtactcacggcgccgccgccagtgggacccatggctgctccagcgacgacagtgaaggatgctcctcctgctgctgctgctgctgccgccaacgacgtccatggcgatgctgatgagcaacaccctggctatggtgatcacggcgaggtcgacgaccgcaagcctcgacgcagatcatggttgtgaggtgagcaatggcacgcaactacatattggctgtgctgtgaattgtgatcctcgttctttatgcatatgccgctctcggcgctgctggctggtgatcaacgatgcatatatacatatgtgctatatatatttttacaggtttgcaaaaaataaagagacattagttgctaattgttgttcttgtgccctaactagtttgggtgtaatattgtgttaattgttgtattttagtatgtgcacttgtatgggtgttgatgaatcatggacatatatcagtattgcatgatctcgattataatgcagagcaaaatctgcaaatttgttctttttgttttatggaaggatgtaaattaatcttgtcaacttccatctgtttttgtattagttatctgtgtttagtttcatctccatcatatcattgacgacgatttaatcgaactagctaagcttgctaggcagtagaatcatggtctcatggataactggtggagaaaccatctttggtcggtcgaccagattttacaatagttccggttgtattaaaaaccggaactaaaaatatctttagtcccggtttaaaagctatagggtactttttcaatctttagtaccggttggtgttaccaaccgggactaaagatctatttgtagtcccggttgataacaccaaccg

SEQ ID NO: 79521 - DNA, 7835 bp, Oryza sativa
tccttcgccttcttctccgcgcccttcccgcgctccccggccggcgtcggagcattagctggtggcggcgcggcggcgacctcgtcgggcttctgcttcgccgcggcggcgaccggcggcgacggccacaccgtggcgtgcttccctgacttgtgcagccgcctgacgagcacgtcggcgccgacgctgctcgtcaccgtcaccttgtgctgcgccgcgtcgattgtcaccttgtacacgcctgcgcatcaccggaaaaccaatcaatcaccaagaaatcgatcaaatctcaatcaaacctgcgaaaactacacataccttcgatgttctggagcaccttcttgaccttcttcttgcaaccctcgcagtggatcgacactcggagcacggtggtctgcaccaacaagaacagcaagacgtcagcaaaacaacaacaatggcgtcgtcgtcgtcttcgcaaagatcgagcattagagctaagctctagcctccaatggaggcattgatttcattcagatcaaggctcaccgtgtactgcagtggctctgcttctcctgacgccatggatgaaggcttagctagctagctacctcgagacggagtagcttcgagctaagctgagctctgtggcggcggcgcgtgcgagtgagaagggaagctaagccaggagggggtgtgttgcttagggaagctgagctttataatggccaacaagtgtagcactgtactagttgagggtgctatttgcaaagtgccagcgtgtcactgacctgtgggcccaggtctactggtaccctgtacacgtcaatccttgaaggacccaggatggtgacatcagaaccacataaatatatttgtacgcaatgatcatatccatgatgatggcagattgaagcttagtgctccctgatgatcagttctggctagtactagctttttttcctgattatcctggcctaaatgttttaggtgaagattatcatgtgatctttgataaggatctccattaatctgtgcaagtgtgtgcatgcaattctggcgatcgatctcttttgttttagtggtgcaatcaagacctcgtaattcaggggtttggtgaatgagtcagacagggccattacattcagcaacaacttaacagcagcagcattcaaaacaaaagggtgtctctcattatggagcaccacatgcacgtacgttgttttcagagcaggtaactatagctcctctagtggtgtcattttcacttgtgctgcagctgtagtacccgctaattacagagtatagttaagagtaattaagttgcttattattgtagcagcctcatctgatgaaatgtccattctgcgactgactccccgggtagaaaactagaattcagatattcaggttaatttcagagaacaaaatgtgacagatatgagtagtattcagataaaatgtccagaaccgatgatggttgcatgtttgcagtagtttcttcagacattatatattcaggtttcggaacactcgaaaactactgtaccccagtacatacgtactgggcgttactatacgattggcctacagttacttccacgtgacgtacgtacattatactacttaaatacgccgtagggtcgaccagaagatacgtatcagaattcagaatatcagtggtcgcatattagtactgtggttatagctgggtcaggacgtacaagtacagtatgtgtgtacgcaccaacgacgtatatacagttagctagacaggtgaaatgtactgcactgctgctgtcagacacgtctcccgttggagatacaattcattcatggcatatcaacagagcatccgtggcatgttcgtgcatgtgagtacatattagtatgcattcaagcaaaaaactctcggttcggtctttcggtgtttgagaaaattttgtcatctaatcgaacaattcgatcggttttgattagctctgtccggtcctgaaatactactatgcgacggtttcaagagacaaaaaatcaaataaattatagagcaagattttctcagccctttctagctcttttagctaggattctttgacaattgtagcacaagataacgaccaacgacgtataacataccaattcatcaagatagctagcatcaatcatagcagtgatctatcttccaacttaaccaagatagtagctacttgggcttctttcctaatttcggctaaattctatcatttcggtcaatcgagaatgataaccaacttaatttacctaattaattttagtaagtgaaaaaggcctgatcgaatttcggagtgaaaaaatggtctcggttattttttggctactgtaactaacgaggctaaagattattcatgcgacgtcgccgaaggcgcgaaatggaaaaaggataatgtactgcactacgtatttactgaatactgcgaccacgagtgtaatactgcaagctccttcactatctgcacggcgaaaattggtatagcagtatcagtgtagtaactgctgtacgtgctcgatccgggaccttcctaccatcaattgttggcaatgccaatcgttggcatttctcttgtcattcagtttggaaccaaaatgtattgtctgtactgctgcatacatctccattgaactactcctatataaggttcattacttaagtgcgtaaacggtagtttgagcaagtaaatgttggaggttgggtttaagttgatggagcaaagtgcagcaataaatctggagacctagctaccaacctccctgcagggttagtaaattgtgctcggccaaggctgtcaatctaacagcagggtaaggtacaattctccaatctccatcaaaggcgatggcccaccagatatgtttatgacaggtagagtcagatgcgagtactgcttttttctagtaataaaaataaagttaggacacgtaaaataaaagatttgttagcgtataaatttagaaaatggatttatttttatatttagcgtataaatttagaaaatggatttatttttatattttaaaacaacttttatatataaagtttttacacgaaacacactatttaacggtttaaaaaacgtgctaacaggaattgagataaaataagtatcttaatctgaaaataacatcatctagtactatatagccttgtttagagatataaggatttcgagaagtagttggttgatagcttttgataatctaaaataaaactaggttttagtttttcatcttctttatagtttattttgtaaatataatatgtgaagtcctgaaaattatgaaagaagttgtagctagaaactctgtaaacaaaagttggataaacttttggatactcgtggcacgtttttcaaactattaaactgtgtgttgcgtgcgaaaactttctatgtgaaagttgttctaaaatatcagattaatccattttcaagtttgtaataattaaaactcaattaatcacacgttattatcatctcgttttacgcgaaacacttaatctttatctttatcttcaggagattcaaacaccacctatagatttagtgtaatcaaggatgtgccgttggcttctgtatctttagagacatgtatcaagggacgtattgacgagagtgtaaatgtagtattgcgtgtgtaatggtgtgtgcattgtcatgtaataaaaaaaagaactccgcaaacaaggactaggccaagtttgaaactaagtttcaactagagttgttggcggctcgaaaaagaagttctagatgattaattaaatattagctattataattttttaaaataattttatttccttaatataaatattatatatatatgtatgtatatataattttttatacaaaacataatgtttaataatttaggaagggtgtaaacgaaaacgataaaattgtcattttaaattgtacttagaactcagcctctacttcactccgaagaagacccttgaagagagacaattggtctgtttgggagcttataactgctgtagcttcttccagaatcagaagctcctctaaacagtctagcttttaatatgaattatgagaagctatagttatagaatctagaaaataaactaaaaatcaaatgctgaaaaacctagctttttcagatggttttcagtcagatgctttttagaatgttaaattcgctaaacaagctcaatgaaagagctctgctcctaaaataaacatctctgtcagggttgtaattattccttgtccaaagaaaaagctgctggccgcgtccttgccgccgtataaacatattattacctcgccggcgtgggccccacccgccgtacgcccggctacatgtaccgccatgtggcccgcgcgcgggggagagacatagatgctctcgcgccgtaatttaacaccaccatggcattggggcgccatggatgttctccctctcgcggtgcagtccagctcgaggtgcagtttttgagcagttcgaggtacggacaggcacatggctcgcgtgtttattcgactcccggagtctttcacacaatgcttaatcaagcttagtattatagagcggtgtttgattagtttcctcgttaattgctcggtttttcttcctttttgttgttgttgttgttgttgtttaccttgcccgatgctagctgcaagcctgaaatagtgcgcattgttgcctagctcttatcttgtctactttgatcggctggaaaacctgacgttttagctgtaaacagttgggttttcgcaaatttaagctctctcctgtgtcctgcctaaaatatcatctgtcatgacgcagttatggttagatcatgctcgctgagcaagcagcaaccacatcatccactggccacttttgtgtttctgtcctgaatatactgatgttgcactcctaaatttgagtgtgtttgagataaggacaaagagtaaattacgaagatatgcaaaacgggattcgtcattagtgtaattaattattttaaactttaacatagtttgtttatggtttcttttaaaaaagaatattgtttagcggttttgcaagcgagcgagaaaagaacgcagatatatctaatgcttcactctcttgaagatgaagatggaacgaaaagcagcaacagtatagtatggtgaagatggaaaaacgaaaagcagttcgggattcactcattcaggggactgttcacagaccgtaatgggatcaaatcgatggatctgatgttccaaggacgacgaatatgcaattgcaagaaagggcaaaagttgcatcgccaggccacaccccgatgatcgatggcctgatcagatactcctccatatccttctttttcttctttcccttcttttctccatatcctcttcttgtgtgtgcatatactgtgtaagagtaatcagggtcaggttcataaaaccgatgaaattttgtgaaaccggccagtattagccagttaatatatggtgttgatcaaatttgtcggtttttattggttttcggtcggattttaataaaccggttagagcaattttttacttcgaaatcgaaaaaggtaaatcgtgatttattcagggtttatcaaaccgttttgggtggggttatcttaaatttaaatttttaaccttaaatttgaagccgattttaaggttttttttatcgaagttaatttttttagcctttgtttttagatcgctaataacacgtatataaaagtttatttacaaattatttttcatttacaaatataccgtttgatttattttacatacaagccaaatgatagggctaataaacgcgtggttttgttaaccctggcagtgatagaaaaacattgatcatcaggcagcctacccggctctatgtctatggagtagtagctgccgcggtaagtgtgctgagctttctccatcaaaagcagtgtctccgattataaattctgcctgcagaaaggcagctggccggcgccacaaccgtcctgcttgcttggcttggctccaagtttgttaacccccacacacagttgagtgacacaggtgtttcccttgcatgatcacacagtaacagtatcactactccaccgacgccgcaatccgccgttgtaatgcagacagaataccctcgccgccgcctagcatgcggccgccacactgtgctggtattaagctttcttaaaacgtttggaggaatgttattattggttaagaatgacaggtaaaaaaaatacttttactttgaaacaaattattatgtcggagttgactatgggctggattggtttgaggcctaaattagacttaccaatatttgataattttaatagtgtttagtgtctatttggtttgaagacaaattttgacatacctaagaaaataagaaaatatacaatttcaatagtgaacttaggctattttggcttcaatacaaacacaactttaccttacaaaaattagtcataccaaaacttgccaaaaaatggcattgacaaaatttagtaaggcctatttaagctacaaaccaaactaaccttatattttagaatggagataactaacactactacttctatagtatatcacatgtatagtaccaacacaaagctatcatctgttttaatttgcaaactttaatatatttatcgtcacttcctcgaattccaatatatctatacttttctatatagttggtactcactaacaattattagaagctaaagctcaacatacaagtatgccacatcatcacccactagcaattactattctagcctatttaaaatcccatacaagcataccacatcttcactcgctagcaataattactgttctagcctattttaaatcccatgcaaacatgacacatcatcaacaagcatgtgccaaatcattttcttcacattattttcttaacatttcaactctcagcatttcgacaatatttaacatatacccatccataaatcccgcagcaaagcgcggggtatcacctagttactacttcctccgttttacaatgtaagactttctagcattgtcatatagatgttaatgaatctaggcatatatatttttttagattcattaacttctaaatgaatatgaataatgttagaaagtgttagaatctgaatcggatggagtactaattgtgatggagtctttataggataagtgaaattatgccaaaaacaaataaagtttttattttttttggacgtaacgtaagtatagtactattacaagtcggtgtgttaagcgaataagcaaaatcggtatgtattgtgtgcacgtgtgtgtctgtggagcacgcatctagtcatgtagagggttcccgatatgggcaggcacgagggcgagcacgtacacgtactcctcctcctactacgtgatgagtagagccgagtagtgcgacgtggtcgtgtacaggcagaggcagcactgtgcacacatgcgtgtgttgttgttgttgctgctgcgttggtgtctcgtcgacgcgacagggccggacggcccgtggcccgtatgggcaagatacgagtacgtactacgccccccggcgccatgggccacaaccgcgtcgtaacctgtctcgccttttcggttcccaagccgctcgtgaacttctctcgactcaaccaccatgccccatgtcattcccttcgtcgttccgtctgccacgtacaccttccatctaaaaaagaactcaaccaactcaacagatcgattttttttttgacagaggaagtacgtgatgaatgaatatatggacggaggctatttaatatggtaattagctaatgctgtaaaaatcatataagctgatcaatttgg

SEQ ID NO: 79522 - DNA, 3007 bp, Oryza sativa
gatcttctaagtggttcattttcgatcactgacggttgagaaggttcttctataatttcttcattttgtgcctcagaagtctgttgagtgtcattatttaattcattattattttcaacagaatcggtatcaccagaattttcatctggtgttaccacggtatgagtcacgggtacacaacatgaggtaccaaatttattggaatattattttcttggatttccggtgtaacattagcccgaatttcctcaagattaatttcccttttctgtgagctcccccagaattcattattttctaagaatacggcgtgtctagattccacaaatttagtgacacggtccgggcaataaaatcggtaccccttagatgtctcggggtatccgataaaatggtagcttacagtcttaggatctaatttctttagttgtggattaaatattcttgcctcagcacgacagccccacacacgcaaataatttaatgtcggttttcttccggtccataattcataaggtgttttgggtaccgacttacttggaactcgattgagtatgtgtgcagctgttttaagtgcctctatctataaattcacagacaaaatagaatgactaagcatactccgtaccatgtccataagtgtacggttgcgacgctcagccactccattttgttgtggttctctaggcatggaatattgggcaattattccatgtatctgaagatattgggcaaatggaccaggactttgcccataaggagtaggtctcccataatattctcctcctcgatctgatctcactactttaatttttgcattatgttgattttcaacctcagctttgaatattttaaacttatcgagtgattcagatctatctttaatggggaaaacatatccataacgggagaaatcatctgtgaaggtaatgaacgagtcatatccatcaatagatgttactgggaacggtccacatatatccgtgtggattatttctaatggacacgtgctcctagtagctcctttcttaattttcttagtgaattttcccttaatacaatctaaacaatgatccgcattcgaaaaatctaagggttgaagtatctcttccttaatgagacgctccattctccccttagaaatgtggcctaaacgacagtgccacaatttcgaagacgtctcattatcattacaggcattcaatatattcataatatgatcatccaaagagagcaaatagagcttgtcttgcacgctagcaagaccaatatcaatattattatacttaataaagcatttgtccttagaaaaattacaatcataatgtcacgcccggaaattcactaataatttccgaactaatttgtgcatgaaatcctcgtccaggaatcagccgaggtacacaaactgacaatttaatatacaaatccatcataataataacgttacatacttacaaaagaaaagaaaaacagcagcggaattaacggtctagcgctggcttcagctccactcccataggcagctcaactagggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgaacagatctaactccaaaccaggagctaagcaaattattaccagttattacatccataattattgtgaaaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcgatcttcaattaaccttcttgatcacttccgacgcactcacgaaccttcgcaacgacggaaacgacaagctaacacgcaaaacgaagaaaaagactaataaaaaccaaataaacagtacataaaaagtaaacaaacatgtagatcataattttagatgaattatgagacttgaacggcctcattccgacttcaaatgaatttattatgaattttacaagattaaatctaattaaagtccatttaaaaagacttaaataaatttaattcaatttatggacaatttt

SEQ ID NO: 79523 - DNA, 4617 bp, Oryza sativa
  unsure (1)..(4617): unsure at all n locations
caacttttattggagaaaaaaaaccataccttatatagggttggtatcaggttccatgaccatcaaattgatatcgtattcgccgtgtgtctgtccactacataaacagtatattcataaactaggttgtgtttagatccaaagtttggatccaaacttcagttcttttccatcacatcaacctgtcatatacacacaacttttcagtcacatcatctccaattttaaccaaaatctaaactttgcgctgaactaagccaatgtaagttcatcaaactctatccctgttcgtcatcagaatatttctcctggtggtgggcccatccggccgggagctaagctaacttgaccgggacatcactgcgagagtgaaaagatagatgctgcgttttattccagccttctcttagcgatagtggttccggacaaacatgcacgtaatacctctattcagattctttttctttttcttttttttaaaaagagctccttgttctatgttgacagatggatacaacgacgacaaacgggatactatattgagcgtttgatgagaacatgcagttacagtcgtacacatcagatcatgctagcttgcattattagggcatgttcaatgatagagacgggtatgacctcttaaacaatacaagattatttagagaccatgtctttacaatagttgagacgacaaaagctctaatcattaactcaaaaaatattccttttgttaatattcttttcatatttttatcctcatgcaatcatatttctatattatagtgactaaaagtcgttgttaagctgttgtcatgcataacaatccccgatgttttgtctctcctctttctctttccttcatgtcaacaagtattcctaattagcaacgctaagagaccactattaacaaccattgtacatgtccttacaagctgatcatttacatcaatcacagatacagattcctcctcctcttctactttgttttttaaggttccttgttactatacgttgacaggtactccatctgtccccaaaaatagcaattctgatacccgaggcaattttagctaccactattaaagacccaaatacccttgtataagtacaacatctattccatcattcaaataaaaaaacaaacttccgtgcacaagtactactctcgtacagagtgcatgtgtgaatgagagagggagtagacgagagaaacgagagagaatagagaagtttgcgtgaacaagtggatagactactatcctggttgctcagctgtgactgtactgctatctcattcaatgcatcactaatcgcttttttctgggacaaatgcttctctccagaaatcgattctttctaggaagaaaggagtacgatacaacaacattgtatatcggaaaagttagttggcgcgcgccctgcgaacacgcgtttttagggagtaataagcgtaactaataattgtattagttatagatagtgacaataattaaggtaagtcttcccttttctccggttgttttttttaactaatagattgaaaagaaatctatactaaaagaaactttcacgtaaaatttaaaactttctaactttcaacgcaaactgaaactattcttaaaattttcaacttgaaatttgaactttcaaggttttgacctaagatttaaactttgaagtcaaaatttaaaaactttcaactcgagatttgaaactttcaactcaagatttgaaattttcaactcaatatattttgaaaacacgtgtgctaacgatttttttaaaaaggaaaaaaacataaaaatatgcgataaaatacgaaaaaatgcatgcgccgccagctagcgtgtgcaccagttacggaactggcgtgcacgcgccaactagcaacccccattgtatatttttacacatacgggatatatatctctactattataaacattcaagatgtttttactagcactttggtacgtcattcgtgaatgagtcggtttttatgttcattcgcttttggaaataaagatccgtatttgagtcgagttttaagtttgttcgtttttagaaataaagatccgtatttgagtcgggttttaagtttgttcgcttttgaaaatacatatgaaatcatataagaaatctctttaaaaaacctgcatgtatttgagtcatgctttaagttcgttcgcttttaaacatacagaaggagccgtataaaaaatctatttaaaaaaactcgcatgctgatttgagatgattggactcctatcatgattttctaggaaaatatatattcaagcgaattctcatagtgaattttactttaactaaaccatataataataataacattaaaataagcttcacccattgtaacttacggatattttttttctagtatagatatatattgaacatttgattttacaatcatatacatatatatcaatcacacagtgcacattacacacttatatacattacattaccagtgatcgtacatgcatgcattacgccatctgcatgattatgtatgtatgcagagattaaaccaaaccaaaccaaaccacaccacaccaaattaagcaaagcaatatatatatatatatatatatatatatatatatatatatatatatatatatatatatatatatatatatatatatatatatatatatatatatatatatatatatatatatatatatatatatatatatatatatatatatatatatatatatatatatatggtttntgcantcatatgtaatcagtgataantctaggtgtgcaggtcgacgaccttgaagtggtcgcggttcttgacgacgacgtcgtacatgtgggtggagcgnaagctggagaagtcgcgggggatggagatgaggtcggcgctgccgtcgcgcctgtgnagctgcagggtggcgcggtcctcgtagtagcgctcccaccccagcgcccccagcctccgctccagcgcctccgtcgaccggatcacctcgctcgtcgccacatgcaccagcgccttcctgctcgtcgcctgctcctccagctccatcaccccgttgttcctgaacacccacacccctcctcccgccattatttctatctacctatctatcctcttcgatcgatctgctcgttgctgatatgatgctgctacctgcgtctgcatatcaccgtatatataggcagctagctatagctggatgcagtactgtacatactgccagtgtgtggtagtacacctggcttggctaagagatactgtatgtagagtggtgttgagatcagatgcgacgatggaatcgattaccacgtagtacagcgcgcgacgacgtcgactgatggggttttacccgtgaatgaatctattcttctccttctaattaacaccatggtggcgtatttggttaatgagaaatgcaaaaatcttcaggaaccaatcaccagacatcccgcagactataactgctataatggaagacattagagatcgggattttgttttcaaaccgcgctaatttattactagctctacttttctacctatcttttcttcccaagatgtattaatctttctaagaactatgctgtaagactttattctacctcctaatataatcggcaattctcttgccgctttttcttcaaaaaaaaaatgaatctattcttctcatccttctatatcgaccggtttcactttcatgccaaccatgataattgtgctttcttcacatgcatgacaacaatttctacggggacatttcaacagcgtgtacctcgtggtaatatatataggttccctaggatttttgtggcaacatgtattcatcttttctttttaaacaaagtgaagattcggcctctacatcaactaaggatgcatggcaatttttttacagcacctgaattaaaatatttaagaagagaaatgagatatgaaaaacatcatgctgctatatatatgtataacggctaatataggagaataaaacttgtcgatttacagaccaagaatagataagaggatatatataaatcaacttatttttggataatttttgtaaactgtaagaatcaacttgttttgaaacaaagtttgaattcttagaatcagcttagtctattttttttgaacgaatcgacgagcgccaatttcattgaatagagaaggagaactttacaaagcgaaaggaaaaaagaaaggagctaggacctttggtccgagctaactaaaagaaagcagctattaagacttctcgctcctgctaaggcccaagttttggcctcttccttgatcttggctaaaagggaggtagctgaaagctccttctgttggaaggttctgcgattcctttcgttccatatctccaaggcgaccaacaacatcaaagtgcggagtgccttcttaggtgtctcttgtatgtttgcggtagcctcccaccaatctagcaccgttgaagtttgcctccattggctaggatttagttgctcgcacgtcgcccactccgctagtgccgcccagactctccttgtgtatctacatgctgcgaggaggtgcagagttgtttcctgggtccgacgacataaggggcaaatggaaccgtt

SEQ ID NO: 79524 - DNA, 8610 bp, Oryza sativa
  unsure (1)..(8610): unsure at all n locations
gagctagggaccttggccgggtgattggaggacacctacgcgtagaggacgacgaggcgaacccaacggtactcaccacaacgacaaacgacgaacgatgatggccggcgacgaagaggacggcggcggcggctcggcttgacggcgacggcggagctccggtggtcggcggcgaagggggacgggcggccgaggttctcctcaccacggcgcacctaacggcggcggcggcaagcggcggcgacgacgcaagcgacggcgcggcgtggctgaagacggccggcggcggcggcgaactaagtgcgcgcggcggcgactctacggagcacgggagaccacgggagatggggcaaacgaaagaggggaactagggggtcctatttatagccttggattgaagagatcggactcctcccgcaagaaatcgatccgagaaaatcaaaactcggttttggagataaactcgaaaacgagtttgattcgggcaagatactcaaccatttgctccgattattgaggggaaagatagaggaggacgagaggataaaatcccctcaaaaacccggaagaaaaagagccggattggagcggatttgagggagaaaaggggcggctcgggcgacggcttgggctcggccggccggctgctagaggaagaagaagggcctgacatgtgggccccacatgtcggtgcctagagggaaagggtttttgaactttttcaattaaaaaataattcgtgaaatgatgtttcatttattaaaaatacttcccttgctcaaacaattcccagaaaattctagaaaatagaggaacaagcaaagtatttaataaaattttatctaacccaattttatattgagatttagcacattaaaattagatcttctcttttaagcttttaaaatcatttctaataattccttttaaacaacaatttataatttaaggattttaaacaagaaaagcacttaacaattataattagatcattattgatcaaataattactgaactgttctctgtatcatttacatttaggaattgagctccgaaaaatccgagaaaattccagagagtataattaaccatggagaatttaataaaaattaaatccacccatgctttatatttaggaaattttatttcccacatttaacttcacttgtaaattaatgaacatttcatataaattctattaataatttattaaataatttataaatcctaacacgaaaatcagggtgtgacacataaccactgttcgttaaaaccattacagaaataaggttcctcttaacagagggagcataaagaacatcatgaagtaaaagattattgccgcttggaagtcgaagatgaagctccccaacggccatcactttaatttcagctccatcagccactcttaggatccgctccccctttcttagcgtcctcatggaaaggaatccctgtaatgagttagcaacgtgcacagtggcacctgagtcaatccaccatgatttatgagaaaattcaacataaagtaattcatcaacattagagacaatgtcaacattagtacctttcttagcaagccaagcccgaaagccttcacagtccctctgtgcatgaccttctgccttgcaaaacttgcaaaggaacttaccagcagaattttgtcctgctggaacctgagctttgcccttatgggcaccattagaagcctgagtggaaggagtgttgggtttctttttcttgttttgggagttgctggactccccttgatagaactttttcttgccgcctttagcaccatgaaggaggttcagctgatccttatgcttctgtttgtcagccttctgacgatcctcctcctcaacagaatgagaaatgagttcttcaatggaccacttatccctctgattattatagttaatgatgaaagactcaaaatcagaagaaagtgaactcaagataaaatggactagaagatcatcattaattcccatgtccatactcttaagctctccattcatagcacccatctgtataatgtgctttctcacaccatctttataattatagcgcatggacgttaggcgcttaattatagagctagcgtaagacttagaagaactcctgaagttcctattaatattttctaagtatgtcttaacatcatcagaatcctcaataccactaataatgacagttgatatgacactcttgatgtacatgagagaaatcctattggacttctcccattcattagttttctcacgatataacttcagtttctcctcataatcgtgctcaacactaaaaggctcctcaggatggtcctctctaatggcataatcataatcaagtatgcctaagttgagcaacacgtcagccttccacttagcataatttgacccatcaagaggctcaatgagtcggatctgaccaaaagctgaaaaatcatgaaaaaatatccgtaagtacatatatgcaattaatttgcgttggctcaattaattacataattaaacaaaaataaattcccctaattacatcaccgttgggcagaaataattttgggaaacataatcataagtaaatttacgtgaatttataatcaacgttggtcagaaaataaattcatatcatggaatacaaatatctagacaaatttctcgttggttccatttagctagaattaaattaataagcctccataaaaatttcataaattttcagcaattttaagcaatataaatggtactaatgcaatttctgaaaaatacttaaaggtgaattggaaagaaaaaaaatatataatatttgggccggcctggcgcgtgcggcccatgatgcacggctcggcccaacccggagggcgcgctgcggcctgctaatggcggtggcccgatcggaagcgatccgagccattcgcttagatggacggctcggatcgattaatattagtaaaagagaaaaaaataataaaaaaaataaaagtgccggctcaaccctaaccctaaaaaatttccccattcttttcctctctctctctcccgaaaaagcggcggcggcggctggcgatttcgcagtagcggcgagagcgcaaggcggcggcgcttgcgaggcgacggcgcgacggcgcgggaggcggcggcacgcacgagaggtggctgagtgcgcgggaagggcggcggcggcagggcgcagcggcaacggcggtggggcggcgcggcgacgacgcgcggcggagagggccgcggttctcctccgcgcgcagccagggccacggcggcgagcctcgacctcgcgcggcccatgggaggcagggcaggcgtgaggccggtccaggacgacggcgaggacgtcatcgagcgcgcgggcgagctgatgccacgcgcggcgacgacaacatgttcataatgccagtaagtgagtttctaatttggggattttagtgttctaatcttggggaattttgtgattagggtttttgaaaattttggggaaatttggggattgttactatccgccgaaattcacctccttctaatttctacccaagccttaaacgattaaacaatgtaaacatgaactaattagccttgagcagtggtaatgaaactttaacccgagcctaattaatcattaacagaacatgatcatgaggaaattttcatcaaaccgaaagcaagatcatggcattaggcttcaaaatgggatgatgggatctgaaggcttaaacattggctctgataccaaatgtagactcttgccatctactaagacataagtgctaagcctagcatgatcaccctaatgcggaatccttaggttactgaccgttgtttgaagccattgatgttttccttggttttgtcgatgtagaggttgtagtggtagcagtagcagtgtgagcaccagcttgatcccgaaggggtcgccggtgatcacttgcggggtagcggcggccacactgtcccggaaccgccacacgttctccctccagcgctcaacttgatcggatagggttttgggaattttcggggagaagatgatcgtggagagatcgtcacctatccacgacaccggcctcccctattagtatagcgctgagggagatcgggggcaatccaaattattgaagttatggaaattgaatcgcgttaatcccgggtggaaaacggcgtccgagattttggcaacgggtggaaaacgtactgccgtccgagatttcctctcgatttccatgccgagagatatactttcctaacaatactatgggccgattgtctgagatccaatcagctggtgtgaagatggctgagtttgtggaggaggaattaatggtggctggcttgtaatcagctgagtagccaatggctgtgtacttccagaaaattgtgttatcatgaagaattgagccagctgctctgttatcatggtgcttggtcctaaagtcccggatgccgatggttgttttggttgtaatgatcctagtgctgacatgaagtttccttgaggctgaccactcccaatattagtcttgatttctctatacttgggaaaaacaccacttggaaaacagattggtcctcctgtcttttcctcaacaattgatccatcaaccactgacttgatcaaatttgacaatgtattgaccaaaatgccagattggttgattaatgcatgatgcacagctgaatcaacatgatcttggaaagtcaccggatcaaatttaccctccttggcatcatcatcctcttgacttccctcagtcttgacattctttgttctagatccttcttcttcttgccctggtgattggaattttgtcttctaaattgcttttccttgacgggttacagaaaaagtcttgatgtagttttctctcacctgttgcatcacttgttccatctctgccttttgctcatcagttaaattttcaactgtagcagggataacgttttgtcaacaacatcagttattgagtgtgatgacatgattgaacaatgaaacttgtcccactaggcgtgccaaaagcgtgttgatgagaaaacacggtggcctaggagatctgcttagctccagtgaaggtccaaggctagacttgagtgtatcaagggtgtgccagctgatttgatcctgcaatcaacaagaaagacaaaaacaaagttagtcagtcgatagtcgatcgaccgatagcgtatcgttggtggtctcaaccgatggagttagaccaaatcggctatggactggatatatcaaagaatattaaaccccaaatatcatcggctgtaacactgtctatcaagattgatgaagaagcataagacaatattattaaaatagccaatacaacaatatttggagctagaaagataatgtactagctaatactctagtacagatctatataggcaaatcaacctatagtactataccaaatagagctcaatgctgtctatatagatgacaaatatacatgaaatagataaagaaacatgtatattgggtaagatcggctgaaagctcgatgctacccctacgagcaatccagaagcaggctagagatcatgattctaaacacgacttagtaggtcgaatgtactgatgcaacactaagtatgaaaagaaacataatatctagacaatcaagccgtagactgattttcagggtggtagatgtctaagctaatctaatctaacaagacgatttagtcgataccggcggaaaccctaaagcgagaagcagccgatagagctaaatcgatatgctaagactagattaacagagacgtatgatagcaatggtcatgatacaaggactaagatatctaaaacgacataatagccccgatagcataagccatcaagatgggttaccgcttgcgaagcgaactcgtcgaaaagtaaaaacgaaaagggtggcgatgcgccgaagttgtattggattgtgccccgtattacaatgctaggagattcatatttatacctcaaatacagactcagtctattatggacacgactcaaacctttctaaagataaaatacaaacaaaaccatatacggcggtctcttgccaaatctaacacaaactgatgtaactaaagatacaatttccttaatcgagctctctctctaattggcaatgacagttattctaatctaggcccagactgagcccaagtcatactatatcgactgtatcgaccatcggctacatcaaccttgatcaactcacactttatttcctgccgatatggtgtccagccgatgtgcagtctgactccaaattcaactcgattccacatcaaaactactttgatcttcttccttcttctctgaatctgatgcgaaattccgttgttaacaccatctcttagttattaatagttctctatccttatagtgaacttaagtttgtttactaatatttattgttcattttttaactgttcgatcaccgcatgaagctttcatggccgaggaaggtttcttgtggcttgatttctctgatctccgagccgtctattgtcgggaaaggatgaacgcacatttataacacaaataaatcaatagtatacgtaagcttgtgattattattaacaagcttcttttgtaagatgcaatacatggatgctgagaagacaaaggaatctatcggatacctggatcccagaagaatgtatcaaacacagcataccatgacgctatcagcaaactccgagtagcataaagacaagatgcctaaagagatagcggaatacaagaagggctttcacaagaccaagttgcttactgtcgcagagtacattggacgagcctactgggtgccatgttcgaggagtcgtagcgcgacctcgtcgacgaggggttgatcgacggcgggagcatggacagcttcncatcccgtcgtacgccgcgacgctggagcagnnnnnnnnnnnnnnnnnnnnnnncggttcgtttgccgtcaaccagctggagcacgtgatgggaagccgtctagccgtggacgacgacccccatgaccgccgtgcagtcgggccagggtggcgaacaaccagcgatcaatcttccggacgctcgtcgaagcgcacatcggcagggcgctcgccgatgagctgtttgttcggatggagaggcgcgcaggagagctcgccgaggagctcggggacgagatgggggtccacttccacatcgtgtgctcgctttcactcgtctgacgatatctacatcgtacactgtcctaataatgaaaaaatatattcaaattttgggcacaataatttaaatataataattgtatttgctaaataagtctgctggaaatatggtcataaattggcatattttaatttagaaaaacaaaataataaacatggcatgcgagtaggaaatgatcaagtgctagtgctaaacataaatatgctaagggcaagaaaaaacatcatctacaaacatgtagaagggctttgttgctcaaagacaagatgttgttgacagaaaacacgaggcctgggagatatgcttaactccagtgcaggtccaaaactcgccttcagatgtatgagcgtgccagtcgatttgatcctgtaatcaacaagaaacaaagacaaagaaaccgtggttaaatccataaatgatagccgatcggctaggtgccgatgacatatcatttattttaggccgatgtcatatgtgcatcgatcggcaagtattaataagcaaatcagaactaaatctactccatcggccgtagatattaatgatatataatccttgtatcaatatatacttaaatcaagtgattgggatagatcggtcgccttgccgagacagtataaatcacttagatcgaaatatgtattaatagtgaggttatatatattcatagcatagccgattagatagatctagcgtgtataggctaatactccgataccactctaaattaagatattaaagcaagtagaatataccaaacaaaagcctaatatacttaaatgcaacaagatcttaatataaagggcagatttaacatgtcaatcaagcatataggataaaagtagttaaatcaggtaagatcggctgaaactccgatactactctaatcggcaaccagaaggcaggcaagatattatggttctaagcacgacttaatagatcaaactcaactgatgcagcattaagtatgaaaagaagaataatatctagtcaatcaagccgctggttgtttcatggagtggtagatatcttacataatctaagccaacgtcgctatttaacctaatcggctgccttctaataacagatgctagccgattataggttagatgatgatattatcgaagattatatgagatatatgataactcgacgaattacataaacaaggttagagtatcgtaaagatggaagcactaatcccgagaacacaagccgtcataacaagttttaaatcttgttgaagatcgaaaccgatgcagctcaacccgaaagcaagaactcgtcgaaacaaaacgaaagtaaaaagggtggcgatgcgccgagattgtattgcacgtctgttattaattacatagggctcagggtctatttatacccgagaattacaag

SEQ ID NO: 79525 - DNA, 683 bp, Oryza sativa
aagcagctattagacttctcgctcctgctagggccaaggttttgccctcttccctgatcttggctaaaaggaaggtagctgaaagctccttctgtggaaaggttctgcgattcctttcgttccatatctccaagggcgaccaacaacatcaaagtgcggagtgccttcttaggtgtctcttgtatgtttgcggtagcctcccaccaatctagcaccgttgaagtttgcctccattggctaggattaagttgctcgcacgtcgcccactccgctagtgccgcccagactctccttgtgtatctacatgctgcgaggaggtgcagagttgtttcctgggtccgacgacataaggggcaaatggaaccgtttggccaacctcttgtcgccagcctgtcagaggtcctgactctattttggatgattagccaggcgaaggtcttgcacttacacggcgcccaggctttccagattagcctattgaagttagtagcggtggttccaagaagttgtgcgttatatgctgatgctgtcgtgtactcgccatggttagtaagcttccatgttatattgtcctcctcgtgctctaccaggtgtatagcctgaacggcgatccaaaccccgacaagttgatcaatcaggtctgtcgtccagctcgcagtccctggcaagtccaagtcaagaag

SEQ ID NO: 79526 - DNA, 15759 bp, Oryza sativa
ttaatagatacaattgccttcccaggactctatccatgtatggcaatcatctcaaagcacatcaattcaaacccgatgtcggatacgagtcatattgtcggaatcggctgtatcacttaacccagtctgactcggtcttagccgatctcagtcgtagccgatccgaattccagccgattcttactctgcttccgtgataatcctcatcttcgattccgcttcgatctaatcttcatctctggtgctgattttatcaaatttggtcgttaacacatgccccccaagtccgcgatatttgataatgttccgaatttgccgtgtacatactctgaacaggtttcgcactttgccgttttccgaccgttattcaagcgctttaaatactaactgctgcccccgagaaatctcacaccgttacttccgttttcaccgcttaagcgaaacactgccttctctctctccggcgattcctccgacgcaaaaagcgatttccaggcgacttcatctccggcgagatctccgcccgcagcgatgtcgtcctccaccagcccatctgtcgcgccatcagccgagtatgctgaggtaagttcccattggctagatcccctttcttagcagcagatcgattttctgttgtcttatattgctctcctcttctcggttgctttggatttatagcatctctccaacctagttgcgattcccagcctatcgcatgaaaactactactttctcggcccagttggcaatcctgatcccaccgagttcatcattggtgaaaccaataggattccctttagattaaccaaccctgatctaggccactggaagaacacctttaaatcttggccgtctctagagaaaaccccacccgagaaaagttggactacatagttcaagcgtatgtcggcaagcaaaagagttcactgggacgaaattggaatcggccaagcactcgacctcaccatagcaaactcgaccaaagatgaacccctgatggcagctgcctcttatttctggtcaaacaccatcaatgccttcttgtttaatcaagggccgatgaccccaactctcatagatatcagcatgatcacgggcctggatgtcacctcatcggccaaccctatgagttcgaatacgaagaaccaatacgacttcaagaccaagagcataggtggctggtcaggctatgtagcagcatacaagggccaaggttcggtcacccctcgagaacatgtggctttcttgttaatgtggctagagaaattcctcttttgtggatcaagctgtggtcctacaaccaattggcagttcgtagccgaagccttagagacaaaaagacaatttcctttaggcaaaatcctcctcggctacttgtaccaaatgctaaataatgcatcggctaagttagctgtcggctcagtagtcggagcagatagaccatggtggctactgcaatcctggctaaatttggtagtcatgaggttcgtcaattagccatctgtaacagaagctgaattcccaagattagagccgattgtgaacaatgacggagaagaactcactcatcggagatgcacatcctatggagagtatgcttctacaccaactgatgcaggagcaaagctatcggctgagctactcaaagattggttttgcagcttttttgaggggttccaaaaggatgctcgagtctggtttctctatgaagattcaacacttctggaaaatccattggacttcagatttgaagacatcaacaatgacatatatcaaaagcccagagaaattttctcatctgcaatcagtccgtgtatccttcctgtcggcatccatcaagggagaaacatccaagtttcctatgagttttatcatccaatgagttctgccagacagtttggaatgggctaactcctaatcggcttattctttgccgataagatccagtgccgaggagaaatctcatcaaccttaatgatggatcggctgcttaatctccaagaacctcctctaggcagcattgacaacataaagctggcaaccttcagaagcaaagcatttgacagatggtggggcgaatggaagccgcacttattccatcaatcggcttctatgtatatgacagacctctttccagatgttgtccctcaagtaagtcttaactcacttgattttcatttgaataactacttaaccgattaatccttggctaactttccttttgacttgcagacaacagaatcctctcctcctatccagagcaacagtggcaaggatattgagtttgccccaggattgattcccaatggaggtgggccatctccccccgtcatcggctataatgcccccaagacttcagctcttcttcaagggctcatcagagaactagccgatgccggcaaaaagaggaaaactagatcatcggctgtagatacttcagccccagctccaaagaagaaaactaagacgaagaaaaccacgccagctgatgatctgcctgctctagatccatccattgaacaagctctggatgaagaagtaattgaagacgatgttgatcaggtcgcagccgaagtaagcgatacataaagaacaccatcggcttcacccaagcagacccctccaactccttctgctctagtccacttttcaagagtaagcaactctctttgatccctcttgtaatcattttaccttatggccgattactcacagatttagtaattgcagaaaaagaagactgctgtgaagaagaaatcggctgcaacaacatctaaaccagctccaccagtaagatagtctcaattcttttcattagttaattctcagccgattttgtctaacacttgtctcttttagcctccttctcctccttctctttctgtacaacaatcatcaagtgaccagactccatcggctgtagtgagtcaccatgtggaagaagaagttcaaccaactgctcctgctatcccagtaagttttctttgacaaaaatactcagatcggctatgcctatttgatctctaactctctttaaatcattgctgcaggtcttagccgatcttttctcttttcacatcagagattatcttgatgaaggagaataagacaccacaagcaaagccttagcccctttatccgatgatgtgaagaaaattctagaagatatttctcatcggctagaagcatcatcgctggatagcttgctagttgattgtggctcaattaggactcggcttcatgagattcaagctctgatcccagatgagctagctgatatcctcactccagccgtttatcttgagcaacatcaattcaaactggagaaaaccaagttaagactggctgaacggcagaagcacaaagatattgaagctacaattcaagtcaatcggcaactggtgcatgaagaaaaagcaaaacttgatcaattatctgaaggtccgatcaggtctaatattgattggcttgaagctcggaagattgagctcctggcacaacatcaagaatgcaatgccgagctagacatagaaaataaaaaactagccgatgtcccaaaatctgttgaagagcagaaggcaagactaaaatcggccataaaaaatgttgttgatctgaccaagtgtttaaaagtcatccctggaaccgatgctcaagacgccctagccatagaagaagtagaacaaattaggcgaaaagctatatcggctatccagcgatatttgtctcagtgactttctatgtaatagaccttagaaattttttgtaatcggctaagatacttccgatgtttatcctgacaatcatttgtgccgattaatctaacttccaaatttcgctcaaaaatttgctaaatttgcatcttgtgaatatatgtgcccccctaattttgtaatgacgaaggcattgagaaaattataatctggactaagggcgatataaccatatcggccattgtacatcggcaaaacagaaccgattacaatacaaaaacagctaagggcgagataacaatatcggccattgtatatcggcaaaacataaccgattacaatacaaaacaactaagggcgatataacaatatcagccatctcaaggcgatgtaaacacatcggctatcatgcatcaacaacactaacagatcatgcgttaacccaaacacttgggtaatatttgttcaagtacttgccattgagcgctcgtccatagacctcgccatcaagccctcgcaacatatatgtccccttagacacaaccttatagatttggaacggtccttcccaattcggtgaccacttgccgaatttgttatcccgagttccaatcggcaaaatcaacttccatacaagttcaccttccgaaaaagtcttggataccactttcttgttgtagtgccaagcaactcgttccttatctttggtaaccttagcaagggctcgcaaatgcgattgaaccaagtcctccctttcatcagccataaggttataatactcatcggccgtcaaaccatcttgcaattcaattcttctggagccgattctaacttcccatggcaaaacaacttcatgtccataaacaagtttataaggaggaacttgtatcgacccatggcaagccatccgataagaccacaatgcttcggctaaacgagtatgccattgccgaggataatcaaaaattttccttttaatcaacttaatcaagctcttgttagatgcctcggcctgcccattagcttgtgcataatatggtgaagaattcaataatttgatacccatgctatcggcaaactgaacaaattcatcggacacaaagattgagccttgatcggtcgtaatggtttgaggaataccaaatctatagataatatgttcttgaacaaattgtatatcatccccagaatcaaccttcttcaaaggaatcgcctctacctacttggtaaaataatcggtcgccaccaatataaacttatgccctttacttgaagatggattaatcatacctatcatatcaattccccaacctctaaatggccatggtttaataataggattcatagccgatgtcggcgctctctggatcgccccaaatttctaacaatcttgacatcctttataatatctgaaacaatcttccagcattgtcggccaaaaatatccagcacatcgaagcaaccacttcattttatgagccgactgatgagtgccacatatctcttcatggacttcaccgattgcaacttttgcctggtcggcactcaaacatttgagcaacaccccatcaatcgtctgataataaagctcatcatctagcaatgtatacttcaacgctttatatcttaatttccgagaagccgattgagatggatcctgtaaatatcgatagacatcatatctccaatcatcggctgttatggcgacaacttcaatcttaacatatttgatcatcggcttatatcccgatgccccttgggctaaatcagtagcttcaatattctgctctcgaggtacatgcttcaaagttactagccgaaattccttcattagttctttggcacttctcattataaaccattaacgtatcattcttgcactcatattctcctgccaactgactgattaccaacaaagaatcccccatgatttcgatagcaccggcttcaacttcctttagtaactgcaaccccttgaggaccgcctcatactcagcttgattattagtcgcataaagtttaatagtataagcaaactcaaaacatgccccccgaggggaaattataactaagccgataccacaaccatgagtacaaactgacccatcaaagaataaagtccatggcacaatctcatccgagccgattgaatcatcatgatgatcaacaataaaatcggctatagctggccctttgatcgccttcggcgattcataccgaagatcaaactcagtcaaggaaaatatccactttccaatccttcctttcaaaataggagccgataacatatacttgacaacatcggccttgcatatgacagtgcattcattggatagtaaataatgccttaaccttgtacatgaaaagtataaacactccacaggggaatatctagtctctgcatccaagagccgacggcttaaatagaacacaaccctctcctttccttcgagcttctgaatcaagaccgagccgattgacttgtcaccggccgacaaatataaccgaaaaggtattcctttctgtggaggaatcaaaactggaggagaactcaaatattccttaatattatccaaaactttctgttgttctgccacccaagtaaactgatgatcggccttcaatctcattaatggtgtaaaaggctctaaccttccagacaaattagaaataaatcttcaaacaaaattaattttgccgatcatctcctgcaattctgtcttgttctctggaggcttaatcttcttgatcgcattgacacttctttgagttatttcactccccctctcatgaacaagaaatcccaagaactggccagccgatacaccaaaagcacacttcgtcggattcatcttcaagccatatttcctggttctctcgaaaacttttctcaaatcggctacgtggtcctttatttccttagatttaacaaccacatcatcaatatagacctcaaccagccagccgatcagatcatgataaatataattcatggccctttgatatgtggctccagcacttttaatccaaaagtcatcactacccattcaaataagccgattgcaccaggacatctaaaagccgtcttatgaatatcttcctcagccataaagatctgattatatctcgcatttccatccataaaacttaatatcttatgtcctaaagcagcatcaaccaactgatcggccactggcattggatattcgtcctttggggtagctttattcaaatctctaaaatcaatacataccctcaccttgtcgttcttcttgataacaggaactatgctagaaacccattcagcatatcgtcaaggacgaataaaagcagcatcatataaacgcttaatctcagccttgacaggttcgagcatatcggctttgcatctcctcagaggctgctggtgcggtctaacccctggtttaataggtagccgatgtttgacaattgatcggctgagtcctggcatctcataatactcccaagcgaagcaatctctaaattctttcaagagctctattagcttggttctaaactctgaagataagttcttactaataaatgtcggccttggccgatcgcctggacctatatatatttcttccaaatcatcagccgacatgaaaccctgaccttgcttgtcatcgagatcatctactgcgtccttggtgtagacgtttcaaccctccacaatgccatcaaaataatagcttgggttctccatcttcaattggctatatatcagaatcgaaaacttttagaaaatctccatcccaaacttttccagataaacaatcaagaccatccatctcccaaagagctaaatcggcactggcaacattgactgtcctgttggctggcacaatctctatcttgttgcattgccattgaatcaagcattgatgcatggttgaaggaatacaacaattggcatgaatccaatcccttccaagcaacaagctgtaagaacccttcccatcgatgacaaaatatgtggtaggaatagtcttgctgccgactgtcagctccacatttataacacctttggtttctgatggattgccaccaaaatctttgagcaccatgtttgtcttgatgagatcttcggcgtttctacccaacttcctaaacgtagcacaaggcatcaaatttactgcagccccaccatcgaccatcgtcttagacatcggcttcccattgacatagccatttatatacaatggtttaagatgccgattctctgtctcctcaggcttttcaaagactgcctgttctggtgatagaaccaacttagccgattcttcttctacttcgtcgacatcggcttgttcgatcccaaattcggctggcaaggtaaaaaccatattaactgatgccgttacaaaacttttccattttgccaacctctctgcctcgtcggctgcaatatcatcggctccaggagcttgattcttaacgcgccactcctgcctcggctttgtcttctttagtcgatgactaattacttgctcgacctcctaaaaacgttctctgctcctcaacctttgaacccttcttttctgattctttgtaaaaataccagaaggacaccactgaatcttcctatcttcatcatcctccgggtcacgatcctggtttaccgggcccaatctttgatgaacaggaacccttgcatgcttcagccgattgccttcactatatgatcggcttgaactcccagtaacatcacctcatccaggacagttctcgatagatggtagcctcataccctcattccagcagaatctaaagaactcacagcccaacgaggataaaaaccaccattatcctcttcataacgcctctcctgctgcttgtcgtatttcctttgatacttgtttataattttagccgaattcacctaaaaacctctcgtacgtcccgcatcggctgttcggctagatgtgtgcaccatgttaacaggaaaaggattaccatcaaccttcatcggcctcttggaatcatcaaacttaatcttgcctccctcaatggccacctgaatctgttgcctgaaaaccttgcaatcgttagtagaatgagatccagaattgtaccatttgcaataccttcttttgcctaattcctcagccaatggaatcgtatgactagcagagagttgaatttgcttctctcagagtaacagatcaaaaatcttgtcaaccttggtaatatcaaagtcatacctatcctcttttccagaattcattacccattggcatggtattacccattcggctgcagctatttcggagtcatcatcatcatcatctgacacatacatgtaagggcaaacatgattaaccttcttagagttcttcctagcctctgcagacctctgctcgtgcaggtttaccttttgtataagatgtgacaaactatcaaagtcctcagatgagaatttttccctaatcggagcaatcataccctgaaaggccaaatcggccaattgggcgtcagtcaagctcaagctaagcacttattcctcatctccctgaacctcttaatatactcatgcacaggttcatcatgcctttgcttgatcgctgttaaatcggacaatttcatctcgtgaaccccactgtagaaatacctgtgaaattgcatctccaaatcggcccaactgttgattgacccatatggcaaagaagaaaaccaagtaaaagccgatccagacaaggacaaccggaacaacctaactctctgagcatccacagccgatgcttcaccacactgagctaaaattcggctaatgtgctcataagttgacacaccatcttgtcctgagaatttggaaaaatctggaactttgaaccgctttggaaggggaactctctcaaaccactcagggtaaggttgccaatacaagtttccagtatcttttggtttaagcccgaactgttccctcattacgtcagcaatcacatcggcccacggtcgttgttgagctgctccttgcgactgttgttgcatgggctcgaattgactgtactgaggagcaaactgaggttgagttagccctccttgctgatattgggcttgcggggaaggaggttgatattgatagttcaaattgccccctggtaattctggtagtttggctgaatatttcgcaccaagtgttcagggacaatatgaggtattaccgtatggtctagctgcacatgatggaccaaatgctctggaacaacctgattcagagcgtgttgtccagccgatggattcatcaagccttgctggtgaatcggctggatagcctactgtcttgatggcgtttgttgaattggctatacaatctgctgccttggtggcgtttgttgaactggctgcacaacctgttgctgaactggctgtacaacctgttggatcgggggtgtttgttgaatcggctgctgctggactggatcaacagtaggttgaggtggtagaaacatggcagcaacctgatcttgagttagccgattcgcaacctcccactatgttgtggttgctccctcatcaatagccgaggattaaccagctggcctggtgccgacgctgatggagcaggtgggggagtcgataccggtgccgtcggctgagctgatggtgcaatgggaggaactgttcgaataggctgagtaatcgtgatcaaaggcctataatttggaaagacacctccttgcaaataaactaggcctgtagcctgatattcagctattgaaccatcagctattgatttcatcatgtttgacaaggtattgactaacaccctagactgattaatcaaagcattgtgcatggcataatcaacccgtcttggaagttattgaaaaactcctgtgatggattgccatcctgattaagatttcctcctaaagagatagcggaatacaagaagggctttcacaagaccaagttgcttactgtcgcagagtacattggacgagcctgctgggcgccatgttcgaggagtcgtagcgcgacctcgtcgacgcggggttgatcgacggcgggagcatggacagcttcaacatcccgtcgtacgccgcgacgctggaggagttcagggaggccgtcaaagctgacggttcgtttgccgtcaaccagctggagcacgtgatgggaagccgtctagccatggacgatgacccccatgaccgccgcgcggtcgggcgcagggtggcgaacaaccagcgatcaatcttccggccgctcgtcgaagtgcacatcggcagggcgctcgccgatgagctgtttgtccggatggagaggcgcgcaggagagctcgccgaggagctcggggacgagatgggggtccacttccacatcgtgtgctcgctttcactcgtctgacgatatctacatcgtacactatccaaataatgaaaaaatatattcaaattttgggcacaataatttaaatataataattgtatttgctaaataagtctattggaaatatggtcataaatcggcatattttaattcagaaaaacaaaataataaacatggcatgcgagtaggaaatgatccagtgctagtgctaaacataaatatggtaagagcaagaaaaaacatctacaaacatgtagaagggctttgttgctcaaagacaagatgttgttgacagaaaacacgaggcctgggagatctgcttaactccagtgcaggtccaaaactcaccttcagatgtatgagcttgccactcgatttgatcctataatcaacaagaaacaaagacaaagaaaccgtggttaaatccataaatgatagccaatcggttaggtgccgatgacatatcatttattttaggccgatgtcatatgtgcatcgatcggcaagtattaataagcaaatcaaaactaaatctactcgatctgccgtagatattaatgatatataatccttgtatcaatatatacttaaatctagtgattgggatagatcagtcgccttgccgagacagtacaaatcgcttaaatcgaaatatgtattaatagttaggttatatgtattcgtagcatagccgatcagataaatctagcgtgtatcggctaatactccgataccactctaaattaagatattaaagcaagtagaatacaccaaacaaaatcctaatatacttaaatgcaacaagatcttaatataaagggcagatttaacatgtcaatcaagcatataggataaaagtagttaaatcaggtaagatcggctgaaactccgatactactctaatcggcaaccagaaggcaggctagatattatggttctaagcacgacttaaaagatcaaactcaactgatgcagcattaagtataaaaagaagaataatatcttgacaatcaagccgctggatgtttcaaggagtggtagatatcttacataatctaagccaatgtcgctatttaacctaatcggctgccttctaataacagatgctagccgattataggctagatgatgatattatcgaagattatatgagatatatgataactcgacaaattacataaacaagattagagtatcgtaaagatggaagcactaatcccgagaacacaagccgtcataacaagttttaaatcttgttgaagatcgaaaccgatgcagctcaacccgaaagcaagaactcgtcgaaacaaaacgaaagtaaaaagggtggcgatgcgccgagattgtattgcacgtctgttattaattacatagggctcagggtctatttatacccgagaattacaagatatgtccataccagacacgactattatctctaacaaactctaagataccataagtctttgcggcagacttttgcccatatttatctctaaggaatttacataaaatattctaacccagtctgacaatcatctcgaagcacatcaattcaaacccgatgtcggatatgagtcatattgtcagaatcagctgtatcacttaacccagtctgactcggtcttagccgatctcagtcgtagccgatccgaactccagccgattcttactctgcttctgcgataatcctcatcttcgattccgtttcgatctaatcttcatctccgatgctgatattaccaaatttggtcgttaacagatgcctaaagagatagcagaatacaagaagggctttcacaagaccaagatgcttactgtcgcagagtacattggatgagccttcttgaaatttcaacataaaagagtcataaaggccgcatacaactttaactaagtccagtagatttctttgtacatatatgtgttatttcatccgtgactaacttcatcgtcgttactatgtagcgatcattatatttgtttgatgatctacccgaagtacgacaccgtgacagtcttggacccccttgattataaccacatgatgtaccgtcaatttctaacaatcttcaaatagtaagtgatctgataaatgcatgtctaactttcatgaattataattaaatctcctccttaatgcgaatctgtaaatccatacaatgtgtataactactacaaggtaaaggtggagaactactgcaaacaagggagaaaccactagtgcatacatactggccagtaatactccacacacttaatgtatttcaattgttttacttgcaatatttaactagttccttctatgtgtatgtcatgaagtgtcacaagcaacttaaaagcggtgtcctctgcagttattacacatgcgaattcctcagggttaatgggaggtacatgaccaacgcagaggatgtaagtctctcgactcaacgtataagtgcaatggagaactgcacatctagatgttagtaatatattgtcgttttttcgtgcatgcagttgcctagaattgaacatcgaacaagctttgacgatgaaggcattaaaaatgtgcagcgggacctctgccacttcatccacaacgagtgctgtcatatccaaggacggttcttcgacccagaaggcaccctagcgacaagcgatgaatacaagtctcttcgggagtggaacaacgcgatgccataatgtatttattaattagatagtgcatttgaaatgacaaatataaaaaatattgtaacatattgatgacacttttcactaatgcaatatatgtatttttgtcagtattaattgtttgtaagttcctaatattatttatgcattatttaattagttgcaacattattgataaaaaatattattaaaaaattggcgtgtattttcctaggcgacgaggccttcttatcgcaggcgactcctacccattttcccaggcggcgcgtcgtgctcccttccacctaggaaaacatcttcccagacggaatggccgtccacctgggaagactgttttcggccgtatgcaaaaacattttttctacattttttctagtagtgaaggagaataaatgaattaaatatgaccacttggctgccttttgatgatgacggtttcgtcgtcggagagaaaattgccttattctggaaggtcaatggatgagaaaatgtattcacttggtatacttgctggatattgcgtgaggacgggtgaaatgtaggtccctattgacatttctttattttatgatttattttatatcagttcaaaatataggcattatggatcttcaaatcattggtttagttagattagaaattatatgtatagcttaaaaattatgcatattttaatatttattattatttttcgttatataaaacaaggaggggtacagtggacagctcaaaccgagaggggaggggacgagtagtattgtgtggtgtgcatgtgtagggagggcacaatggaggggtgtttttttttctatttttctaaataatttaagtgaaaactgatggtctaatttttttctctaatatatttttttctaatttttaagacgtaacacatgaagcggtttaagatttttctaaaagtatatatgttagttaaaaataatgaatcatctattcaagggaaaaccgatagtcaattttttttacaatctctaagatttttttttctacagaggatgtacttgtgatataatacttattgtcatttttttaatttttttgttcgttttgctatttcgtttatgttcaaatgatgtatttgtttttctaaatgaactatgggtaatgtggaccttaaattatttatttaactataaataaaataacaattcaaacaaactaaaaaatcggatgtaacttaagaattataattattttactttctaattattgatcgttttttattaattagttaaaagttagaagaccaagaaattgaatgcctgaataagttataggaaacttcccacttcgtagtcgtagttcagcatatcagccactctttcttctttgtctttatcaactcttacctcaaaaaccttttaattactgtttatttcagacaaagcaacagagcagaaattttaagagcaaaaaagcagagactactatattatatatactagatatacgcccccatcaaatctactcccgtagtgttcgcacggtggaatcaagagaagatgcaagcgcaggacgtaaagaacgtcttctgcatgaagggtgggcaaggggagtccagttacctcaaaaacagtaaagctcaggtaacaagtaaaactaaattaattacctaaatgccacaacaatttattgaagtttaaattctccttatttatatacgcaaagaattgatggagttcaaattcagcatgcaactttagtttcaaaaaaaaaaaatgaaatcagcatgcaagtagaggttattttgtttcctaagcaagttccttccctgtgcttgatcgagcgaaactggcaacaaaatgcagttgagaaacctgcaaatgatgctgtatgccctggaggagacactggacacgatcccgatccctccccgcgggccggggaagcttcttctgctgacggcggccgacctcggctgctcctgcggccgcaactcgcacgtcgtcgccgacgcgatcgtgcagcacatgaccaagctgtgtcgcgg

SEQ ID NO: 79527 - DNA, 573 bp, Oryza sativa
agttgctgaaatatctgcgaacatgttaaggagcttcatatacaacattaatacttttctgaacaatcaattacattagtggaacagatgccagtacaagcaacacttatgcaagggtagttggtgatgaaaggatacataagcatgtctcccaagtgaactaaaaataacttcatcgcctccaaccaatgtgaccttagcagtcttatctaataccttcccatttacatggacagctttagatacgtaaatctcaagagcagcacccctctggtacaaacaggtcaaaaattgagtaagaaactcaaaaaaaaaaggcaagatgaaaacacgtaagtcaaaatttagaaaaaagaatgtgcaactataccttaacatgcttcaatttgcaaataagtgatccaggaaatgactctgtcagcctcaaatcataatttccaccatggccaaccgtaaaatgagtagtataaataggtactgaaggagactggaaaggacaaagatgaacacaatcatgagcaaagacaaaaggactccatggggcaaattaacactttagaagtaaatgaggct

SEQ ID NO: 79528 - DNA, 697 bp, Oryza sativa
tgcaacgacggtagacgtagtccagtaactcctcgacaccagcacagcagctctcgagagctgagcgtcaagaggggccggcctttcatcgtgggtgaccttgatctcccagacaagcacgtagtggccaggaacagtgaaaatatcagtgtagctagtgtactccagaagaaggtaattttggttctccaggattttctaagcagtggtgacactgttgtggagatcctcctcgttggtcttgtcagaatcgatgctgaggataacatttctccggcaaatgaatttgaactgcggagctcggttgtagaagcctgtcacttgaagcacatcaccaaccctgtacctgtaaagacctgggcaagacatatgtcagttgaaggacatgtatttgcgagttactacatttccaaatatctgcagtgcaggggtttgtagttttattttgttttcctgtatgtgaacttaccactgcatctacatatttattatggtgacaagcactacttcagtgaacataaataatccgtttcacttgtctgatccctaaaaaaaattgaagcaaaaatacctgacagttgacacatatattgtattgtgaaaattgaagttttgacaaaatgatagtctatattaatgttatagataatttcatgtcaagaaaatttcttttgatcatatggagtaaaagctgatg

SEQ ID NO: 79529 - DNA, 1388 bp, Oryza sativa
gccgctaggactgctgcttttgctgctgcggctgctgccgatctgcttgtgctgctgccgatctgccgttgctgctgcttgtgcgttgctattggctgctgctgcttgttcctgcagaagaacagcaaggaggaagagaagggaaaaaaaagttagaagaagggaaatttggggaatttggtgaatatttctaacttctttgtttttcttacaaaattagtactgctaggtaacccgttttagtccctagttgtttctaatttatatataagacgatatgtttccggtagctctatttttatcgaacgctaggctgaaaccgtattttcaattctggtattaaaccatcgggattcaggttagttgtcttaaataaagtttgtagtcatcgtcgatatctttctaacgctgctggtttcacttgattccaataaacggtttaggagaaacaacagaaacagtactgctgaccgggtccggaaatcaggacaataattcgttttccttaatctgggattttcagaggcataatctgattttgtgctccacatgaaagttgtagacaattttgtctagatgtccgaagttgtattatttgctagattccgttagacggtttgtgagttacacataaaatagtaagggaacagctatatatatttaatataaatcggtaaaaaactatatattttaggtttcgattttagtaaatgtcccttgtaactatcattagttgaatatagtggtttattatgcgtagttttgctccataggtgtgtggagggttgcaacgttgaaggagttgagttggattatcgatgaagttaaggcaagtacaagacggacttgtgtggtggataaactgtattgctttgttggtttcatttacccaattattattcgaagcttcctattatcaattgtgtggttttggtattatgctacatattcatatttcacttcatgttcaagttcacgacgttattcatgtttcattcttccggaagttttttttacattattcaagtaccatgcgtggtcatgggaatgcaatttgaatctttttgtttacattattcaagtaccatgcgtagtcatgggagtgcaatttggatctttattcatgatccttgagaagcgctgatcacgcttgctcggcttaccggtaatgctaagaggatattcacacctgcccgggagggaactactaccttttgtctccttcgttttaaattaaaggaagtcaaatgtttcatattggttttcttattgcattaaacctgtgtatattttactagttcaatattgtacttgctgagtattctttactcactcttgtgtttaatttggttttcaagtacctaatgatattgatctgcatgggacga

SEQ ID NO: 79530 - DNA, 614 bp, Oryza sativa
cccaaagagctccatagcaccgttgttcttcttgcttcttctcaagttcatgtagaaagccatcagctcacagagccatggggattgaagtatttcaatatgcagactctgggcttgagctttgaattcctgcccttgcttcgagtaatgtatctggaaaagagaggcttttagttaatagtcttacataattattaatataaccattgaggaccgtcttaaatccaaagacaagaacaatgatagatacgttaattctaacaaaaatagtcactagaaagattaaatatataaatacaactcaatcatcctctgtgtgtgtgtgtatatatatcctcgaagataccatatgagtatatgacccattgacacctatatagactagcattttgggcttcaccaaactcacatgcttataactaaaagtgtgtgaaatttttgtgttcctctctcaaataatggaatacttatatagttatcttcccccttcgttcggtttccaaaaaaaaatattccccctttgtccttagtaagctttaaatgtttctaatgcctttaagagataaagagaggtgcaaagattaaagtttaaggccatgccttgtcatatttct

SEQ ID NO: 79531 - DNA, 21596 bp, Oryza sativa
gcaacgtggcgtagcgttggacagtgactggttaatattgcttaattactacaactgtttttactattttcaactactggttttaaatgcctgctttatgcaaatgaaccccgtagcctccgttggttatatcctgcatcatacctcctcttccggtatgacttgctgagtacagtgggtagtactcagtcttgctcttttcccccacaccagagttgaagttcttctcagttggagatgtcttgaagaggttggtttcgtcgctgccgtcaagggttgcctgtggaatggaatcgcctgctgcaggagtcaagtcttcaggcttagctcgcttttaccttttttgctgcatttgtaatcttttatatttttgtaagacgtggatctgtatgtcaacaattgtcatttgtgtaccctggctggtcctggacaggggtttaatacacattcagcttagaaattctggttcgtgaatttctgggcgtgacaagttggtatcagagccgaccttgaccgtaggacaagccaactggaaaacctaagagccctctgaaccccttttcatatgcacatgcctttttcacttggatttgtttcgggaaactttggggtttgatcttttgattttgggagaaaatcttggtcgcctatttaatcggatctcttgactagggacagtccagggttttagcaaaactttatttggaatttatttggcagtcagtcgggaattgttaggtggaatgtattaagttgtgtctagattcgatgggatgcagtctttatgcgcatcattattatcatgcatttatttcatgcattaagttattgtttagtcagttgcattagtgtcttttgtctgggttcatgaaaaatgttccatgcataaaaatcatcatgcttggctagttgtttgggccatttgttgcgttgtttaaatttggatttgagcatgtattgattcctatcccttgtctaccttagaagtcagacctgttcttcgattgcaagcgccgctccgagcttccgagtcgtcgcccttagctttatcgtcttcttagtctgtttgcgtgctagtttttgtgtttaggtttgttgcttgtgggttagtcggcggtcgatatcatgtgtgagtggtatgacagccttaattaggaattgcgtgcctctttttcagagttttaatcaagattaagataattgcacttaattttataagaaagattagtttctgagccatctgttttcttcctttctcttatttctacctatcctcgtccagatggtgaagacaaggaatgatccccgtgactccaacgacgccagtggcagcgaagagcagacagatgaagctcatactagtggtgcacctggcagcagttcatctccgccgcccgagaacccaacagtcactcagatgatgacaatgatgatgcaacagatgcagcaacattaccatcagatgttgcagcaggcgcaacagaaccagcagtttggtcctccaccatcacacgtgtccaaactgttagactttcttcgtatctagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggtgacccgtccagatgcaacgaaggttacttgggtagagttttgtcaaaactttaggaaggcacagattcctgaagggattgtggcacaacagaagagagagttccgtgcattgcaacaaggaaccagaacggttacagagtacctgcacgagttcaaccgcctcgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcaacaacgattacaacggtggcagtcacaacaatagtaagcagcacaaccacaactcgactccacccctactaatggcaccagctcagtcagatctgccagctgtgtcagctcagtcagaacaacccaagaagggggctgtaggaaagccaagaccctgcttcaactgtggcaagcacggccactttgctggcaagtgtccgaagctgaatcgcactggacccaggttcatccaggcccacgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactacccctcggtgactatagagatcaaaagatcaccgtttctatccaacctcatccttctcgaatctaaagacctagatgtcattctcggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatgacagctaatgagctagcagaggtcaagaagcaggttgacgaacagctgcagaaagggtacatccgaccgagtacttcaccttggggtgctccggttatctttgtggagaagaaagacaagactaagaggatgtgcgttgattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcaccactcggtatgggttgtttgagtgcacggttatgtcctttggactcaccaatgaaccggctttcttcatgaacttgatgaacaaagtgtttatggagtttcttgacaagtttgtcgtggtattcattgacgacatacttatttattcaaaatcagaagaggaacatgagcagcatctccgtctggtactcgagaaattgaaggagcaccagctatatgccaagtttagcaagtgtgacttctggttatcagaggtcaaatttctgggtcacatcatttctgctcaaggcgtggcagtggatccatcaaatgtggagtcagttacaaagtggaccccactaaagacagtttctcagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttctaattctgccagatcagacaaaagacttccaagtctactatgatgcatctcgccaagggttgggatgtgtgttgatgcaagaaggcagagtggtcgcatacgcttcgcgacagttgcgtccacacgagaccaattatcccactcatgaccttgagttggcagcagtggttcatgctctgaaaatctggcggcactatcttattggcaaccgctgtgaagtatacactgatcacaagagtctgaagtacatcttcactcagcctgacttgaatctccgacagcgaagatggctggagttaattaaagattatgacatggggatacattatcatccagacaaagcaaatgtggtagcagatgctttgagcagaaaaagctattgcaatgccttatgcactgaagacatgtgtggcaaattgcagcaagatcttgagcacctaaatttgggcatcgtcgaacacgggtacgtagctgccctagaggcacggcctacgctcgtggatcaactcagagcagctcaggtaaatgatcctgaaatagctgagctaaaaaaagaatatgagggtcggaaaagcccgagatttccatgaggatgagcatggcacaatctggttgggagaaagattgtgtatgcctgacgacaaagaactgaaggatctcatactcacagaagctcatcaaactcagtattcaattcatcccggcagtactaaaatgtaccaggacctcaaagagaaattctggtgggccagcatgagaagagagatagccggattcgtcgcactctgcgatgtttgtcggcgagtcaaagcagaacatcagaggcccgcaggactgctacaaccccttcagatcccggaatggaaatgggaagaaatcggaatggatttcatcactggtttgcccaggacatcgtcagggcatgattcaatttgggtagtcgtggatcgcctcacgaaagttgctcatttcattccggtgcacactacctatacggggaaaaggttggcagagctgtacttagcaaggatcatgtgtctgcatggggtacctaagaagatagtatctgatcgagggagtcagttcacttcaaaattttggcagaaactgcaagaagaattggggactcgtttgaatttcagcacggcttatcatccgcaaactgatggtcaaaccgaaagggtcaatcagatcttggaagatatgctgcgagcgcgtgcgctcgattttggtggagcataggataaaagtctgccttatgcggtattctcttacaacaacagttatcaagccagtttgcaaatggcaccgtttaaagcgttgtacggacggaaatgccgcactccgatcttctgggatcaaattggagaacgtcagttgtttgggacggaagtattaactgaagcagaggagaaagtcagaaccgtcagagaaaggctaagaattgcgcaatctcgacagaagagttatgctgacaaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgtttcatgtatctcaattgaagaagtgtttgagggtacctgaggaacaagctagctcagagcacattgacatccaggaagatctgacttatgtggagaagccgatttgtatccttgagaccagtgagagatggaccagaaacaaggtgatcaggttttgcaaagttcagtggagccaccactcagaagaagaggccacctgggaaagagaagatgaattgaaggccgctcatccgcacctcttcgccagctcttccgaatctcggggtcgagattccgtttaagggggtaggtttgtcacgccctgaggttcccctcccttgctctaaattcataaaataaatcgtccgaagaaattgtttaatttaacctagagatgaatccctaattaataaatacaaataataatcggaatcgacatgtggaatttttcttggattctacatgtcaaaatatgctaacaggatttttagtggaattttcagagcattggaaataattttaaccaattaaaatgagcaaagggcaatgttaaatctctggaaaaatcctttcttctttttctttttctttttcctcctttttcctctctccttgggccgtcggcccagtccattcacctcccgcgccggccttccctcggctgggctggcccaagccggttcctccctcctccctaacccctccgggtcaccgacaggtggggcccacctgtcggccccttcttccacctcccgccgccgctccccaagccggcaaccgccgagccgcccacgccgcccgcctcccccgccttccgcgccccactccgcgccgcgcgcccacgtcgccgcccaccgtccctactcctcccactcgcgcgtgcaccccgcaacggagggattcgaattcgaatctctctctctctctctttctctccattccccacgtcggcgagaaatccggccacctcccggcctcgtccgtctctcacgagccccaataaagcttccccgcactcccctccacctttttcctctttccgccgctctctcccgtgccctccatcactcccgcaccgctacacccgccgccgccgccttttccactcctctggtcgccgctcgccgccgctggagccgccgccgagccaatctgccgccgccattagcttcgccgccgccaaagctaccccggccgccgcatcccccatccaatcccgccgtcggggcccgcttctctccgcgcgccggtgagtaccaccatagccgccgccgtcggccatggctctcgctcgtcgtgggcaccctctctccctctaacctctcacacttcctctcttagggtgtcccggagctcggccgccgttcgctgtcgcccttcggtcgctcaccgtcgccatttgccgtcgtctcctcccgcgccggccgaaccccggtgagaactccctctctcttcctcccgcgcgcgccgccgctccccgcatgcgcgtcgccgcgatgtaccgtcgcccgcgtcgccggccgccgccgtcggtggccgcttgccgccgccgccctcgccctaaccggccggccggcttgaagccgagccaagccaggccgccttcctcctttccccatgagccgccgcccggtgggccccgcctgccagtacccctccctcccccttgagctgctgaccagtggggcccgcatgtcggcgccgccccaccccttgctgacgtcagccctggggcaatattgcgcaataaatacattaaggcttttttctttattagtaaaaacacagataatcttctaaaaatcataagtaattcatccgagctccgattaagtccattcaagtctcagtaaattcataaaaatgtatagaatccattaaaaatggttttgtttcctgtttcagtagacttatagcatgttttgcttgtgtgctttgtttgtcgcgtagatttcgcccgtttcgtcgattcgtggtttctcaaagaagttgctgtggttccatcagtgcgagagcaaggcaagtcatacattgcaattgatcatattgtacccaatttacaaatgtcccgcatttctattaaatattgcattgttttacaatatcatatgggatgggtcctattactcagctatatgttgtttcccttacgccattgataacttgggtattaaaatgactagatgttggtttaggagatgcttagccatgcttagttcaactagtgcacaaaaggggatcacactaaagcatagactttgattattggcaatagctttggattagtgccaccgcaatggtgttggttaattaaaatacactacatggtgggctgtgggtgcatggttttgctagtcgtgcccatggcgattaaggacctgttcgcgggatgccctggaagaacttatcgtacttaccacaagccagcgtgggcaacggctgggcttgcagtgtagcttttatctagccgacgtacccaggcgagggtgggcgtgatggagttgggtcggccggggtgtccggttgatcggcttccggattcaccgcggcacgaacggggggctgcccgttgcctgctggggacgggggcgaacgctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccatgctcgcggttatgggcggtcgaccagattcaccgtgattagtctcacccctagtttagcttaatgaactggtgtagttcaggtggttggttgggcctgttgcaacgtggcgtagcgttggacagtgactggttaatattgcttaattactacaactgtttttactgttttcaactactggttttaaatgcctgctttatgcaaatgaaccccgtagcctctgttggttatatcctgcatcatacctcctcttctggtatgacttgctgagtacagtgggtagtactcagtcttgctcttttcctccacaccagaattgaagttcttctcagttggagatgtcttgaagaggttggtttcatcgctgccgtgaagggttgcctgtggaatggaatcgcccgctgcaggagtcaagtcttcaggcttagctcgcttttacttttttcgctgcatttgtaatcttttatatttttgtaagacgtggatctgtatgtcaacaattgtcgttttttaccctggctggtcctggacaggggtttaatacacgttcagcttagaaattctggttcgtgaatttctgggcgtgacacctaggtgagaagctccttgccttccacctaccatcggtcgctgctttcgccttcttgctaacgagctggcgagctcactagccgccaccgttgatgtttgtggtaggagaaatcgggggaggagagagagggttgagaaggaaaaaggatgcatgtttcactgactcgtgggtccatcagtatttttattactatttttttctaatttgtgtgccacgtaggcaccatttcacggcttagtagtgtcttggaacctcgatttcagtggtattgcaatatgagagatacattatacatgattgcgtggccaagggacgggactataactcgatctataatgagagacgcaaaatgaacatattattcccatccctgatggcggccgctgtcgccagaaaaggccaatagtgctggctggagcatcgacggacgtgatgggacgtccgttcgtttgcgagcggaataagttcacttgtcgtccctcaactttacaccgagattgtttgacatcccttatttgcaatatcagaaatcttcactcctatactatgtaaaaccgtgcattttaggtcctatagcagtatatatacctggttttgctgatgtggtatactagtcagcaaaaaattaaaaaaaagtatgtggggccacatgtaagtgagagaaaatcatatgggtccacctctcttcttttttttccttttctcttctcttctcgggcggcggcagatgtgggagaggcggccggcggcgaagcaggggcggcggcggcagtgggcggagcaggcgccgtggcgggcgagctcgcgggaagaagctgggcggcggcaccagcgccggaagaagctctcgttggcatcgtgcccgcttcgcctaccgccgccccgtagcagtggctcgctctcgaggcgaagcagcggcgatcttgccttgagacagagcaacggtgcgccggctgggcggctcggacgtgtgcggcggcctggccggcctcgtggtggagcgacggcgcggcctcgagcgaagcggtggtagccctggaggtagagcgacagcccggcgctagcccgctcgtcgcggcatgcacgatacttgtccacatataccatcagttgcaacttgcacgaatgcacgcaagaaaaccaatctaaccatctaagacgatcctaataaaatcagcaagctaattggttgttaatttgggccccagttgctgaggtacatgaccgtcgtcagctcctcgtcttgctgcttggctttcctccgtcgcggtcgcggcaggctgcagcgtgcgcgcgccgccgctcccgggcgcggcctacagcatgcatgcagtgctgctgggtcttctagctagctgctgtccccggacgtggagcgccgcatccgcgaagagcccggagttggacggcgacggggtgccagcagcagcagcacccggccgcgtctcccctcccctctctggccggcggtagggatccttgcggagccgggcgcggcggaaggcgatggcgacggggttatcgtcgtgggcgaggaagcagccagctgacgccggctgaggagccactcggtgtcgaagcggcggcggatgaaggcgagggaataaaagaaaagaaaaaattgttgtgtgttctacatacttttttaatttttttgggtatctatactgctatgggatttaaaatgcatgattttgtatagtttagaggtgaatttctgatattgaggataaaggatatcaaataaactcgatgcaaagttaacggacaacaggtgaacttatttctttgcgagcgcctaggctatcacccggctgggctgctatcgcctggctgggcttgctaataggccatgctcaggctgtactaacaggtggtttacccaacttttacgactggcctttctaatttttgttttgtcagttttttctgtaactttttatttgttgtcattatctttttgcgtgtttgtcatggctccaaaatttttcatcttcaatctttaaaaatcatgcccgtccgttgcaagaaaaaaaataaaaatatggtaatcattagatgattaggatttaattttcatgatgtcagtcctttagaaaaataaagaatgcaagcagtgggttatgttaaagtcagatcaccaattgtatgtaaataaaattgcatgcgaatagtaacctgtgcatccttttcagttttcaaccacttaattttctttatcagaatctgtatcaccaatacatttatctatggcgttctgacactactacgaaacactatattagtagtgctctcataggtaccgattcatttaaaaccggcacctatgactatgagtgcttttccataccaatgagcatgtttaactcgatcaaattaagaaccaccacctatatcacttataggtgttggtttataataaaaattgacacaaatagtgataggtattagttcttaaaaaatcggcagtcggttatttttttcaacaacacctatgtaacaagccgacctgataagcaacattgacgaaaatatcacgaatgagttgtgcctgcttggtacttatcttcaaactactccaccctatcctcttctccctctagccacttttctcttctccccttatcctcatcccctctccacctggctagtagcgagggcgacccagcgatggttagggcgcagcctccacgacggcagggcgcgggtggcctccacggatgtgtgtggcctcccttatgtcacgggcatcctagcccactacgaggtacggttggtggtctccacagcggcgagcggcgggcaacctcccttctgtcacgagcatcctccatggtggtgggcagcctccacagcagcgctgagtatgacctcccaatggcggctcattggtcacccagatccgcgcttcgtccccatcagtgtcgttctcttatttctagatccgtgtgttcttggatgttgatctatgcatgttttgatgcctctgtgttgttggatggatgggtggtggtacgtggatgttgataaatgtgttcttggatgtgggatgctcaggatgctctagggtgatggggagctgcttgatgagctagatttttttgattcatggacactcacaggtgttggttactaaacaggcatatatgacatcttctcattagttcccccttttgctggttgggaaaccagcacctatttagggttcccaaccggcacatatagggttttctgtgctagtatgatcaagtcctggaaactataaatgtattcagtacagctattacaccccacatgctcatagcaaggaatagaaaggcataacaaaggagcaacatctctagtgacttaaaactccatcgtggaacatgaaggccggggatcatagcacctaatccagtccgcgactacacttgctgcacttgcaattagcggaacatagctgcagattcgtaccaatggcttgctggctgagggggttggatggatcgaactggtaccagcggtttgctggagtaggaaaaatgatacggagtaaatctcagtagcagaaaatggcatggtggtgctgaagcatcggacaacagacaaaaatttagtacttgaggatgaacccaatcatggcgcatgggtccaagtgtccaacagttggtgccgatgcgtgcggtgcaggttggccttagtggcacctcatcgaaagaggcaatggccgttgccaccactgaggagaggagaaacttgaagacgtgtggcaagccccaattggaatagaataggaatggaaggaagtcgcagatgtgtagagttatctacgcaataagatgggcagccaaactcctgcttggctcactatgttgagatttgcgaacaatacagaaataggcaaaaacatcgatggtgctggtggtggaaaacaaaacaaaacacggatgcacacagacattgcacgtgaatcggtacgcccaatgcacacatgggacatcgcgctcttgcatggctatcagacgatgtagcaaaatagagaaatgcgggtgagcagaattggaaggacacgatgcaggtaggcgggcaggtgcacaaagcgcgaggcggacgtgaacgtgcacacgggggtaatgccaagtggacgatgtacgaaactataggcagaaatagttcgaacttttataatagtagagatatatcacgctaataatctaaattcttaaagggagtaccaccaccaccaccaccaccaccaccaacttttttctttaaaaaagaaagaacaatgtagaaccagaaggcctacatatcaaccatcccactacccacatgtctagcctgaacataaatcttatgcccatgcaagtgcaaacctctagtaggacatgcgacacagttacaggcaaagagatagaggtagtggaagtggaaaggctttcaattgacagaagatagaaaccctaaatcggatttgtgtaggctggcgatggctgatgcagcagggaggtcgactgatgacatgtgagataggcaaggctcttctatgaggacgccaattatgagggcactggatttgcatcctatgtgggccgagtgtaggaggagacgtggatgagggagatgatgagaggatgcctttctctctccacacctctgagagttagtggcgttgcttactcgcccaaagagacgacaagatgttttggttatatgggagttagaaagactaggactaggagttaagttgtgtgagagattatagttgggttgcatgggtgattgaagtgcggctgtgtgggagtcaggttatttcggtcaatatgtagtcacttcgactagcaaggtaggacgattgggttggtcaaacttagtttggtctttcagattgtaggcccaaactaatggccagagacgactgagatcaacttcggtcttttggggtccatcttagtttgttggggtctgattttgatctaccatttgtatgcacatccctacttgtattgttccttagcggatgagtgtgtgtccttggggcaggaagcataagactatagaatttttgacgttatactattcaccgtctcgataaatcattatttggatggtgttcatataggttgttcaatgtacatgtgtttttttccttaaacaaattgcataagacaatgtgagatttcatattaatatagtagaaaaaaaacaagataatagctctggaatgctataactagaaaacagaagaaaaacagccacgtcaaacacctacgatataaacacccacccatgaaaacaaataggagcatcacatccaaatacactcaactttatccacatcaatatacaggtttgggtactcaacaactaacacaaggtagacttgcatgggtattaatataatataactagttggcaccccgcgtctttgccgcaggttttgtagttttatcgtcaaacaaaatcatagttttaaatgcttaggtacaactctatgtatatataaaatatatgataatgtggatttatatatgtcttatgttattacaatacaattcagattttatttttccaagcgtcattgtgtattattataatatatgaatattattttcatccgcaatatgggtttcgttataattggacaatttgcatttctctactccacttaagttttttctaaaaatagattcaggtaacgatacctaataattatatgctatcttatcatgcataataaaacaaaacacatatattaaacaataatcatataataaacaataatttgagttgtattcagaaaacatagtgttattgtcgaaacatgaattcggcaataataaaagggggtagcgcacgagacctaaaagtggatggatgcagagacaaaggatttagacaggttcaggccctctcgatgagaggtaataccctactcctgtttggggatttgaatccgccgagtgtgtattgatctgacgatcaggttgtctcatgcccctagaggggctccctgccctccttatataggttgggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccatagtagcccctgagaccttcacagtgtaaaatataatcttctctcgaactagattactccaaagcggagtgcttcaatcatattcgccatggtctcccgggtacttttaccaaatttgaagactgtggagggctgaaaaataaagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaacatatagcatatgcggtgtgaatccccgaataatatgatccaagtgatataccgactgcttggcaaaatataatgcgtacaacctaaagttgacaacatttttgaaagttcacatagcaaaacaactataaagaagcttgaatgctgtgaataaagaaatttccaaagtattgggcatacgccatgcgcacactgctttaacacatgtgcttaagtccctaaaagacacatggtttcaccacacccggaaatatatggcatatgtggtgtaaaatccgagtaaataaactcataaaggatttaccaaccgcctggaaaatgaccataatatataatcagcctaagccataatattggtcaataaaaatacacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtaatatagaccaagcgtaactcatatgaatagcttctgatctgagtgattatcccttatgggatactccaaaatggatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtgtttgaactagtaagcccctgagcatatagcttgtccttctgtcgtagtcacaattgtccattgatggtagctgacgcagttggcatagagacaagacgaccaacatagagataatattgcccaccagaggtggcaaaaatattggtagtagtgaagatagtgattccaatcaaaagtgataaagttgcatagccgtggaggcgaagaaaccagttggcaacagtcaggtcagccagcaatgaatatgaaggcgcccagcaataaagttgtgtagccatggcagtgaaataatcagtcggtgacagacgatgcagctggtgaagaagatgaagatgcccattagtggcgacataataagccatccatgaaggcgaggataccggtcggtggtgacaaaagcaagccgacggtgaagatgtagacacgcatcaaaggtgatgacgaaatccaccaatcatgaagataaagaaaatagtcggcgacgacaaacgcaaccgacagtaatgatgataagcagcaatcatagatgatcaaatataatgacgaagttgcccatcaatagcagtagagtgggctatgttgaagaggcttgacaggatgttgatgaagataacaatgtcggtgatccagtcaatagcaaccgtgaaagtgaaataataagtcggcgaagacatagtcatccattagcaacagagttgatgtcagggccgatgaagcagaggtgctggtgaggatgtcagtgacaataatccatcaaattggtgttatagctgttgcagatgcttcacttggaggaaagtagatgatgttgtccatcttgtcgaaactgaggtgattggttgataactctgctctaaagcaaagacgaagataatgactcctggaattgactcgttggctgattaattgattgcttcagcttgtcgaattttaagagtcttgtatttgtgtagcccccgactctttggttagttgggaaacaactgaacatagagtcgagaactgtagcttcttgtcgtcgaatagtcattgcttgattgaagatatgtgttgaagatgtccaagtagaaatcatgaatgttggagagccacttgttgtagtaaaataacacgacattgcatgccgagatgttgaggttcacaaagacgtcgtggttggtgaagtagcaaaacttgcgaagtagcagcaatagagtttgccggtgccgaagataataaatatgaagtcgctctaccatgatgacaaagttgcatcgccgtgatgaagtgaacacgagtcggcggcaacagaagcaaactggtagtgaagacgcgcagttgtgaagataaaagcaccagtcgacggcggcataacacgagtcggcggcagaaaacgatgatgtccatcagtagtggtagctgtataaaccagacgtagaggcgagggcactagtcaacagcagacgagatgaccggcggtgaagaagataaggctaatcaacactggtagaatcatgtagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggtggccggtcggtgaagacgtagacgcccaccaacggcagcataataggccagccgtgcaggcggaaacaccagtcggaggcggcgaaggcaagccggtcggtgaagacgtagacgcccaacaacggcggcataataggccagccgtgcaggcgaaaacaccagtcggcggcggacgaggcggccggtcggtgaagacgtagacgcccaacaacggcggcataataggccagccgtgctggcggaaacaccagtcggcggcggcgaaggcaagccggtcggtgaagacgtggacgcccaacaacagcggcataaaggccagccgtgcaggcggaaacaccagtcggcggcggcgaaggcaagccggtcggtgaagacgtagacgcccaacaacggcggcataaaaggccagccgtgtaggcggaaacaccagtcggcggcagcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcagcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgacgatgtagacatccaacaacggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataataggccagctgtgtaggcggaggcaccactcggcggcgacggaggcaggccggcggtgaagtcgtagacgcccaacagcggcggcataataggccagccgtgtaggcggaggcaccactcagcggcgacggaggtaggccggcggtgaagtcgtagacgcccaacagcggcggcataataggccagccgtgtaggcagaggcaccactcggcggcgacggaggcaggccggcggtgaagtcgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgcgatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcagagacaaaggatttagacaggttcaggccctctcgatgagaggtaataccctactcctgtttggggatttgaatccgccgagtgtgtattgatctgacgatcaggttgtctcatgcccctagaggggctccctgccctccttatataggttgggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccatagttatgcacaaaatatgtaacagtgatatgtgtgacaataagtagagcaaagggaggtgaatagataactaataaatgattaaattggatgaataagtagcttcttgatccaattattattatctttatactaatatcatctaatggcttaaaattatcgatgatgtggcttgttgcatgtcttgctttattataggagaaaatgccccttagtgggtaccaattatatagaaaaagataggattaggaataatttttttcttaaaaataaagatgcgctagctaggttgtctcgccgtccatttgttgtagttccaggttcattgaatatgactgttcaataatagctcatttatggccagaaaaaaacacacatcagtaacctaagaa

SEQ ID NO: 79532 - DNA, 28563 bp, Oryza sativa
ccaggaaatgactctgtcagcctcaaatcataatttccaccatggccaaccgtaaaatgagtagtataaataggtactgaaggagactggaaaggacaaagatgaacacaatcatgagcaaagacaaaaggactccatggtgcaaattaacactatagaagtaaatgaggctggtgttctctcaaattctcaagaggcaggcaccctttgccaatagagagaatccacttagtgccactgagtttttcccacttctacaatctaccactgactttgtcaagttgaataatatgccatcgtgttttcccaaacatctactaagtgccatcgccatccacaggccgttaggatgcatccgtttagtgtattgatttttttcttaatgactaaaatacccttaccttagcactttgactgaagaccctagccgtgcaatccccatttgatctgcccagtgtgtggcagcgccgactcccatcgatggaaggccagccgcccgagtctccgaatggtggcgtgatttttcgggttggaatggattcaatccatgggttaaggtctggatcgatccataaatcacgaccaacccactcgctcaggtcatgtgctactagctgtgctctcctcttgcaggtcatgtgcttgctttctgcctcccccattatccatggcggcatggcatctctgctgctggcagctgccacgccggcggcagcggctatgcctactccacggaaacgagacgaggtgcccggtgccccaagggaagcccggactgctgcgtcgtcggcaagcgctacccgcggttcatgtggctcacagacggtatcggacatgcgccggcgatcccgacgctgcatatgtgcttccgccggaacatggagctggtcgtcgagctgtactccgggtctgggtggctgtgcctcgacgacggcggtggtggcgcacgctgccgccgctgcaacgggaggatccgcgtcgtcgtcgccgccgccgtgaatggacggtctgtcgttgtcagggtggtggacgagtgtgactacgtgaacgggtgctgcaacgaggacggcttcgcgcccccgtgccaggacaacgttggcggcgagtcactgactgtgtggaagaagcttggctcaaagagaacaggggcaaataggtctttttacagctctaacagatgtctaactaacggcttatggacagcgatggcactcagtagacgttcgggaaaacacgatggcatattattcaacttgacaaagtcagtggtaaattgtagaagtggggaaaactcagtggcactgagtggattctctcttgccaataaccctccatcagcatccattcaaacctttgaaataatgaaatgctgaacatacacaacctaatcccaattcccaaatgctcttgtatattttcaccccaacctatgtaaacttgttaacttttgtttcgtcttggtccaagatcagataaaatatacaaaatgtataccactaagaactaaggacagaagttatgccactcggaattgaggggtttgtacttcttttttctgcagaatgcgtgatttagtccttagtccttaaagaccacaacacaaatccaggttctacaaaaaaaccttcgaaacaaaaaattactctgtttcctgaaatctgctattactgtagcacctcattgtctatcaatggaatgatcttagtgaacacaataggaaatttcagaacatattgtttcaaccgattggaagttgatcaccgaacctcggaagattgagaaatcagtcttccccaagcctcagcacgcccgttcgccaccgcctgccttgccttccagagtgagagttcttccgctgatggaacatttatatactttgtccttttcttcttcactgaagaatcgaaacaagcccaaatcaatcagaaacatatctcccctgaactaaatcaatcctaatacaccccaaaagccggaaaacccaacctccagagttggacaccgttgacgacgccggtacggcgcccgtgggcctcgccacaccgtgcaggttttccaccgagctatcgatcacatctatcgccgccgccgccgtcgcgtctgctccccccgccttcgccgcgggagtccctaccgtcggcttccgctaccgtacacaccaaaaccaacacaaaaaaaatcagataaaacccctcaaattccaccccgcgtgaacacatgcaacggaccttcgcccgcttccccgaccgccttcgaggcgtggaactccccggcgaccccggccccggcgaagccccatccgtcgccggcgatgccggcttcttcgacgacgcccgccgcttcggcgcggcgctccgccgcgtatccaccatcgctcccccggatcggcgacgcgcgcacgcaaagggaagaggaggaaggaaggcggccgccgcgagggaccgaaccgtaatttcgcgcgccgagccgagacgataccacggagagaagaagaggcttggggttctcccctcttttccgtttaaggaacgccaggtaggtggtgcgggggaggagggaggcccgcgcttatatataggcccccgacccgcgccgaaccggcaagcggcccgacgagaaaaaaaccggtttattttaaagccgcagacattttgccgacttggttgtggtgcggtgcggtgcgttgagacacacaggcggggggacgttgacctgttgttgcggcggcgttgggtgatgcgtgcggctaccggcttgaccggtccgaccggtcgggtggtggggtttaggtgcggtgtacaaagggaggcgttaataattgggcgagattaggattcggattaggataaaacacacgcttatgggttctgggtttgatgttgctttcgggccgttcaatttgtactgtcttttctttttcctttttcccaatctttttcgttgatagactgtgtttgtctcgtttggacaaatgcccgccaagatggatatccctcgtcatgggattttctcacgatttatcgatcctgacctcgacttaccaagtacggcggacgctaccaagggtagttgccaatttttgccgacaatatcattttgtttttcagaaggtccaccttatattaaactttaaaacgtgaagaaagtgtttttttaacccctttacaaaataacaatttttagctatatgtatctggactaatattcgtccaaatgcatagttagaattgttattctgaagcgtaattataaacttgctctctatggagttaaccccgattcaaccaacgtgacgttgtggctatactcggtgctgagttattttggctttcggtggctagcgatgttgctacggatacagtttagtgatattttcaattttaaaaatggtaggtagatagcttctggacgtattcacatgtattcaacaccttgcgtcagtgtatcccttagctcatatgcaataagtaacgtgccgtatatatatactgctacaaagaaaaacattttatatatgttgagatattggtaccactttttcggtggaaagcaagaaacgtatactggatttcctacgaaggacaactgcaccttatggatgtatcacgtttgtcgacccacgatactttggaagtattaaatgtcatgtatatcatctttgttcacctattttactgtttcaatttatgatgaattgctaaaacaaggcatttattaagatatcatggcgttaatattcgccttctttttcgctataaaggaagaaacggctacgggttttcctacaacatgtagctttacactttgcgtgaatataaattcgcaatactctagaatcacgtcttagaagtaaatattccctaggtttaaagttttaatttgtgatgaaacgttaaaacttgacatttttttaagatatcatggtgttgatccgccttctttctggttggaaaggaagaaacgtataagagattcttgataacctgtagctatacacctagcacgtcacattggcaaatactacttaacacttaaattattttgtgccatatatatagtcttagataagttggttttccctagttgaacgtttcatttttgttatgaaaagtttaaacaatacaaattatattggtgtagcttctttttttaaaaaaaaaggtagaaacatctactatatttaatccagcttgcagctgaaattaatcacgtgaaacgtatgtgttgaaaaaaccttgtgctgatgcaccatgttggcatgtctgcagcacttcaagtatttcatgacagtagagcggaattttctcttcttctattgtattccttacaagaatgagagtttttttttcataggtggatccaggagtggtcccaagaccacccaaaataatcctagcccaatacatatatatatacatatgtgaaaataaacttaaaaaaaagaaaagaagctcctttattaatatattatgatgcacatttaatcaatttatacttctaattaacttggttatatttagagtatttaaaaagttataagtgttggatcacctatataaaatttcatcatacgcactgttgttgtgagagaaaaacacaaggtgttggtccgttggatgatctatctgagattataaatataaacgtggagctttttgcaaaaagcaaacctcacatagcattttccaagaagagaaaaagttccgaaaaacgctgaaaaaattgctccccaaagggttttaattgcggatgatgtatatcgtcttgaggggccggaaaagtgtgttggttggatttcgacttctataattaaccatacctttcattgcattaggatagcgctttaagtttggaagtaaattgttacatgtgacaatgtatgtgatcctacgagttatctgaacttccatttcaaactatggataggctgctgctaccgtagtattttttgaccaagttatttattaaaatataaatattttttatgagtaaattgcatattgggtcatgtatttttttaccatggtttcagactagataacttaatccaatgttttcactttcaactataatttgtttccaaaaggttgcactttgaaccagtagcccacctgtcagtgcctatctttcatctttatctctattcggtctccaccaacagcgtatgcaaaagcgacctcgagcgaagtagagtaagtgctagggcggatcttgagcttggtgagaacgaggtagagcttgagcaacccagaattagcaataggggaggttgacctcgacctcgagctaggatggtgcatctagggggtagatggcggcggatcctgagcgcagggtcaacgtcagcggagcctgagtaggtggaacccgagcttgacctctgcctacactacatcgcccccatcgcaccggtgggatcagccatgggctcgttctctgctagctttgtcttctgttggcattatcgttgtcctcttcccgtggcttgacctcgaccttgaccttgccacaatctcgaccttgactccaagcctctttgctcatgcaatccacatgctcgagctcatgcacaccgctgtgactgtgagataaaagagaaggttttccatgctttggtttttttttaaccctagcctacctgatcaatgggccacgagtttaaagtgtaactttcaaacacagcttactacttgataggctatgtttaagaagagaaataaaaaagatacacaaaacgaggtacccctccgtactcataaagaaagtcgtttaagtcaaaccttggggaatataaatcataaataactctcaagttattgagtttgaaaatgtgaaaattatatgaatagatttgtcttgaaaaatacttttataaaagtatacatatataacttttcaaaaagatatttttatagaaacaagaagtcaaagttgtgttttggagaccttgtcgatgtccaaaacgacttcctttacgagtatggagggagtaagttattagtgtgtaactaataattattttaaacctaaaaaatgaatttttaaaaagatacacaaaacaatttttctattgaaagttttttttaaaaaaagatataccgattagcagtttgaaaagagcgtgtgaaaaatgatgttgttttcttgtttttgtttaactctcgaacacagtctaaagtgaaaacactactgtgaaactaggatgaagaaaaacataacctactgtaaccctgtttagtttcaaagttttttttcatacttccaactttagtgtgaactaaacacagcatgtattttaaagtactactccctcagtcccacaatataagggatttttagtttttgcttgcaacgtttgaccactcatcttattcaatttttttttaaatataaaaaacgaaaatttgtgcttaaagtactatagataataaagtaagtcacaaataaaataattaataatttcaaaaaattttaaataagacgagtggttaaacgttagaagaaaaaatcaaaatctcttatattatgggacggggagtagtacgtacctggctaggcgagtacagtacgcacggagatgagaggtcgtcggccgaggcgtcatgatcatctgattgaaaaggtgcggcggaaacaggaacagtggagcgcaacatgcgtcatggttgtgtgtgcaaacatagcccaccaccgaacacccagctattttaacgctttttcggtgttgggaaatcgcgccgtctcccatcacggagcgttgcgttggagtagcagtatttggggcggacggtgtacgccagccgacttgaccagcccagctagctagctacaccaccacctgtagatcgcacgtgttcggcgttgttccatcgatccctgtactgctgtcaagagagaagagagtggagtagcaggttggtggggagtactgtatttatttactcgctgcgcggcgtggcgtcgaaaggcttgtcaatctgcacgtatcgtcagcggggaccgacgtacgccacgcgagtgtgcgcgatgaggtccagccccttatcgcttgtagttgtatcgcttgtgagagctaagctacgcttcctgaagtataatttggttcttctaaggacagatcgtccagctagtagtagctaactcccccgttttcaaaatactaaggacactgtataattattggttactgaaaaaataacaagccaccattttagcggcaataattgcattgaaattcgtgcaaactcttttacctatccctcttgtctacccctccgtccaaaaaaaaaaaataatactacctatgaacctggaaggctggacacaaactaagaattcgttttttgacagagtagtattccgctcttcgcatgcagtttgtcatcaccgcctcccctcccaagtcccaaccacgctagtcctcatgatcaccagctaaccaagaagcccaataacaacgtcgaggaaccgctgcaccttgcaagcctgcaattggcggattggaagctggcctacatacaatggaggaataagttcatataggtatgtcattttgtcatcgaatctgaaaggaaaaagtacgaattatgcccctaaaatatcatggtcggccgaattacccccctaaacttgaaaaccagatattattcaccctgaattttcaataccggacgaattacccccctcgaccctatccaacgcggttttgtcctacatggcgtacgcgtggcaaccagtcagcaccttatttattaaaaaaatatgggtcccacatgtcatactcatctttccatcttcctccctctcctctctcttctctcgcctcgtagagctccaccgccgaccagatgatgaggacgcctgaaccgtaaaatgatgaggacgcctgaaccggatgcccgcctcgtagagctccgccgccgaccggatgatgccgccgttggcctcctcctcgtcgtcgtcgtggcggcggtcatctctcctggcggcggcgccgccgcctctgccccggtcaccgcgtggtctatggtgctggccactgagcaaactcttgcggaacaagtcgagcgggtggagcgcccggtgttccttcgccggcggcatcttgcacgaggccagatgaacctcagcaccattttgttcacttcatactcgatgtcaccctttttcaagtaatccgttaatggtgagcttatagctagcaatggtggaagagagatcgatcaatatcaatggtgtccattaccatttctttgggcttctttgccggtctcgacggcgacgagcttctggaggaggaggagaggcaggtggttatcggtgatgagcatgtcgcggcggacgtacggcaccatgtacagcgcgccgtggcggccgaacaccgggtcgttgtgtgcgtatccgccgccgctgatcaccttcgtcgtcctcatcatctccagcagaccaccagggagcacccgttggtgaacatcaccggcaagaatctctcgccgcgccactcgccggcgaggtccacggcggcaacgaactcctccaccggcctgcgtggagatgggtgcgtggcggatgggtgctcaccgggatgcggcggaagcagctggacagacgacggcggcgcccccctgctcagctcgcgggatgaaggatcggcgcagcctgctcagcccgccgtcggcctcggctcctcgcccgctgcccgcagccgcctccgcgcccgcccgcctccagcctcggctcctatcccgccgtccgcagctatctccgccaccggccgcccgtcggcgtcgattcctcgcccgcccgctgtccgcagccatccccgccgtcggccgcccgtcggtgtctgctcctcgtccgcagccgcctccgcggccgcccgccgccgcctccgtgcccgttaacctccagcctcagctcctcacccgccgccggccgcccgtcagcgtcggctcctcgcccgcccgccgctcgcagtgtttagttgttcaccgagagagagggggaagagaaggagaggaaaaaaaggtgctgacagctgggccccacctttttatatttgtttttttcactgtatcgtcacgtgtgtgccacgtaagctgaaaaccgcttcgacttagggtggaaatttagccagttttaagtgtttgggggtgtcaaatgtccggtattgtagtttagggggtaaatcgtacaaccgtaatagttcggggagtaattcgtacttttttcaatctgaaatttatccctaaaacaaaaaaaaaggacaattgctcatttgaccctattctgaagtctaactactaatttgaccctaattttttaactttgcccatttaactctgctttttaaaatcggaactgccgtctgaccttgttttcactacaccgttaaagtttatttacgaaacagaaaataaatcattttatattctaaactgactaaaatgccccagagtacaaaatcaatcatatccccaaaattttcacccggtgccgtccactcatcccaggtcttctcagatctcaacggcgcggctagggttcggcggaggcggcgcatggagggggctgcggcggcggcgcgcggtgagggcttcggcggcggcggcaggacgtgcggtggtgacgacgcgcaggtgcagctgcgacagcgacgcgcaggtgctgctgctgcacggcggcacgtaggagctgcggcagccacaacacgtggatgtgggagatggccgtcgagcctgatccttcgggcatgccataactacatgtctacatgtgttttttcccttgtacagtttgagtttgatgctggcaaaattttatcaaatctaagacaatttgtcaaacctatatcaaacccatgtcaaaatttgtcaaatctaacatcgatttgtcaaacctagaaaaataaaaaaaatcttttaataaagtagggtcaaataagtaagagcataaatggcatttttgttatgaactaacaccgttacattgcctttacagaatagggtcaagtttgatcttcatttgtgaaaaaagggtcaaatgagcaaattttaaaaaacaaggtcaaattggaaattaggtatcaaaacagggtcaacaacacaattgccccaaaaaaaaagatataacgggttcctcaatttgtaaaactggatcacctaaagtactaggcgaatcagatgtggcaagctaataagtcagcgcgagatcattatgggcccacatgttattgactagcactttcctactactctcttcccttcccctctctcttctcctctctctccctctccctctcccttcctccctatcccctctagggcgacgaccgacagaaagaatgacgtgatgggtgacgaggagaagggcggtggctggtggccacaggagaggagggcggccaatatatcgtagagggcggcgcccaacgaagagaagggtaacttgcgaccctctctctcatgcttgaatgggccgagcttgttgctttttctacatcgccaccacggcgggtggacccttgaggtggaacaccaaggcgggcatggcgctgccctttatgatcacgttcgcaacctcctctgcaaaggaaaaacacatccaaaacccccctcccctcaacccctaagctcatgacttgaagccaggcatggaaaaccgcgaatcgacgcggtgcagcgagggttcaggatgggtgcgcttatcctttttggcgagttccataaggacgttggtggcgcgcttggcggcggtgcagtaggcatggtgccaggagaagcaccggtggagggcgccgacctgcgtgtggaccttgcttgggagtgctggcagcagatctctggcttgcccaagtcatcctcctcattgtcatcatcgcacgccgccctttcctcctcctctctctctccctttctgggacaacagctgctgcagaggctagaaggggagtggacattggtgccagacactagctacaggggttgggggaactgagcggtaagcaagcacatcggggtgggtggtgggtgggtaggtttggacaccggagaggcaaaggccagaatcccaaagtggggaggtgagagggttcgacggtggcggttggttggccgacgattgaggtggattgagtagagtggcgggggaaccaacgagagagagagggggagaaggagagaagagaggaaagagaggggtgtggtgggtcccacggcatttcttgttttgaagcgtacactcgctgacatgtgggtcccatatttttttttgataagtgccacgtaggcaccaaatcagcctaagccactgatcaaacgtctcgggaccttatttgcactggttccggagttgagggaccttaagtgaatttcactccgcaacaatttgagggacgtcaagtgaacttattcctacagtggagccctgtaaaggccactgggccagtagcttaccctactccgtgattccggggctctgggccgacaactcgatcggaccgaaaccagtggcccgttcggagtttttgaaggcaaatggagccgggtacccagccatattaatttgatccatgccactgcaaatttggctattcagaaaaatgccattacaattcgtctattcgtaactatgccattaaaatttttaaaaaactagaaccgtgccactcccgttacatttttcatctatcccctccttttccatcttctccgtcgcagcgcaccaccgccacctcagtcagccaccgcacgcggctgccgctgacagccttggtcgaggaaccccacgccctcctccaccggcctcacggcctcgtccccacgcaccaccgcttccttggctctagcgccgagaccgacgccgccggtgaggtgtggacgcgcagataggcggcgggagcaggagatgggcgtcggcagtggcggcgattaagctcggcgatggaccatgctgcgatccattctccgccggcgagttaattgcacgagttaattagtttcacaaaattgatctagcttccatgctacgatccattctccgccggcgagcagtcggcagcagcggcgacggcttcgtcgtctccgcttccgctcgcggcggcgtgagccggaccatgtgttcgccgccgtcgcgtacatgcgtacgccacctcgagcgacacaggtggtagccactactactcccgctgcctccatagctacagctgcgacgagcacagccggcgccgacgccatctctacttggtgctggatgactggaaggaggggtacagcctacacaaagctcgacttcagccatgtctccggcgacgacgccaccagttgcgccgacgtgtgaagccgcgcagacgccgtgcttgccgccgccgccgcaggttgcgacagagtcgccgatttcttcgattctccttttctctttctcttttcttcgatttcttctttcctggcttggcatggccggcggcgtgatgcggacgaagctaggcgacggtggcgcagcccgacgagggcacgacgaggttgggcggcgccacgaccttgcggtggccggcgaggtgtggatggcggtggggcgtgaccgcgcggccctgcggtggccggcgaggagcggcgcagcaagccgaggacggctcggcggcacagcccgaggccaacgtgcgacggtgcggcggagctcaaggcccaaggccgaggtgtggtggctgattgaggcggcggcggcgatccgtgctgcgcgctgtaacggagaagacggaaaaggaggggatagatggaaatcatgacgggagtggcacggttctaatttctgcaaaacttcaatggcacggttacaaatagacaaattgtaatggtatttttctgaatagccaaatttgcagtggcatggatcaaattaaccctatcagggagattggggtgtgccgtgagtgtggcttgcacggggtccagccagggtccctggtctcccttgatccagtaaacagacgacacgcggacgatcgccatcttagcaaagatacttcatcaagcaagaaggcagtacatcttctaaatgacgcagcctctgagagcgacagacagacaggagataacacaacgttttcaggacacaaatcgcggataattttatcggaactaatacgacacctgcgacgccggagcaaaacgacaccacaacagagcgctctagtagcctctacagcttaaacagactagcagtggcagtagtctagcagatacaatgggcaggaatcgccaaaggattctaagctagtagccaatagaacctgcttacctgcatcgacagcaaccgagatagcaacagaaagttcaagcctaattgcactggattagctaaaagattgggacatcaaccacagcttttatacaaaaccaggaggattaaacgtacgccacaacacaaagtaaaagagctaagtagaacatcatcatccacgaaaatgtcgtcacatgcatacatctaaaacaccatttttctgctgccataagcgccccactcttacttattcagttcaggacttcaggcgaaggctacctctcaccttcaggcgcggtgacctcacctactgggtcttcgccgactcgctcttcgacggctgggcctccggcgataactcgccgaaaaccttggcgatgcgctcggtggggatggcgggaaggtactgtgctccggtgtaacccttgtcggccgcggcggcgatcaccttgttgtacttctcggcccagtaggcggcggtgggcacggcgatctgcgccacctgcgggaacagcggcaggttgttgagcgagcgccaggtgaagacggcgaggtgctccgccgccggctcgtagcgcacgtagaggtccttggccgccggctggatcctgccgtacacgcccttggccacgggctcgaccttggcgtacgcgacgcgcgcggcgccggtgacgcccgactgctgcacctccgcggtgagctccctcgccacgtccggcacgccgcgggccaccgcgcaagccttggcggaggcggccttcagcgtcggcgggaggtgtcggtccagctcttgcaccgtgtcatccacctgcaatttatggttacacctccgttagcaagaacacataataatttctaccgtgcttccaaatacctacaagaattagcaccgaattctaccacaagcaatcctcagtatcaacttatgtattgccaagcaagaacacattgaaatcaaatcggaatcaatttaaaatgaacacgctgaactcaatttctaccgtgcctccaaattcttgcatcaattagcacccaaagctaccagaagcaatactcagtatcaaattatgtattgccaagcaagaacacagtgaaatcgaatcggaaattcggaatcaatttaaaatgaacacgctgaacccaatttctaccgtgcctccatattcttgcatcaattagcaccgaaagctaccagaagcaatactcaaaaatcaaattatttatcgacaagaaagaacactgagtggaatcagtcaaatggactataccaccacatttctaccgttcttcctaaattcctacaagcaccgaactctactgcaagccaatcctcaaagtcaaattctatattgccaactaagaacactgaaatcaaattggaatcaactttggagttcgtcggcaggttcgttgccaactgccaaactaggacctgttcatcacctcggagactccgccaagtgctagaatgcgccggaatctaataaggaatctaccatgggggccggattcgatgcaccaccacgggaatcccgtacggggacgaattctccaccacagattgcccacccctgtaggccccagctacatcacgcgcaccaagaaaatgaccacccacgccatcgtagggcccgcgtcggagcaatcatgcaccgcacccgaaaaaaatctagcggcgccagatagggcacggcgcccatcccgttctagcgtgcgccgccgcaagcgcggccacctcggccggcgagcgagcgagcgagccgcgccaccgctcgttcgtctcgcgggacaacgccaagtcggcaaccgttagcaacggcgaaagagggggctggggctaccttgcggtcgacgaaggcgaggacgtcgagggggacgccatggaagcggccgtagacggggccgacgacgcccttgacggcggactcgacggcgtcgacgccggggcggagcgggccggcgtggtccttggcaagcgcgtagagccccgcgaggcagatcgtcgcctgcgctgccgccacctgcacgaactccaagtacctcagcttcggcctcctcaccttcttcaccttcacctccctcttctgcaaaaccaaaccaaaccaaaccaaaacccccaaaatcggaaccaaatcagcaccaaattccacccccaaaaccagcatcaattcgaaaccaacaagccacaacgaatcgcgcctaccacttgcgggttgggctccgccatcgccggaatcgaggccgcgagggtttcgagaagctgctcgggaatcgggggagacgaagacgagacgagacgagacacgattttccttttttttttcttttctttctttcttactttcccttcaagcggggaggaaacggaaggatcgggaggaggtgggtatataggcgacgaggagctccgcacggccgtccgatgcgaggggtgcgggtcgatctgggccgttgggacgcggccgcgagaatgctctggagcgggtccgccacgtcgtggctcgcgtgagggacacgtggaggcggggccctgtccacgtctcctacaggcgccatcttttactcgttgatctgtgtgcgggatggttgaggatggacggccgaggtgggtcatgccggtgatttgctgatgtcgattctagcttctagaaatttctatcaatcatttgtgagtgaccatggctagcttgcttcaacattaagctgcagatttgaacgattcagttataaagcaacgagtatgcatttgatggtgttcttttctcaagacagattcttcggggttgttcaccaatgacttgacggccgcggtgccagcacaaggatatcgatggaaagaagtaggctggtgaaaacgcaggccggctagaagtagtagtacttccgtagccggcacgctgatcaagaactgacgtgcgtgatgcaaagaattctcagctgctctctttcctcaatggccattctgatggggatcctgaactcagggagaaaatggtttcacatcgctaaatacatcaaggcgctccaggcaggcaggggaagtgaggcacagccacgctagccgccaatctcctgcaggtactgtcgggcagtgccaggacaacctgccttgtgttgtcaggggaaaaaacatccatccgcgcatctagatcggatccacatccacttcaatagaagcatactccgtatacagtatgatcgaaagaaaaccatagttcgcagttcgcaccatacatttcatggctaatcaagaactattaatctcagacgttgagcgtgaggttccatccaagcgaatgcggcacataacaaagagcaccggcgttcagcatcagaccatcagttgatcgaccaaccatttttaaattaaataaaacaataatacataagaacatacacaacaatcgttctagttagacgcctttgtcgttgagcttttcctgcaaacagatacacttattgtatttgaccccctttaaataacggtgcagacacgagcacaattagctacagctgcacaacctctcgtacacaacgaatgcaatgttagccactgacagctaacgcctagcaacatcaggtaggagcatactgttgtacaggcctggagttgtttgcctgaagcaactccggcttacgagctatctagtgaaggccgccgagtcttggtctggttcaatcgttatactagggctaagaccatcttgcatctgctgctcagatccctgtttgcagtacgaatgttagatctatcaaggaaatacataaaatcaagtccatgcatcagcagtaaaattttgctaacaagtacagtttgaaagtttaaatgccctttgaaaactcttttcaaatttaattcaatttataatgaagtttattgttccgaaaagccttgcaaacaagcattccatgtatgtcaccctaaaaactgtgtacctgctattcttgccaatgttcaatagctgaggccagacaactaatcttgtccgtagtgatagtcccagagaggactctgtaatgcaattaaacataactattggtaatcaaaatacctgtaccaacttattatcgcacatttgcatatatgtgtttcgattagatctcgcaagtaattcaggtaagaataccaatacttctgatgtttactccttaaaaccaataccatcccccattatgatattctgtggctagttatatgtacatgtgtgttatctgcaatatattttgtaatcatgtgtttctttgcatgtgtatactgagtatttgtggaacatgtattctttgcatttgtgtcgaatggtgggcccaacccccattgtttatgtggtcatgtatataatttctaaaattaagaataataattattttttccatattaactcttgaacttgaagtatatttatctcgcgtttgttgtattgtgtaagcacattactaacaagattaaaaagcccagagtaagcaattatctaaccgtctccatacagtcaaatacagtaggcagtaacataggtacttcaagtacaggattatgtgccttgcaggaaatgagacataatatggtgatttttctggtgttgccagtgttatgcaagatgcagatataagcataagatgtactgcatgaaaataaatattaaacaaacatccccgttgttcttcaaatacctaatagaaaacaacttacctgtggctgcaaagatggtaactgctgctgctgctggtcttgttgcatcacatatggttgtggttgagacagcctgtagtatggctccttgagttcaagtttggctgtggatgtctgcaggatgccaccttgttctgccccctcaccccacattttagcttccagaaaataaccaaaagagcaagaaccatcagcttcaagtgcaatagagggaaaaaaactgataacaaacgaaatagaaaatgcccaacctgacatcgtcaagtatatcgtgtagctttgtgcactgtgggctaccagatgaagtcgtcctgttatttcttgtcctgccatgacatataatggctgtgaaagtatgcatcgtagttgataccagtgagtcgtaggggaggacctggagcagtggtaagccacctctggacagtgctgcagtaaaacacacagattgtagcgggtagaagcagacaagagacaatatagactcaaataaaccgatatagcactgacctcccattgaacaatacatcaaaccaacaagctagcccatgcaccctagtgccaacagaggccacaaaatttaggggaatgtcaatctcgtaaagctcctcttcctggcaaagaaagaaaagaatgcttcattttgcagggagaaacaatacagaaaaattacctgtagtttcagtctcatcaccaataaagaaatatttaccttcatggtagtgaaatcaagcgtatgaaacgtaggcggagaaaccaataatcttggatcgaatgcatccaccacaggctgcatgagaattgcaggggcgtttagatttgataactagtcagtagtcactctgatcaacaatgcagtcatgggttatatagaattacttaagtaatagccattctcggggttcaattcttggcattaaccactggaactggaatacaggtggctaattgaaagattaggtgccagtaagagtgcattgaactatttattgttgtttttgaattgaggtactttctagtcaaaagttgaaaagaaaagggatgagatacctgtgaaaaatacccctggaatgctgaaccatgcaaaggtgtaagatcaacaccaaaaaagttatgctgctgccagaagagagcctgcagagacacacaaccaaaatataatgtgtcaaactaaagaaacacttaggattgaaataacatactttcagcaaggataatatacttgctcaacaacatgagaataaataggaagtgaccacaaggtggctttaaccccccaccagcatcatcatacgaaaatatgagattttcgcatagagcaaatgatgtgctaaaaacacataaaagctaggaataagtgtgcattttcttttttcagaaaatacacagaagagctgcttatctttgtgttaagacaaggtataagtgggggaaatggacacattctcactttggtactgtgctatacagttgacagaaagcatggacaagttgagaattcatttctcaatatctcctatttaaagaaccagggaaattttgaaacagtaatatctatatataggatgtcagatgttatgggcgttgatccagagatagggtaacggtccaaagatgagaataaattgatagttaccccctctgtcccaaagtataacaacctagtactcgattagacaccacctagtactatgaagactgtctaggttcatagtactaagtggtgtctagtcgagtactaggttgctatactttgggacgaagggagtatttcattactttgtgttcaataaattgcaagttgtatagtgtgtatctgaactcatcttacgtagttgctaggtcaagcgcgtgaacataaacatatggtgttacagtttgatgttctggacatttccgctccaacaagttccaatgtcatatccatttctggcattaccattttgtattctcatttcaagaaaaaaaaagtatggtttcggacaacagttttgaatattttcgattcaattccaactgttttcacaacccacttgcacatagtaatttacaacaaggttagtatagcctcactagaagcactggatagtaagattgtgcagtaaacttaggaaaaagatttcatcggagtgtaatactgtaccttgtttgccatttcaacatagaggtattcatcggaaaatggagccatatgaatcctagtaaatatttaatatatcaggcatcagtgagtaattgtgaatgccaaaagtagcttaaaaagccatgcatctgagtttattttttggaaaacttagccaatagatctattctgacgttttagtaagcacagatgatttagtgaacaatcctaatcaaacacctaaagattttgtgaagcagaacttccaataaatatccagagtggttcagattaccttccagttgttggaaacattttaccacctggcacaaggaatctgtctctagctataacataggactccagcatcctttcattcaccaagagggttcctaaaatattatagacaaaacaagtcactacataatacatataagcagatacagaaacaagtttattgtcctataccaaatttcaaaattcaaacaacaatataacatttcaaatattagctagtttacattgggtattcaactattcaataaacaccgtggataccgcatatactatcaccatttggccaatggccagtgcttaacccatacaatccattaaaaggaacattgatgctaacaacggatagtttgtctacaaatatgacagccaatttcttgacaggattaacagatggcaatgcaacctagtacttatccgtcacctagctgcaaagtgtgaaagttatccatatgtatacaaacacaatgaatcggttattagattgtgcaacgggtataagatgtaaagcaggaacaccacaggtgactctgggaaaagaaatgctccagaaagtttatcattgaggcatacccataggctccgaaataagtatgtcagctttctctggaagttcaacttcctcaactttgcctttgatgacctagttatgatggggacactgattaattttagggcaaaaaggaagcctggaagttccaaaccaaactggcacataaacgaaccgttattctttgtccaagagatgggtttccagaaataagacgctgagcatgttcagccatttcagatgcctcaactgcatatacatgtctggcaccagcctgatattaacatataaaacatcatctgttattttgtataaaaaacaagaagttagaaaagtcatggagaatgttggagtgtacctgtgcagcaaataatgaaagaatgccactaccagctccaacatcaaccacaactcgaccctcaaaatcggatcgattttccattacagcagcatagtatgttcctggagtaaaaggttgtaaactaattacatatatacagaaaggagaccttcatgccattattttaactcttttgacaataggccagagatactgacctgtcctgacaaagtcttgcaacatattttgctgatgtaataactggccatagtagtggaaatacatctttgctgatgaggcctcaatttttgtatcaaatttgcttttagaaccaattattaatccattttccaaaggttcacctgccatgaagcagcaatatgttgaaataagaatctatggcattttacattaaaaaaaagggctaatgactctggcttcactgttggcataagttttgagattaacatgtcaatgttgtcccttagttgccactttgcttcgtcacaaataacacttttgaaaaaggaaacgaatacaaagagaagcacaaaaaggtgtgctacaatgagcatctcataaccaagttctaccaagagaaatgatgcaaagtattaatgtatgttctccaaaataacatgcattaatataatcatgcatgatgtaatttgatttcattaactacagttatccttcaagaaaactggatgtgcagatataaagcagtaaacatgctacttctacaaattcctaatagcattatttttttatcagaccaggcacgaccaaatatgcaagttaaatggcattatgcatttcattagatagtagagcactagagctagcagaatatatcaaaccaaagtgaaaaacattatctagtcttaaaaacacttggtattgaagggcagctattggcacttaaagaaaaacagacatggagagctgtaattgactatatgcatgataatctgaaatttagcattgagaacatgggccgatgactcagaaataatgcaacaaaatatgctactggaattatctgaaacaagaaatgaaaggacaaaccagcttttccactaatcactcggtgtttccattgttgaaaagctaaatagaaggctttgctctcagcttctgtcctaagaacaaccttaattgctcttgaatatgacttctgcctcaaagaattgagagttaacatgaagccatttaatatgtgctacaagaaagttccaacagaaaaggccaaacaatgatctacaaattgtcatattacctttacctctaggcaacattatcagaaagtctatgcgatgagttatttagcagatggcaacaaagaagtgtgacacagcagtcagcaggaaattcacctttataacgtaacaataggcagcagactatcaagagttctataagtcagactttcagataggcaggaaaattctagttatgtctcgcatctcacaatcatagagcatatcctttgcagtttcagaaagttgcttttagtacatataggatggtatcgagagagatcatatcacactccagcctttttctttaggtgtttcaactagtatgtgtctaagactctaagttggatttggatgaagatatgacccccaaaagaaagagtgttccgacaacaaacttgaatgcaaactgtgtcatgttattcaactagtaatatcaacatcttcgccccagatttaaaatgtcactgaatcttcttttgagccatcttttaaaagaaaaatgttggtatgcctctaccgtgcaacaattaaaccttgagatcatcttaaaattggcttgagcatgatacagccatacaggcatacagctcaaggcgtggtatatcagggaattggactggttatatactggaaggctcagtgcacatcagaaatatgaaatccaacagaggaatgtacattatgaccaaacgaaagcacataataactcaaaaaaacagcgaaattactgaagagtacctcctccacaccgtccttagcctccgactcgccgctcacgcacagccactccgtcggccccagcttaaatatctgcaaaactcaaaatctcatcctccaatcgcacggcaacagcagaggcacctctcagagccccaccatgaaatcgaatcgaaccaacgcggccacgccctacagcccaacgcacttccacttctacttcccccataaaccatcgagatcacggaggaatacctgcgcgtcagagagatcgatctcgagcgtgtgcttcgcctgggtctccccggaccagacgaggctgaggcgcggggccccggtggacgcgtccccgccgaacacggccgtggcgccgccggtgacctccgtcgacgcgcccgcgacggcgggtacggagacatggcagaaggagacgttcgggaacaggtccgccgacgccattggggccgggagcttcggatccgggatgccctagggttttgggcgcgccgaggcgggcgacgcggggtggctagggttttgggcggaggcgcgcggcgtcgcggggtgaaggagctcgctgtttgtacgcgtgggtggagtatgcgtctgccattttctaataaatatttttatttaattcgagagagaagacaaccacgccgccaaagtcacggtgacgcggtgagttcgaatgaggctttcttacctttgacggcaggtgggacccaccgcttcgttatcgatgaagggccccacgtgtcagtggcgaatgggaatggtatgatcgtacgcataacgacggaccatagttaaagccgtcgcttttttggctttttacggagaatgggtgaacctttggtactgacatgtggggtctatactccaaagtgctttggtccacagatcatgggaatgtattttgggagtactctgaacttttggtattaattgggctcttgggacttgggccacttggattcatttgttttaagcccaaaatttgctgggccatgactaccaagcccaaaattctctactgtacataagttgcatgtcctatattagtgtaaagttataatccattaatcataaatcttaacatgtaaatatatcacctcatcatccactagcataattacatataaaacttatgcaaacatgcaacatcatctataattctttaaattctacaaatcaacattcaatcatcttccttcacattatttttcacaatatttttaatatatatatccatcatttttataatccttaacatatattcatctatataaacaaagtgcataatatcatattttatctataatctcatatagagtctactaaatgtatttctccttaaacatagtttgataacctgttttatttattgttaataactaatatatattttattgttaactcgattattaaaataatattaaaagttacttagaaatttacgcagcaaagcacggggaatcacccagtgtatttatataagtgattgtgtgcacgttttacatgagcttctgcatctgtattttgttttgctaaaaaaaagattatgttacgatcaaattattatttattttgaaacatgtacaatcgtgcaaacatccatatacacacgtacatactcacccatataaacgctcgtattcatatagtatctctacgagcacaatcaaccagttgtatcaatatatcttgaaattgatgaagtaatcatatgtagggtatgatcgtatacaactgagatgaaaatatacttatttgtataagatcctcatcatacgcagtggttaacttccaggcttgatgttgagtcgatgtgccttgttttcgtattttccaactgttgcaactaactgttctgtcaaatatcatagaaacggtaaacaccgcgatccaaaaaccatcaaattctaaactccgattacagttaagctgggtgtatttatctgcgatgatgcaaattgagacaagtactcttttgtcatgtaaagatcatatgggtcttctaagatgggctggaccaaagcaaactttaggtggtgtttatttatgttgaagatgaagttaggacactaaaaaaaaaatcattagcacataattaattaagttttaattattataaagttagaaaatgaatcttcatgataattaaaagtaacatttttataaaagacatcgtttaacaatttaaaaagtatactaatggaaaccgatgtaaagccctaattgttttattattttgcgtgcgctaacttcatcatcatcttaatatatctcaaatactaattattagtgcataattattaattttaattattataacttagaaaatagatttatttgatattttaaatcaactgatgtatagacagttttttttaaaaaaacacatcgtttaaaaaagtgcttaaaaaaccgaggtaaaatctatgcatcttgatcagaaaagaacatggcacacttttgtttggtacggaaattttctacatagaagttatttttaaatatgaagtaaattcattttaaatatgaaataaatacatttttcaaaacgtaattaataatactccaatgatttcaaagtattttcatctgaatcaaacggggcccgtcgtcttctttcgtctccactctctcgtcgtcgtcggtctcggggcccgacggggtctcgacgccgccttccatccacggcggccgccggtggcgatctggctcctcctcctcttcatccaccgcgcattacgttccgtacaacgagagctctcccttccaccggcctgcgtttgcatatccatccctccgcccgccttcctcgccgcgatccaggaggatgccgccggagcaagccggagacctcgccgccgttgtgagcaaaattctgacacatttttttggaagtaacattacttaggtttatcgctagttagtcgttggattgcggctattcctcgctagttgtaaaatactccgcccgggggggataaactttatgtcatctgattgcaactgtaaatcctctgggtaggcgagttcaagccgattcaacaatgccgccatgggaggagcagcagaagcttcctcatcagagagagactccatgaaagggcgcacaaagaagctcctagtagataaggtatacctagcccaatgatcggatctgtgcaggggactccacgagcaagcgcgcgtggcttgaattcactcctgaaatcgacgtgctgtgctaactgtagcctgtaggagtgtagggggtagaggaggctggtcctgtgctctcttatctagcagggtggctggtgagggttagttcattctttgatgtcccccaccatcctaatccaaagagaagctatgctaggttattagggaggggaaacaccactgatgagatatggagggagggggcctggcctccctcctggctgtccctgttcttgatgtgaagaaaggggcaccaatctctgacttgtttctgcctcagcacagttcattcccctcacaggcatgcttgcacctccatcatgaaagtgtccctcctccctcagcctccccttctttggtcttttcccacctttatgctgtgctacaatgagaaccgccgtcgctcgcgcacccgattggcctgcgtgagaatcgactcacctccttcttaataacatcgatatgatagcctcctttcatatccagctttttttaatgctgtgctacaatttagtttaagttattgacttttttttttgctttacctttggtttagctctgatgtatttctccaaaaactttaggagacatggaaacaggagatgcttgcttgagaatttttttgagatattacgtaatcgctagctttatggtgatgctgacttgagtgaactatactagagaacatgaacgtggaaagatatgccctttttaccttgaaagaagcagattgctctgcttgcctaatgctgtgcccactaagaagctcaagaagcatggtggatgcattttagtgtttggtaaaatgtcgaagctcaagaagcatgtatgtataatagctgctgaatgtttcatttcttgcacatgtggctattcagatcatggaggatgcaggccactttgaaggggttttttttttcattagtttctgttgtggagcgagaaggttagatagatctcacaaggacaaggagaaagaaatctggggatatatgacaataatgatattacaagggatccaataactcatctttcctgattaatccttacaactttagcaaagaatatgtgcaccgtttccccttttttgtgaaggtagttaatagacgaagagcagggggcatggcaccaccacagggagtgcaccatatgcggcgagcatccgcatactgtaaatgcatgcctttaccctgaaatgactagataatatcataaagaaagtatgatgcctgggattgtcacctacgcgtttattccatcgatatcaccttttgaaaatggctaggggtacggtagaattccgctttctattgtgataatgtgatattcaattgaaaggaattggtatgtgaaataatctgcagctgccacctttgtagcaggtgtaagtcagtagagctcagctgatgtactgatattttgagcatatgcatgcgcaggctctttaccttcctgagtaacctgttctttttactattgaatcatccttggatgcttcaagttggggatgcacctagtatggaatttggtgtttgtttatagccgtatgttttgttgattcagtgaccttgggaccttgcaaactaaggctagcattgttcccttctaacgccttatgttacacgaaaccttcagatgctgttacaactttcctggaataacttttttagtgtacaaaatatgttattgtctccagtattatctactttactgatgtgtttcattgtgtgcgaccttgtaccacggcagtgtattccttagttgcattattgacaactttatcatgatctgacaaatatcattattgtgtgtgcaccttttgcctcatcatcttggtggatgttttttttttccactggaatattgtttacctgtggtctatgtgctttgatttgtcattgtcagcatctccatgcccagttccatatgaaattgcagtcaaaagagttcacatttttttttgcatgaattaaactttgttctgtttttgccagcagcttcatgcttaggtccatgggattgtgtggcaatgtaaacatgtttttttcttctgtttactccttttgaccacaatactaatattatgatttttgagcattgtag

SEQ ID NO: 79533 - DNA, 767 bp, Oryza sativa
aataggacccatcccatatgatattgtaaaacaatgcaatatttaatagaaatgcgggacatttgtaaattgggtacaatatgatcaattgcaatgtatgacttgccttgctctcgcactgatggaaccacagcaacttcttcgagaaaccacgaatcgacgaaacgggcgaaatctacgcgaccaacaaagcacacaagcaaaacatgctataagtctactgaaacaggaaacaaaaccatttttaatggattctatacatttttatgaatttactgagacttaaatggacttaatcggagctcggatgaattacttatgatttttagaagattatctgtgtttttactaataaagaaaaagccttaatgtatttattgcgcaatattgccctagggctgacgtcagcaaggggtggggcggcgccgacatgcggaccccactggtcagcagctcaagggggagggaggggtactggcaggcggggcccaccgggcggcggctcatggggaaaggaggaaggcggcctggctcggctcggcttcaagccggccggccggttagggcgagggcggtggcggcaagcggccaccgacggcggtggccggcgagaagacggcggcggccggcgacgcgggcgacggtgcatcgcggcgacgcgtatgcggggagcggcggcgcgcgcgggaggaagagagagggagttctcaccggggttcggccggcgcgggaagagacgacggcaacggcgacggtgagcgaccgaa

SEQ ID NO: 79534 - DNA, 2019 bp, Oryza sativa
tttcctggaatactttttttagtgtacaaaatatgttattgtctccagtattatctactttactgatgtgtttcattgtgtgcgaccttgtaccacgcaagtgtattccttagttgcattattgacaactttatcatgatctgacaaatatcattattgtgtgtgcaccttttgcctcatcatcttggtggatgttttttttttccactggaatattgtttacctgtggtctatgtgctttgatttgtcattgtcagcatctccatgcccagttccatatgaaattgcagtcaaaagagttcacatttttttttgcatgaattaaactttgttctgtttttgccagcagcttcatgcttaggtccatgggattgtgtggcaatgtaaacatgtttttttcttctgtttactccttttgaccacaatactaatattatgatttttgagcattgtagatggtctctgcttctggagagtggagactctggttagcatcagtcacttgacccactacaaataatagaagttcctgggatgaagaaccaataactgtcagccacaaccctttgtttgcattcttattacctttgttacttagtctccgctagattatccatctcctttgattgaggttaatcatgtccttttgatccaactggtttaaaagttacaacttttcatctaggtggtgcatttgttattaatttgttaaccacaatccatggcatggtactattcaccttttcttgatacataaaacatttcattcaaaaaatggaagtggatcaggtttacacttttgtcactcacctctcctaggatcttcaactcagttctagcttttccaacctattttttctatcattaccacaaaaagattgccctttacttactggttacccaagtatagtgtcttttgcctatccctacatgcctcatgttttcttcatggctaggagtttgtagtgatatttcaagactagtgcaaatatttcatattttttcttcatgacaaaggggaccttcttaaaggtacatcgtgagaaacaggtggagttctgcgtcacacagcaaagcaaggcaatggataatggaggacagcgtcttgatataatttttaagttttcaacatattatcacatcacattacacttttcaatagaacactactagagggagttccataaattgagacactgtcgtgtccagaaagatagcaagtggatcatcttgcacaggctgcaccgtcgtattggttcagaatctttcaaataaagtcgaaatattaagaagatatgcttctcagaccatgcatcaccacactatataaggggcaaacaagctcccagtatcgttactttgagcccccgcctccccttttgaaataaggttgactgtaattctgcttttgttcgtaatatggatgatcataacttagactacaagggaagtggtgctcttgaagagcttgagatgttaacagtgaatgccaaagaagcccaagagctcatattgacgaaaatccttgagaggaatcaggctaccgagtacctgagcaaattcatgaatgggtcaacaaatatttctgccttcaagagacatgttcctgtagtaacatatgataaggtacatccatacattctcaggattgcaactggtgaggaatcttcaattttatgtggagaatatatcttggagctgcttagaaggtgcgcctctcatttcaatgcattcatcagttcacatctctttcctgtgtatggtagagatagtagcaaccaacatatattggttggcaatctggcaggccctacatgtacttgcctttgatagaagttggttttagtgcacttggtggttaatgggagaaaaataagttctcttggtacttgctaggctgctgttaatgactgtcataaatccagaggcacagaccgagcttcgcttaggaaaaattgtttatatttattttttggaatgtgctaggctagaaatgactggtcatactaagctacttgc

SEQ ID NO: 79535 - DNA, 581 bp, Oryza sativa
  unsure (1)..(581): unsure at all n locations
gggggttgcaaggtgcggncggcgcgcgtgaaggcagtctggggatttcgcgtgggctttagtggattcgggcgcttttgggattattttcgcagctgcggggtgtcacgcaggcttggctttgacgaggaggaggtttgttttatcgttttgccccgcttttgattgcgggacgagttcgctgagccggaggaaggatgcgaaatcggtccgccgctatcgacccaagttgttggggtcgtctccgtggggccctgttgcagtgagagaggtacgtcggtttttcaaggagtactccttacacaggatcgcagaaacctatcactatcactctctatcagttgtgcggttgtgccatcttttgggggctgtgttgtaaatggcctggagggaacaatatgggtagttttgatgggctttctaatgggctctcaattacccgtctacccaattaaatttgccaagaccatcaaattggaatagctccactttaaccccctcaaatataggtctaatctaattcgtatatctcaaccgtaatgccggatcttgaccctccaagtattgatgaacgactgtac

SEQ ID NO: 79536 - DNA, 11344 bp, Oryza sativa
aacgggcctgtagccaaaggttacagtgctcaagtagcacctctaggtcctgggttcaactccccatgggagcaaatttcaggcctagtaaaaacaagtcactcgttggccgggcagggacctcaaaccacaggttaaggaccgatccatagagggcgagtccgcgtgtgtggggccagggtttgtggcttttcttggccgctttggttgaggcttcttctaaatgaaaagccgtgagggcggtcattcccctgccggtcgaatttttttaaataacaatctgtttaagctattctgactcaggatcttctaagtgatcctctctatatggaaggaccgaagtaattagcaaagtacatacaaaatgcagaagttctattaccaaagtatgtataaatattttctcttgctcctacctttgaggatataatttttcaagaacacacagaagagatgtgcatattttgcatcaggcagaagaaagagtaagaaataattcccattaggccagacccagaatatactcatcataagcaaccacaatctatgtaaacaactagggcccgcctgcaaaagaatagacaacaagttgccaacaaaagtagatacatcagtttacaaatatatcatctgcttcttgaagaaataccctaatgtttgatccatgccctataatatatccctctttactgtcattaaagaaattactgttaatattaggccttattgtgtttaaagaatttaatacagggccttgctattcacttagtgactgtgcttttgatgctaattacataattaatttgtagctcggggacttctcgaggtgagccaagattgatgccgtccatcttaaaggatcttgaccgtcgaacctacctctatagtctgatcatgcctatcatgaacaagtaagtttatatcttcttatggaaatattgtgatgtggttatgacaacttcattattgtgtaatatctggatccagttgtatgcctaatctcctttctgcaattttctaaccttcttattcttgcaaaagtaatgagataagtagttaattattgcattaaccaaattttgtttttgtttgcctcaaacagatgatatcatttgtgaagctctgttgacactgaccctaaaattgacagatcctgagaggcgttgttttgcatgcttcctgtttgacatttttttttggattattcacattagtaacacaacctgggtccagtactccagttgcaagacgcaaagtattggacaatagttaccgcatatgccactgcttgcagctcaaaaacttaaaaataagttcatatattggttgctgctttagcaaagtatcaggcaatgccagatatacatttgctacctcataccacatcaagaaaccaactgttatacacagctgttttggtgtttctaaaatccacactattaatgcttccaaaggtaattatgtttaatatggtacctgaattttggactaaactgaatggcaccctcagatgcaacttagctcaaatgcttttgttcctgactgtattaatatccagtacataaatttgttagatagcaccatagcagtagcgcacagatatatcttccagagttccaaaggtttatcaagagtttccagacagatttgtcttggactggcaatttatgtcataatccaatctgcaggtatatatcaggccttggtgaggggaaagctatgtaccttctctttgtgaaagctgaaacactgacagattctggaattccagttcgatcagtcctcactagctactataagagccctcatttccttcaccgcaaacacgatttatacaacaactataccagtcctgatgaggtcattctttgccctgatagccagcagagcatgtactgccagctgctctgtggcctggtagaacgccagcatgttcttcgtatcggggcagtctttgcctcagcattccttcgatctatcagcttccttgagcagcattggcgtgaccttgtcaatgacatacgaattggtcagctcaactccagtatcaccagtccagcatgccgtttggccatgctgaacttccttgcattgcccaacccagagctagctgatcaggttgaggcaatatgcagctgcggttcatggaaggggattctgggaaggctatggcctaatgttaaatatatcgaagctgttcttacgggcacaatggcacaatatatccccatgctggaattctatggtggtggtgcgattcctttcgtctgcacgatgtatgcttcctcagaaagctatttcggtgtcaatctgagtccactatgtagcccagctgatgtgtcttacaccatcctcccaaacatggcttactttgagttcataccattagaggacggcctcaggttgactgatcacgaggaggtgatagagaatgacaagcttgtcagcctggtagatgtcaaggttggatgttactatgagcttgtagttaccacattttcaggtaagaacactgcagttatattacggtattttcttggactaagcatatgtagttatacttagatctacatcagcttttactccatatgatcaaaagaaattttcttgacatgaaattatctataacattaatatagactatcattttgtcaaaacttcaattttcacaatacaatatatgtgtcaactgtcaggtatttttgcttcaattttttttagtgatcagacaagtgaaacggattatttatgttcactgaagtagtgcttgtcaccataataaatatgtagatgcagtggtaagttcacatacaggaaaacaaaataaaactacaaacccctgcactgcagatatttggaaatgtagtaactcgcaaatacatgtccttcaactgacatatgtcttgcccaggtctttacaggtacagggttggtgatgtgcttcaagtgacaggcttctacaaccgagctccgcagttcaaattcatttgccggagaaatgttatcctcagcatcgattctgacaagaccaacgaggaggatctccacaacagtgtcaccactgctaagaaaatcctggagaaccaaaattacctcctcctggagtacactagctacactgatatttccactgtccctggccactacgtgctgttctgggagatcaagtccacccacgatgaaaggccggcccctcttgacgctcagctcctcgagagctgctgtgctgctgtcgaggagtcactggactacgtctaccgtcgttgcagagcccatgacaggtccatagggcctctggagatacggcttgttgaagctggtgcatttgatgctctgatggatctattggttagccatggcagctccattaaccagtacaagacacccagatgcatcgaatctagccttgcactgaagctgctgaactccaaggtcattgcctgctttttcagtccacaggatcctgaatgcggcatgtaaaactttggtaaataagcaagtatgcttctgtgcttgcttgatatgcaatcttactacaattaaccgaaattaatagtctgagatatagtggaaataataataataataatgtactactagcttaaataatgaagttcttattttagatggctgcaggctttaggagcttcatttccaatctagtcagatcagcctgctgcctagataagtgggtataaatgttgccaacttttagattttcatttgggttttaattactgaatattcaggggccaacatacccaaatgagaatgatatgtgctgttgctgctaaagaagtttgctgctcccctctgtagtctcatggatgactgaacacttaactgaatgatgtatacttttgttcctatatatgctgcagcagcaaatattccactcttggtctcttttagctactggaatactgatgctctgatctggtatttaccagtgcagtatagtactctagtgtacagtaacaactgcatcttccatttcctaaaaattaaaatccaattctctgaagccttttctgcatgctacactgcccatcagttcctgtactccctagtagtccatagtacaactatggacgcatatgcatgataggcagatactaccatgcgtgcagagcctgctgattctgctgctggaaacatgatttttgtgcttgctggttaagtgtactcaacaacttagcaggggattaggaagaagacgatgccatggcagtgtgtcatggagtgcctgtaggcccaatgtctgtgtgtttttgcatgcagacacggcttacctggctgaagccctctgccggtttgatcccctgctctttgcacccgtctgatgttaacgtcttggttaagccgtgcacgcatattctattctacgtgtcgatcgatgtcttcagtggatgattaggttgtgcacgggtgccaccactctctacttttacctaacctaatctcttctggaacccatgaattttttttaaccgaatgtttctttttctacgagcttcctacctgtaaatctttgtctaggacaagccattttcatgtgagtttcactgaaaacagttcaattcttgatgagtctgctacctcctttcccaaagataactatttttggctatatatctgagtaaacaagaaaaatgcttatatttaggatcggaggaagtattttctttagtttcaactgttgttgtatatttattagagaacagaaattgctatgtatacaatccaatcgtctgactcacgtgcaaccgatcgacggcctacaatgtacatgaacattcgctcttgaagaatagggtgtgtttggttgacctggtttacacaagggatatactagcaagttagcataaagcatgtaaagtttggttttgtgaaagcaatgagctttcaatcatgagagtgatggcattcatgctaggttaattacttctaagctaagacttgaggaatggccgatcgaaagatacatcacaacttcacaagagtgatcagtcatgacaatacatatactagtagtattgctatgtatctgaatggacccaacaatgcaatgcaaagggctccttttcagatggacctatgcctgcttgccgtcgctggtgacctaaaaagagttttgctatcacacagcctacactacacagcttcatgtcagctttgcggccccccttttttttttctcagtgtaaagtcatcaccatcaccagtgcatgcctcttctggaatttgctctcgagttgagtgctcaaatctttcaggtggtacatgctctgatcattgcactgcacatgcatgtgcaaatattcacgtagtagaaaaggcctgtaaaacaaaaagaaatgcaagagatgtttttatctccgttccaaaatataagaacctagaatcggattacaaagaatctgcacatgcaacctatccagatttgttgtacaagaaaatatcccttccggtaatagattcttatatttttggacagagggagtacttaataaaatgagaaacattaacaaaaaaaaaaagaaaacattcattatgcagatgccaaaagtattcttggtgtaattgtatcatcttgatatattttattgagatcaataaaaaagtttcaattatcttgaaagtcttgtgatcaattactttaataattgtttaaagatcacaaagaatgtgccatgagtatctgtactgaaagttcattggtgcatgcatgtatgcatccagccaaagaaatcacgggatatgctcgtatgcatgttggggagacagggatgtgtattcgtgtccagaaagtagaacaggtttggaataatacaccatttttgtcgtgacaggaacatccaattattttgtggtggattaattatttcagtccttttgctttataaaccacggagataatgataataattctggcaacatccaaagttttttttcagaaaggcaaacacacataaccttttctctgtagctgaacatttgcgtttggtactatatatataattccgatgtgatcgaattgctttatctagattatcaaaaggctgccgcattagttgggctactccattgcattttagcacagctttccatcaagcaattcaagcacatgtgagtaactcagatagtcagattcgatctgcctcaatcgtactgagaccaataacaaagcgatcaagcatgttcatcggtcaaaccgtgcttatggcaataggttgcatcatcagctgctttgtgatgcacaggaaaccagtgtcactcagctccaaaagaccatctattttgtcacaataccatttgctacatgttagatcatcgatctattttgtttcagcgttatcttgttggcatctaactgaatctcctctggtcacccgtaacatgattagcaccatttctaaacctacgcacaaggaccctcagttacatgcataaactgtggatgaaacaaagcatgtcacagaacaggatatatagtaggctgggtctaacacagaatccaattctaaaattcaaatttgtcccacaaacagtacaatactacttgtctcacgaatcatttctcatctcaccaaactatccttacacttaaaaaaaccatccctcatttaacgaggagtatctcaggcacagttgaaacatattacttcctccatcccataatataaggaattttgagtttttgtttgcactgtttgaccactcgtcttattcaaaaaatttgtgcaaatataaaaaacgaaaagttgtgcttaaagtactttggataataaagtaagtcacaaaaacaataaataataattctaaatttttttgaataagacgagtggtcaaacagtataagcaaaaactcaaaatcccttatattattagacggagggagtactattaattaagtagattgttgctgcgaattatctacttaattataacgataaagtaaatatttttataaataaacttaacaaataacttaaaaaacaagtggtcacaacaatataatagaagaatctttttttaaatgtatttttaaagcgtggggctaataacccggtcctataatctgataaatgatacgaaaagttgcaagcctaaagtcttttacctttcctactaatttaccttttgaatcctagaattatattcttggccgagttctttacaagcaaaaaaaaagtatctaatttttcgcatgctcgcttcctaaattgctaagcggtatgttttttgaaaaaaaaatctatgaaaaaattgttttaaaaaatattaatatgttttctaaatttaaaatatactcaattaatcaggtcttaatgactcatcaatcttctcccattctctcctctcaaatacactctttagttggacagaaggagtactctacagattagacggaaggaaaactagaaatggcccaacaagaaaaataaaaatactactatatactcctgtgttgaatgaagcttctcacatgtcagcttaagtgcaagggatcctgacatctcagcgttgcacatgtactcactccctcaaaaaaaaaaaaaaaaaaccaaaccctgggtttctgtgtccaactttaactgtccgtcttatataaaatttttttataattcgtatttttattgtttagatgataaaacatgattaaattttatgcgtaacttgtttttttaattttttttcataatttttcaaataagatgaacggtcaaatgttagacacggaaactagggtttgtcttttttttttttttcggggggacggagggagtatatatacgctcctagtacatgctggagttagacaccagctaggagcagaagacttttaataatttgttggaagtgctcagattcaatgagcatagtgttagcgtaccattgctactgcccccaacttttaatttgttttggttgcaaaaatgcaaaatggcatttatgcatcctgtcaaggctctggcattgccattgaatttaccccagcgagtgcatcagctctggcagggtttgtcgtcgcaatcgcaaagatgagatgcagcagagccatgacatgagtagtagtggtagtggtactgctagtcgtaacacactttgaacacgagtagatctcgcttcaattcatacatttgctgttggtgcagcagcctgagcttggagcaggagcattcagtcattcacctgcgtttctccggaagaaagaaccatacactagagaacaaaatctacacacacccaggagagatgagatgagatggccattcaagatgcacagctctgctgcctggaaccttcaattttccttcagtgctaaaataagctctttttcatccaatataaaacctaaaaagatcataatatcatcatttcatcgaatcccaatataattatttcttactttatatactctcggtacatttattccatattttcacatcaacataataattattttaaaaataaatttattttgggataaataggaaaatgaacaatacagatagctaggagagatgcacctaatagtgtagtagtaaggggtgtttggttttttcaatctccaatacgcttaaaattttttctcaaaatatattttgaggctcataattttttcttaaaaaatatttggaggtacgtctttccttctaaatctcttcttttttcttcttttttttcttttcttcttaaaatattttgaggctcataattttttcttaaaaaatatttgaaggcacgtctttccttctaaatctcttcttttttcaatgatgcggaggctcgtaatttcttcttaaaaaatatttggaggtacgtctttaatttcctagctttttttttttttttttacggagagagtagtactagtactacgcgcgtcctccctctggggttgcaacgcgaccgcgaaatctttggttggttccaacgagaaaatgggtcgattttctgtgggatttcgacggcggcggccggcgaggcgatatgcaggatgctcaagccgcggtcaaacagcgggagactttactcgcgtcggcacttggcagtagtggcaggcaggcagccgcagctagattccgctagcctcgccgtcgccgtcgccgcggctcgtctcgtgccacaatacatgcagcacagtgcacgcgcacgcacacactggcattgtcactgcctcaccgttaattttactcgctccattcctaaatacgtattttatctgtattaaaatataagtaattttaggattacttaacagaggatatttttttaagaggaaagactttgatgtcgcttagtaaatgagggatcgatgattgaggataagatactaaagaaatttgaatggtgctagcagatgattggaacttgggaagaacggtaatctgaatagattggaggtgcatatattttcatggtatgattttgaaatgttagaagtatttatattttatagtggatagaatattctctattgactattactgtttcgattttactcaccaatttcctctaatttttaataaatacaatatttttttaatagtatttgttttttttgttaaaagacaagtggttaaatttaaaatgtcaatagtttcaactgtaaagatttagcaactaagggagtagtaaatgggtgtgttcagaaggtcggcttgtagcttcagcagcagccgtatgttacactgatgcttgcaacactgttgttattggctgtgccggatatttgtagttgtttgaggaaaaccaagataaaattaacgggggctttccaccgaattaatccgttgctggtttgggggatcgacacggcatgtggacgtgcgtacccgggaactgacacgggcagtccagtcctcacaccagaccagtcctcgttgcaacgtcgtatggtcacctttcaaaaaaatgttttgcccggaaacaccgggttttacagccacatttgcgtgtcggtgccatgaatcctaccagcaattttgctctccgtcccgtggatggagatgctgccatccgttctcactgtttccatggggtgtacacaacaaattaaacctcgcatatatactccctgccttgtacgactacctactatactacagatgaacagtctctgtgctccttttggtcacaacacaactttgaccaacagctgtgttgggttgttaatgttgccgtctcttctttctctttttttttacgtccacgcttcttaaattattaaacagactttttttttgaaaatacatatataaaaaaattgttttataaaccatattaatctatttttaatcacgtattaatgagttgctcaaaaaggtgcacgagggatttgctcccaactcaaactgccaaacatatttttagtttttaattgctaccttctgtaatgaaaattatgatatattgtttgctctctagcttaattattaactgtaaccaaaatttaaattttaaaattacttttagtgttgatcttaatattattaattacttttacttacattagattttaagtgattaagaatatatgtgtgtgaaagttttatttataaattatttttcgctaataagcattagggcttataatcggctataggcgaaacaataggtctgtgcgttgtcagtcacagtttgctaacacttgccaacaaaagaaaccaaacatcctcaagattaagtgttcaaaatatttgtccagcaggtctaaaagaatatttccatatttttctaaatcattaaaacatggcggatacgagaatcttatcataagtaactgaacaactgtctcagttaaataaatttgtctaacttaactttagaagtggtaaactgtatatggctggccaacaatcgacccctaaacaaaccgagactatcgtatccctaaacactaactatatcaatcaaacaagtggcgcattggttaaacgaaatactatcaagagtaccactggtaaatgctaatttaaacaactccattcataattaagaaaaacaaacaagtccatgtccactctcatagtctcatgcccttgctgatttgtccactacccttccattatgctttccccaaaataatcaaatcaaggagcgtatcacagaacaacgcaagaatcattgcattacatgtggacaactctggccctttgtttaatttgcagagtaatcatctcataaacaaaagcctgtgagccaacaggacgccagcttaactagcctggccaaagactcttcttggcgccaaatgtgcctccacttgcctcacaattcggagtggtaggtaacatcacatcactgctcaaattcaaaatatctggtttatttggtt

SEQ ID NO: 79537 - DNA, 1633 bp, Oryza sativa
catggattcaaaggttaaagctatgatcaaacttctcaatgaagatgctgattcttttgcacgaagagcagagatgtactacaagaaacgcccagagctaatgaaactggtggaggagttctaccgagcttaccgtgcattggcagaaaggtatgatcaggccaccggtgcacttcgacaggcccataaatcaatttctgaagcatttcccaatcagatgccaccaatgtctgatgagtcacccgcttcttcgggccaagaagtggaaccacatactccagacctgtttactttcacccgtctcccttttgatttggatgacctgcagaaggatggagtaggtgtgtcaccacaacaattcacctccaagaggaatggtacacaccctgaggaagccagtgcactgccaaatcgaaaaggttttgatgtgaaagtgcgtaaaggcctaagctttggaagcccagaagttaaaggcagtgatgccatcagcaatgagatggtaaatttgcaacaagagatttcaagattattagctgagagcaacagcatgaaacaacagatattatcagaatctgagagggcaaacaaagctgaaaatgaaatccaggttctaaaggataccatcttgaaattgaattctgacaaagacacgttctgctgcaatataatcagtccactgagcggttatctactctggagtctgagctctctaaggcccaggatgacctcaagaagctaactgatgaaatggctacagaagttcagaagctgagtagcgctgaagcacgcaatagtgaaatacagtctgagcttgaggctttggatcaaaaggtgaagagcagcaagaagaacttgaacaaaagcagaaagaactgaaaagcttcaacttaaccttccaggaagaacaagataagcgcatgcaggctgaaagtgctctgctttcagaggggaaagaacttgctcaatgtcaagaagaagtacaaaggttgactaaggaaatccagatggcaaatgaaaagttgaatgagctcaagcagaccaaagtaaatcttgagaatgctgtttctgagttgaagaaagaagtcgagaatcttactgaacaaaaccgctcctccgagctgcttatacaagaacttcgcgatgaaattaattctctgaaggattcaaagaacgaacttcaaaatgaaatccaaagccttcggagcaccatttcacagttaaacaccgagaaggatgcaaccctatttcaacaccagcagtctgttgaaagagtatctgatctggaatctcaactcttgaagctacagcctgagctggaagaaattgaacagaaggttcagatgctgatgcaagatcttgaacagaagagacaggaagcagatagtgcccatgcccagctgcaagatgaatgcaataggcacacacaaactgaagcagatcttcacaggtttaagaatctgcattctcagttggaagaggaagtgataaagctgacagaaaatcttgacagatcaacaaaggaactggaagagttggaaaatgcaaagttagacctggaaaacacatcaagagagttaaaaagcacaatcttagatttaaactctgagaaggatgcagtacttctgcaacaaca

SEQ ID NO: 79538 - DNA, 687 bp, Oryza sativa
tcccctcttccttttgtcttttggaatctctcgctaatttcgtttggaaatcgtcggattcgagctcgattcggattcaattttctccctctaaccctaatctttccttctcgccgccggccgccgtgggcctctgtcacatcctgatttttgtttcaggatttataaattatttaataaactaataatagaatttatattaaatgatctttaatttacaagtgaagttaaatgtgggaaataaaatttcctaaatataaagcatgaatggatttaatttttttattaaattctccatggttaattacactctctgaaatattctcggatctttcggagctcaattcctaaatgatacaaagaacagttcagtaattatttgataaataatgatctaattataattgttaagagtttttcttgtttaaaaatccttaaattataaattgttgtttaaaaggaattattagaaatgattttaaaagtctaaaagagaagatctaattttaatttgctaaatctcaatataaaattgggctagataaaattttgttaaatactttgcttaattctataattcctagatttttctgggatttatttgagctaaggaagtatttttaataaatggaattgcatttcatgaataatttaaatagaaaaatgtttttaaatcctccttttggg

SEQ ID NO: 79539 - DNA, 1397 bp, Oryza sativa
aacaactgtggcagtaaaccaaacgcatatctaacaaactgtggtagccaaaagtgtggccaaccaaacacccctttagtacgtactaagttgctatgtttgggacggatgaagtactatttaaaggaatagggatagattatttcagcaaagattaagaatagggataattattttctccagtcatattgttagtcaaattgtaaattttgaattgcttggagtccccacaaatcatttgattacctgaaaatgctatactcagtgctatagaattagtgtcacagaaatgcttatgttacatacagaaatgattataattgtgaacggagagagtatatacatgttcttggaaaacctcctccgtcgttgcttggtgtaagtgtaatttgtattttttttcttaggtttaccttttgtttgtcaagatttgtcacttgatcgagaagtggggtttaagccctcgactgcgaacatattcctagaatacaatgaaaatgataatcattaaaattttataatcgggtaatagtgttacttatctcttcccaaaactagcaaggtcgaattttatcttcggagatacaccaaaacaaaaattccaattgcagattggactgcacttttttttggcctaatttgttatttgagttattttggttaatttcttcatgtcaacttacacggttactcctatatatgtaagatttttaaagaaacatttgtaattatttgggtcgcatgcaaaagaaaatgatggcttaaaacactttccagttttattggcactccatgtatgcgtacattttgtttattaataatttatgatgttcccctgcatagtgaatatatcaggcaaattctggacaactggagtaaaaaaaagaacatattatattgtcttggcaattgtgacttttaaaatttaaatagtgtcgcaaaacgttattcatcaccagataaaaccgatcggtccgtaggatcttgcaaaaaaaaaaaaaaaggtgttgctgctgtttgcagcaggtcagactttaaagacttcttgaggagcagacaccacatgggttttgtttctaacagaaccaataatatgggtggttcatatgtgcaaaacggagatggttcaggatacattcacttataaaatcctaagctaggagtagtaagtagtaaccacttcctccgtttcacaatatattctatttaattcattaacatcaatataaatatgggaaatgctagaatgacttatattgtgaaacggagggagtacttatttattatatactccctcctttcctaaatgtttgacgccgttgatttttttaaatatgtttgaccattcgtcttattcaaaaacttttgtgaaatatgtaaaactatgggctgcagga

SEQ ID NO: 79540 - DNA, 1082 bp, Oryza sativa
ttcctcctccccacccaaagctcgagctcccgctagggtttcgccgccgccatggtaagtccccctcgctttctccccgccgccgcctccaacctgacctcactgcgtgcccagttcctcccgggattcaccgctgatcatctcagcacccgcgagtctttccgtttcctcgtcgttctcgctttttttttttttattttttttgagttttctcctggacgagttggctgcagccgcagggagatcacatagagcttcaccagaagcgccatggccggcgcctggactacgaggagcgcaagcgcaagcgggcggcgcgcgaggtgcacaagcgatccagggatgcccggcaggtgagagactgtttatattcccccccccccctcttctgttcaattttttttggtgcgtttctgttgctgatgcgcgcgcgtttgttctgtggcagttgcttggtgctaagggtaagaggttcgccaagaagcggtatgccgagaaggcacagatgaagaagacgtaagtacttgtcgaatgtttctgtcagattgcatgtttgatgctccatttgatatattgatatttctgttgagtgttgatttcttgttgtattggtaggggatgtgagctcaggaatgcttgctgccattatttatagtttatactagattgatgcattttgaatagatgatatgatttgatgtttgtttactgctttgttttgcatagcgatattttgattgtgagatgtgagcattataattcgcaagtgtaaaatttgcttgtttggttgcatttctgtaaagttcattcacggatgtacacttgcagcctgaaaatgcacgacgagtcaacttctcggcagaaggttgatgatgttcaagagggtgctcttcctccatatctgctggaccgtgatcagacacaacgtgccaaggtaagtactcatattttgggttgctaaaatgctatctttctataatctagatgtgatacacaagtcaacttttcactgttttgatcattcatatgctgtgaaacataggttctcagcaacacaattaagcaaaagaggatggaaaagg

SEQ ID NO: 79541 - DNA, 580 bp, Oryza sativa
gctttgcactgattttgatagttgagggacccgttgtatttgattttctggttgaaggatgaaaattggattcgttgacaagttaaagggacctcaagtgaacttattccttctcgctcttcaaggactcggagccgcggggttggtccattcgcagagctcagcggtggaattagctcgaagctcgatcatggccgccgccgccgggcttgccgcgccgcctcctacctcccggatttcctccttccccagggctttctccaccggtatggcatccgccccctctcccgtctcgccattttatcccttcctgtatctcgtgtagttgccgagttgggtagttgtggtatggcctatggggaattggggatcaaaggttctgcgcgttggaacggggtgactcggctgtttctgctctaagtatcgggtttcggaaggaagcatgctgtcaaatctgaatttctgtgatgagtttgctgcattgcttgtgtgcgcgtcaagatttgtgcagttcgtttggaggagacttttgtgtgcaaatcagaacaaaaagtaaagctattatttggaggattctggt

SEQ ID NO: 79542 - DNA, 4306 bp, Oryza sativa
ctgaatattcaagtgatagacttagcatctatactgcaagtagaaccttacagtgaaaaaacagtgcgtgtttactctgctgttgacactcgtgactatggtacacttatctagcttgtagagagagcttccagagctagttaatcaaaatttgggtttaggacactagcctagcacacaaatttgtagttgcagcattgccaaatgttttggacaaaacaatctcagttacttggaccaagaggcccatgcattaaaagaatcggactgggcctagcagttgggcatttggatgccatctcggcccttttcagcaaaatctatggcccagtcatgtactacctccgttccatattacttatcttttttagtttttgtttgtcaatgtttgatcattcgtcttattcaaaaaaatttagaattattatttattttgtttgtcatttgctttattatcaaaagtaatttacatatgacttatctttttttatatttgcactaatttttcaaataaaacgaatggtcaaacgttgcaaataaaaagtcaaaaacgtcatctattatgggacgaagggagtacaattgtatgcttaagattggtcttttttcttcggataagttcactctgggtccctctatttgtcacgctgtctgattttcatccctccgacacaaaaccgggtacgacgggtccccgaacttacagacccagttcaaagtaggtcctaaggcagtattgtgagcagtattgctgacgtggcgtccgacgtggagcgttgactcggttcacatgccgactcggacggccaccacgccaccatgagcaaggaagaggagcaagaggagatgggactcacgacggcggcgagggagatggagagcgtctgagcgtgcaggagatgcacggggaggcagaggcggagacggtggaggaggagaggacgccgcggacgagggcagagtaggtgccatggagctccacgggagccgggaggggtgcgccgacaccaaggccctggaagaagcgctgcgtccaatcgcgggactccaccaatgaaggcttccacggcaggaagggcgacggcggagagggagcggaatcaggccgagcaggcggagtggagcggctgcaacgtgggagaggatgaagacagagcaaccgcgccggggtcggatgtctggggcgaagacagtgccccggtggccggaggatcaccctctcctctagtcctcttaaggagcacgaccggcaaggaaggactactggcgcggcggccgcgccggcggttggcgaggaggagggtcggtgcagcgggacacggcggagaggaggggccgtagcacacggcaggcggaagactcctcgcgcccttctcttgccccgcacgcgctccatggactctcctccaagacaccgttcgccggcgacgtgtttgtcggatcgtcggcgggcggagcgaaccgacgacggcgaccccggttggaatcgacgaccgagggaggtggaggcagacgaattattgtaacagaaataacggaagcggttgagacttgagagttgagaccgtttggcggctgcggttggttgacgacgaagtgcagccggccgttgtcatggcgctgccatgtgcggcacgactcgcagccacagtccgaccaccttgggctctgccccttgcgccactccgtctccggcgacccgctcctaccctgaggagccccatctgcgcgtgtcggcaagcgctccgccagtggtaccttgtcgtcctccagtgccgcgcgttgtggctcccgtggcagtagcagctggctgggttgtcctcgaagacggagtagaggaagccatacacgaagcagaggagcacgtcaacaacgtccaggaaggcgaagacgaccatgtcttgtgcgggttgttcacctgcgcacgcgcctctcatcgcgcagtgttcgtcgcctccgccgccagcgtgtgaggggaggcagagggtaggggaagggttacggcgctccctttcgcgtacggatcgccccgccgccgagcttacgcgccgatccctcgccgcgcggtggtcgtcgtcggctgctttggttggcggtggcggccttgctagaagtgggcgcaaacaaagaaggccgttgcgcgtccgcggtggctggctagtcgatggcggccacgagcgttgtcggagaggggagagagatgaagagagggcgatagggagagaggaggaagaagagaagggggtgagaatgacatgtggggcccacgtgggcccaccatttttttaatttgtgaatgaaactcacatgtgggtcccacggggtttattatttttggatggaattgccacgtaagcgccacgtcaacgccacataggcactacgtcaaccaaaaccgctgtcaatactgccgagtgaccttgtttgcatggttttgtaagttgggggatgcgttgtacctggttttgtgctcaagggacgaatttcgaactcggtgacaaattgagggacctcaagtgaacttaatcctttttcttcttccccttccaagtaggcaaaaactagaaaggagtaaattcctgatgttaccatgtaaaattcagcttcagcattgctgttttttcatatacaagtacattgctcttactagttttatttctttactaggaaccaaaactgtagcccaacacaggccaggagttactccatggcacaaaagtaggaaggaagctatgtgatttagagtagttgacatgcaggacaaatgcatgtggtgttcatgtggagcatcaatcagtgtaagctagaacctcctgggctagcttcttgtaagaacactctcagtggtggtagggaatggaataataattgaggtggttgcccttgcccatggtctcaagacaaattcataatgagaagggaataaaccaggcattgttaatcattcagtaggggctttcagggggaaaccagccttggattggggtcacctttctcactcttctgtttcttggtttctttgggtcacctctttgctttgctcctttgttcttcagttgcaggtgtagtggctttcacttcaacctgatctccaacttattgctagtacatgtgtacagctactgtagaatcataaagtttcagaattagatgaaaaaaaatgcacaagagtggatggatctctgaaattgtcagtagcaacaaatgcaattacagttttgtagagtcagttctcttgctatagatgaaggtttagcaataggcgttataggtggtattctaagtagttttcttgagctgtgatttcgtagtttgcagatattcgtccagtaacctctgtaataattggttgtaactttttaaagcaaatgttggaatgaattccatattaaaaaaaaggcaaattatcttgctgtaacttgtaaggtctacattctaatatggatacagttgctcatcatactagaaactgacaacctaaacctacgaaaaaaaaactaaaaaacatgatcggttgatcatcttttgtcgctttctactacttcgtcgcggtgcaaccataaattcataccaaaataccctaatatgattaaggtattaagcaggaatcattggacagccaatccattgttctaatctatccagccagtacagttaatctgatcaaactagctgtacagtttgacaatacaaaaatggcccatccgacgtggaacaatcgagtagtgcagctgctagcagctatagcaagcggcaacaactttttggggccaataaataagtataggaatccatttgtcacatacacaatttaaaaatgcaattgcaattgcaattgcttttggttaattagtgttcatgcagttaggtcacacggccggagcaactgcccccaaaatttatgtattgcagcacttggcacggatggtagggtccaaacattaatattaatttttgggatctatgttaatgaagcactgacaagctggtcctctatgacctgttaataacaagatcattaggatgctggagatgttgctacagttggagcacataatcaagggtttatgcctaactgaaagcgtcgaaaatcacgccgcgggcttggcttagttcttttcaaattatttactgaattgttaaaatagattattcaatccacgcttcgaaaaattcattttgctcgaaattttttattctgttgtattgcttagactatctgttttaaattatttattaagtttatttatcaaaatatttactctgttcatacaaccaagtagatattcgcagcaacaatcagctc

SEQ ID NO: 79543 - DNA, 2222 bp, Oryza sativa
gttagatttgttagtccgtgtactaggcgagaaaaatctttcgtttttcgtgcaaatgtttttgggactgttatcagaaaataataaaagaataaagaaaaatgatacgtttatcggaaaaaaaaaagacaaacggacaaggatacgttaatcgaatgaaaataagaaaaaagaaagacggacaataattgtttttgcaaacataagatagcaataagaaacatgcacatgcatgggcatcatagcgtaggtaacgaactacagttcttgatccgatgaaaataagaaggaaaataaacaaacggacaaggattgtttttggactcggtattactgcatatccttgactgctggatcgacaggaaacggccaagaccaagctgggagatcagcatgcgagcaaagctgcaggctcgacgtggcttccgggcttgcctatctcggcaaggtcttcttctcggggcctccggcttggacgaggaatatttgccgtttgcggccagccggcgaaagcgaactgagattaatggctggcgagtagtgactggcgtcatgtttcttgacgagctctggtcaccgtgagcttttgacatcattaatgctatgaagattttgctatgtactccttctgtctcacataggctgtgtttagtttctgaaattagggagaagtttggagaaaattggtagtttggaaaaaaaaattagaacgtttatatgtgtaggaaagttttagatgtgatgtgatgtgatgtgatggaaagttaggagttgggggaagtttggtgtgaactaaatagggcataaactcaatgtagtattggatttgatgtcttctagtacaacaaatctggacagtagaaaacgttctatctaatactaggttgagttttttttgaaacagagggagtagatgtgatggataattggagaaaatattctctcaacataagctggtaatatattgatgtacctaaaagtttaggttaacgactacaaattacaggtgggtttatttctgaatttctttcagtttacttgtgctaattactaactgcttatacatacattcctcgcaaaagatactcaatctataacttgtttttctttttttttttcagaggtagttacttggcttggttgcatcgtgccaacggtaagagtaactgagtacgctccccacgcccaatgcacctatactgcctccgttaaaagaaaaaatccaatacgagatgttatgtttaaattcatagtatcaacacatttcgcgctagttttttttttccctgacagagaaagatacccttgtacacgccctaataagccagcgtaatgggttaggagacatcatggcatcatgcatttgtacactactttctgttatttgtaatgtttattccgaattttttttctattttacttgtacactactttctgttatttacgaagagaccacagctgtataaaacggcttgactacactccaagaccatactaatcagccctcacatggacagtaccgtttcatttttttttctttgacccgattgcattagattaacaaacaagcacggagctataagctactaaaacacaatgcaaaattgcaaatatcacagcgcactaacgataaatcattcaaatggtggaaaaaatcaaacaaaatggttagattaatatagggctgcatgtgaatgccacaagaccagttttaccaaaccattgtaggctttataaactgtagttttctacattaccttggctatgagttgtctgttactagcaaatcaagagtacgctggggatgtatcccccacccgtctttttatttcattaaaaactcatcgggtatgtgttatggcagatgccacgaatgtaaaacattttcattgtctaaacaaagaagattccatgaaaccatgcaaacatgaaatacagaatgacccacatcagagcttacaaacgttggcatgggcagttcaaccacattaggttcaatatcaatggcctcgcaaaggccaacttttggattgacaggaaacggtatagtaactgaaacccattagtctcatactctcatgtcataaatccttttccactacagcagaaatgcaactaccatgagagaatcctaatcctattcataaattcagaatagacgacaacctggctaaaagtaaaattctgaatcaggtggtaagcttcttgacaattcacaggga

SEQ ID NO: 79544 - DNA, 881 bp, Oryza sativa
tcataattattcatgggtcaacacagccatgatcagacaatccaagggggtttagtagctgtgcgatgtaatttgtaatgaacaatgaccaagatctagcaagtgttgtcttcagaaaaggattcaggcagccgaaagggggtgaaaagtgcactgaaagaacatctttttctatgaaatctggaagaacttttgtctgtccgtggtccaaggtgatgaaccagaaattcttctaataagattcttgctgacgctttatgcggcaaatggagagagcaataactgtaaaagatgcaggtcttgcactttgatgacgatgtcttagtgctaattcgagttggatttccaacagagctcaaaatttcgaatttgaaccggctgccctgccataaaacattcacttcaattccgggctgacatcaggtacacaaatttggtgaacataactctaacattgcagtaactcctgtttcgcatcacgcacagtaaattaatatcaatcctgcagccatttgcagccaataagatgtagatctgtttggggagcgagccccatcgtttgacatattagagaaaaaagcgaaacaacaatgtatatttgtaaataaaaaataatttataaataaaatttttacatacctgttcttaacgatctaagagcaaagactgaaaaataaactacgataaaaaaaaacttcaaaatcatttccaaatttaaggttgaaaattcaaatcttaacggataagtataagcataaaaaaaaatgaggctgttgattctgagaaacggatggtgggaataccagtgggtgagaagaaaccctcagcttatagcttctaatttattttttttagattttacaactagattttcttaaaat

SEQ ID NO: 79545 - DNA, 726 bp, Oryza sativa
actcattctggtcaatcttttccccccttcagtaaagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgtcaagctggtatcagagccatctcgactgtaggataagccaagtggataaaacctaaggacatattttataaataaaactatttgcgaaagttcctcttttttctccttcccctaatgctatttgcaaagggtttacccttttcttccttcttcaaatttcaactagtactagatggtcagctttgcgaagaagaagatgtcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcagtggggtgtgatgtaaccatgctaggttgtttgcttaatcaactt

SEQ ID NO: 79546 - DNA, 3279 bp, Oryza sativa
catctgagcttcagatttgaatggccagtactatcttgctcatcatatgagcaatgcttctcttgatgttagtcttgtagttgttttcctttttcttttgtggagtcagtggaaaatctcttctactaattagttaatggatggtacctgtaaaaagtccatatatttgatcatcaggttccttgttcaccacatgcaaatgatgtacatggaccaggtatgtaccttgtctggataggaaaaaggatcttggcatctatctgaacattcagagaacttctgaagatgactgaatatgaacatcatatggtatttttctgaactcatgtgagctgtctacacaaaaaaactttcataactacgatgtgcaaatgcagctcaccagttcatcggaaggagaaccttagttcggttcaggtcttcaggtctatcaacactgtccgttgttgacagagaattgacaaagctaactataggtgtttcagagcaggactggaaataaatttcctgatgcttctaagactcagagaactcatgatgaagctaaaccttttgagcccatttcaatagaagttgaggtcggtgtatccatatgggttgatatcggtgtaaccatatgagtagggcagcaattcttcgatgtccaattgcgagcttgaacaactcattttctgaattcggctgtgattgatcgattctacttctgcactaaacatgctgtagacaggcctatgatctgagaagcgggactctcctcgaacatatgagagttggctaagaccccttccataccataaaatgcggtcgcacctgtaaaacaagatcactgaaattgctgaactgtacgaaatatggcaaaaatctggcaatgtgctttacttaccatgctggagttctcctcttttctttctggttcatgtcatcccctgcatatctgtcggaattatttgagtatttgtaagtaggaggaaaatatatcctcccctcattccaaccaggaaatacgcggccgcctctttgctcgctcctcagctgaaagtataagcaattcatgccttctcatcacaattattcttggccttctgttttgccaaactaatgaagtcttgtaacgtcaccaaagcaaaagaatgacaggatataaagcaatgattgcctctgtcacaagcaaactactattggaagaattttaccactattggagatctgcattgtgtctttcaaagtgtgttgctaagctcatacctgatctttctcaagcaatgctttccaattgcgcatctccacaagagccttcaccgatcggtaggaaagcgctatccgataatttaggtccccaagccaaatgatccgactaagaaaatggcgaaggtgaaggatatattacacaatatttgtgattgcaagtttttaatttacaagagttgagggatgctaaggtgttttgcttactcatgctccaaaatagtctctggtgatctctcatactgtccataaaccattgggaacctggtttttctcaaaatttccatcacatcggagtttctgcggtgctcatcaccatccttctgccccgatgtgaggtgactacagacgaagcagaagcttgtttggtgcaacaacatgctaaccgaaatcgaaccctgggaaaaaaaacttctcattggtttacaaagcttctgaaacacaatttcttactcttttttcttcaaattcaataatggcaataagataggaatataacaccaaaaatcacaacagattattttaacataagttaccttatttccaagatagcccatcaatcctctccctacacaagacaccttgagatttcttatgtcactttttatttctctcctagcccaaaccatcaggaacaatccaaccatttgcttgctcgcaaccaagcagtacctaaatcacctcaaattttatttagaaaataaaaatcctaattaaatctcatcaaaactactgtaaattcgggataattccatgaaatcaagcttaattatcctgatgaaaggctgaaatttcaagatccaaagccaagaaatggtggtcacctagaatgggcggcgccgccattgctctcttccatgtacggcggcgcgccgtatccgtacgacatcggcgagaacaccgcgcttggcgactcgccgccgccgtcgtcgatctcgccgtcgtccgacgggtggccccaccggcagttggcctcgtagtcgctcggccggctgccgtacatgacgcggtcgttgacgctgtaccggcgctccagcctcggctgcgcgccgccgccgccgccgaggatgtcgccgtccatccggaggctccggctgagcccggcgttgaacgagcggcggtggaagaacgccgccgggttgttctgcctcgacgacgacccctcgaagtcgtcgtccatctccaccaccgggtccggcgccggcgacggcgtcctcatgcccccgccacctccgcctccgccgccaccgcccgtgcccgcgaggctgttcagcgtccgccgcaccagcgacacccacttcctcgccgggccattgtcctccgcgccgagcacgttgccggcgttcaacggcacgatctcctggaacctacacgtattgagttgcatttatcgaccagttcaatccaagctctgaccatattaaggaggccatcgtttaacttattgacagattaagcgaaatgatatatttattaacgtaaaataatttgtaaataaaatttttatatacgtgttattagcgatctaaaagcgaaggataaaaaataaactacgataaaaaaaacttcaaaatcagcataagctaaaagatgagactgtaagttgtatacactcactagttcaattcaaaaacttaaactgatgagaaaaaaacgagcaattcagtttatattccaacgctacgtttcaacggcaatggcgagaggcggcggcgtgtacgtacccgaggacgtagatgtcggccggcggcgaggtgcggagccagtcgtcgaggctcagcgaccccggcggcgcgcggccgcccacgttccacgtggcaacgaagatcctacataacgcaagaaacaacgaggacgacgacgacattgttacggatcaatggagatcggtgcagcagcaatggcggcgatcgccggagatatgcacacacgcgcacctgtagtccaacgtgacggtggcctccgcagcgtcgaggtcgatcttgctccggcgagaccgctcgtggctccgccgcgacgccctctctgcaacaa

SEQ ID NO: 79547 - DNA, 7749 bp, Oryza sativa
gattaggatcggctgggtctgagttgggctaggtaagccgatacagccgattccgacaatacgatctgtgtacgacgtcgggttcaagttaatttacttcaagatggttgccacgcacggatagagtcctgggaaggcaattgtatctattaattaggatattttatgtaggttccatatagataaatgtgggcaaaagtctgccgcaaagacttgtggtatcttagagtttgttagagataatagtagtatgggcatatcttgtaattctcgggtataaatagaccccgagccatatgtaattaaacacacacacgttcaatacaatttcggcgcatcgccacccttttgctttagttttgtttcgacgagttcttgctttcgggttgagctgcatcggtttcgatcttcaacaagaggtaaaacttgttatgatgacttatattctcgggattagtgcttccatctttacgacactctaatcttgtttatgtaatttatcgagttatcatatatcttacataacctctggcaatatcgctatctaatctactatcggctaacatctgttagcagagggcaaccgattaggttagattttgacgttgatctagattatataagatatctaccactctatgaaacttctagcggcttgattgtctagatatcgttcttcttttcatacttaatactatatcagttgagtttgatatattaagtcgtgtttagaatatcgatctctagcctgctttctagttaccgattagagtaacatcgaagtttcagccgattttatcagatttaactatatttgttctatatgcttcattgacatgttaaatctgccctttatatcaagatattgttgtatctaagtatattaggcctttgtttgatatattatacctgctttaatatcctgatatagagtagtatcggagtattagccgatacatgctagatctatctgatcggctatgctataaacatatatagtcttgttaattgatatatatttcgatctaagtgatttatactgtctcggcatagcgattgatctatcccaatcacttgatttaagtatatatcaatataaggagtgtatatcattaatatctacagccgatcgagtagatttagttctttcttatttattcatgactgccgatcgatacacagatgacatcggctcaaagataaatgatacgtcatcggcacctagccgattggctatcatttatagatttacccacggtttctttgcttctatttcttattgattataggatcaaatcaactggcatgctaacatacccgaaggcgagctttggacctgcactggagttaagcagatctcccaggccacgtgttttcagtcaacagcgctgctcctcccccgccgcccgcgggctgctcctcccctcgccgcctgcgcccaccacccgcggtgctccgctgcctccccttctcctgcttcgcctgtcgccggccgctgaagtcctcctccgggtctgcagcctctgcaaccactgcctccccttttcccgtattgtcgccgcctccgcggcatcgccaggaccaggcgccgccgttggcaggagctggaggggtgggaggcatggcgcggggacgggggaggatggcaggagcggcggctcattagagccgacggccaccgccgcccaactcctctccgtcggtcgtcgctcctctctcccagccaccgctcctatctgttggccgccaccgctctctcccggccaccgttcctctgcccactcgttttcgctagcgagggcctatcgtcagctgtgcgtctccccaatcatcggtcgccaagaagagagaggaagtgatgtggccgcgtcgtgctctagggcggcgcctgtgggtctaagccgacggccgccaccgttgacgcctagctcctctcttcgcaagcgagcaccgccaccgccgagagcagtcgcgcgtctctggttttccctgcccgtcgccgccatcgctctcgctccactaccagttgccaaagaagaaaggtagaaagagaagggtagtggctcacttgtgggtccacgcgggtctcatgctgactcagccgccacatcagataaaatcggggtcaaaaccaccgaaggatctaaagtgaacggttttgtaagttgagggacgcccgatatctggttttatggttgagggacgattttgaatctcgatgacaagctgagggacctactgtgtactttttcctataagggaaactggggaggcccactcccccatcatttgacggaggaacgggccatgtttgggttactggcccgctacgccggcgaaagtcatctcctcgatccgtccgacggacgaccagaccaacggctaaagtgacagtattccagcgcagatttcgctcagatatccagtgcaaaatatgctcttggatcggcgcaaaatctgttcggggaatggagtttgatactgctttggtttgttgtgtgcagaagcagaacacgaagctgatcttgagtaacgtggaagcaaagatcgtgatggtaccattaagaatttagaacagaatttttactcttgtttgcaaccggcagatctcgtagcagatcagctttgtttcgtcgtagacgcataaacaaatgacacatgtgctgcgcaagcacaccaattcaccaaaacaaaaagggtgaggtcgaggacgacggtgaacctcgtggggtcgtggatcatgcatagtaaaaaaaaaatgggatcgagcaggcggttgaaccgaaaataaccggaaccagtgaccttggttgctcggttcaacaaaacgaccgccactgtagcagaacccgtaaaaaaccggtgattcagacggtttttgcgagaaccggtgaaccggtagcggttttttaagaatcggaccgattttaaatttgtcctaacagtatgacattacgaatttactacattaccacactatttttgtttttttatgttgtgaccgtataataatagatatactattttacttatgcatattttaccagtttgtgatgattctatatttaaaataatgcaaatcaaatataatattaataaataaaaaaccggcgaacaggtgaactggtcgaacaggtgaaccgatgaccagagcagatcgacctccggtccggtttttttactatgggatcatgcggactgcaaatccacgcagattcaatattaaatcctgatccaaattcaatattaatcctgatccaatactaatgagagagaagcaagtagcaacatgacaaacaaacaaactcatctcatcacactatattttttttacaaatctgcaatcttacaataagagcagagagcaagtagtgtagtgtagaattgggccaaagttcgcttatctgaaactgaaagaaagctacgaagacttgcaggttgcaaactaagcaaaggaggatgtttcagtcattttctgtgtctcccatcctctcgctgaagctggccttcgccgtcgccttcgccgtctccttctccgtctcctgttgcgccgcgcctccctcgccgcgggccgtagccgccgacctcctcgccgtgctcgccggcccgggcgccgcggcgcgcgtgccgccggccgcggagtcggcgcgcctgcgcgcctgcctccggttcctctccccggtcctccccctccccgccgccgcagcgatctccgaggggagggccgccaggaaggttcttgtggagcgcggcggcgcggacgaggcggatgggatggtgatgtggccgccggcgccggtcatggagctcgcgcgcctcgccgtcgactccggcggcgaccccggtgccatccaccgcgcgctcgaccccaccatgctcccggtgagctctcgtttatctcgttcttcgtagctcgtagctatatctatctccgagaaattgtaaaaattctaactctgcatagttctggatgtgttacgtacaatcctgaaattaatttccataacaaaatctaccgggggaatttcgttaggtgcctgatgttcagagggcgaagaggaacaaatgccaactcacaagaacaccatatgggaggcgtttcgctaacaaggtccagatttttgccctagctgtttgcttgcacttgaaattctttttacttacaaaggttgggcattgttcaagtgacatgtttgtgttatcaacaggacatcaattcatacctggcgtttttgttcgaattgattgcggcacgaggaccatcagtggggttaaatgtatcacttagtcgatacgatttcttccacggacacctcttccttgcttctgggacaggaaggcttggaattctgtaagtgtcatcagttactctatacaatttgtgctcaacactttctaacgctggccactccgatttcttaagtatcaagtgagaagttgtatgaaaatgcacggttctgtatgtatggtaacattactaatttactattcactatctgttatattgactaggtactccaatctgaacatacaacctagaattgaatcatatgcaaatttaagttggatattagatttttctttggaaaaattgagaattgaatctaaaactatcgcgagtatgcaggaacaagcatttggtcacagatatgtggaattttttttttagtgccaacacataatctttaatacagtacatatgtgccagaaacttgtatagtatcttcatcaaatatgtaaatgcaaatgattaaggtgtgagctattcttgagacagattccatgctaaagaatatccagcatttgataaggaattgttcccttacagtttgggattttgtcaggcaggtatgattttagtcagatgcatgggaagtcttaatctgacttttttttcaccgattggattttattaaattgtttattttctctatgacaggatctaatgtagtgtacgatgattctatgaatttacgcaacatcctttggttagcaccattgccatctaatgaaacaaaagcttggctatcaccaggtatgctgcccctgagtacttaacactgttcacatttctccattgtctccaagattgtttaggttctgaattaggggctcatacgcagttcatctcacttcaactcctatttctatttctctcgaacaaacaaaaaacaaacttttcctacatatgaattgacattctgctggtaacttttacatgaaacaggtgttttagttgtcctggatgcacatcctgatgggattatctatcaggatatgatacgtgattatgttcgggatgtacggacaatatatgaaggtttgattttataatttatcaatctacctgggtgggttcactatggagatagatggataacctagttggttttctgaacacctctgcagatgattttggagaggtttccgttgatgtcaactatctgaatgttgccaactccgctcctgcgaatagagttttcatttgctgaaatttaaccagacaattagctatcttccccgggtgtgattttatcattgtgggaagtagacaccatgtatcattcttcaagtcatatagccaggaaagcaatggtttgcttagcaaatttgcctcttgacggcatttgcatcctctgtgatgtttaggtgtttatttgattttctggaggatgcttattttgagagagaacgaagcaacttatatgggccgcacgcaggccgcaatcccgtccagaccttcacgcgggccagaatcccgttccggacaacctgttttgggccgtacggaggccggagtccaagttcatgcctcgtcggctaaacctgtttctggttttgtagtttccgcaccgagtagaagtaacgtgtgtttggttatatacaatagaaaatatcaaacttatccaagttagaaacaattagccacatcttaacaagtctaaaggaatcggtttgcattttgcaggttaaaggcagaatgacgtaccattaagggtggcataatggttaaaggtaaaatggaagaaaaatgaatgagtaatggttgatagataatatgggataatcgttagatgtaatataaacactctagaagtgtttatatttcaaatgctagataattttggaacgggggaagtactagcagatacactgttagtacatacatgcagaagtctagaagcaaatgagaccagacttgtagctctcataacaggttgtaaaatgtaactagtaaagatcttttctgcaccacgacatacaatgtaaaatgtattccagatatgttaaaggcatataacagatgagccttgtgcccacagtttaaaacacgctactctgaatgatcggtcaaaaagacccactgaacgggtacatctggggtgagagtcgcaacgagaagaatgaagtgtatagcattgcgtccttacacgagtaagacagcattgatacagccatcattctctgggttgtttgtaacttgtgcatatttacctgcacgacaagaacgctgttttatggaacaagttccagggagaagttaaaaagcaaaataagcagaacattcaacagatgccttaccccaaacaacttttccagcaggggttaccagaccaagttcactaacgttcacctgaaaagataaagtctgtaagcaccaacaggtaaaagcaggatgtctaaatgaacatgacaagcatccaacaatgttaaagtggttccagcaatctgctgccactaagaagttcaccatatcccatatatgccacatcagtaagataatcaagagcacaaaaggaatttatctcataaaagctaaagttttcattatcaataattcactatcagctgtaatactaacaacttaaatgagattacttttgttttcatatacaggcagaattcttgacatacctcaatgatagttccccttgtcaaaacaccaagagtagagtacatttgaccatttgggtttttcttcacagaaattatgtcaaggttgaaagtacatttcagctcagggtgagtaacatgggcctttgtgaaacgaaggccagttggcctaataaaccgttcatactttggtggtttccttgtaaacccaggtccaacaaaggtggccttagtgaccattctcttccactgtttggctgcataagcgtcattcgttagcagaaatcagatgcctaataacacatggtagtttctcagatcactactagatgacatgtaaaactgctttggcagaaatcagatgcctaataacacatggtagtttctcaaatcactactagatgacatgtaaaactgctttggcacctagctacgaggaagtacaaatacatgaatgcaccgagcatacaagccaaatgtcaactaatattacagatttacactattggcacctaggttcacttactttttctcttgccagttcgtaaaactttgaacatttcttcttcagccacaggtctgacctgaaaggaagaaaattgtgacagtgcttagtcaaggtaggaaaaccattgattgccaggtactagaaacagtttgtgttgaaaatcacctttggcaaaggaacctcccatttgccagccttttccatcctcttttgcttaattgtgttgctgagaacctatgtttcacagcatatgaatgatcaaaacagtgaaaagttgacttgtgtatcacatctagattatagaaagatagcattttagcaacccaaaatatgagtacttaccttgg

SEQ ID NO: 79548 - DNA, 2342 bp, Oryza sativa
ctcatgcatgcatggccagcttgcccatatatatacacttgtccttccggtgagagagataatctattcctagagagaaacgcctagaggttttccggttagctccacaagttgatgggctaggtgacctagattcgaagtctcaccccttctaattatttgatatcaggtctttccctaatattcgcgcctttttgataatctcttcccaacaaacacacacatgcacagatcgagagggagagatcgtctcaccgctgcgttgagataaattccaacaggttttatatattatataagttattttaggtttgtcctgaggcaaacaactctgagtttgaccaaatctatagaaaatgtagcaacattcctaacataaaataaatatatcgtaaaaatgtattcaatgctagatttaattaaatttatttggtgttataaatattgctatcctttctacaaacatagttaaatttgatgaagtttagacaccaattcaggaataggaagaatgggggaattgaaatggtatacttctccaatcttacgtgaacaaaaaaaaaacacacatgaaagaaaatatatgaggcctttgatagtgccacacaaaaaacaaagaaaagtttacaaagagctcatacatcttggtgtttttcctacgaaagtgaagcatgggaatacaatcatatggaaagtcctatgaatcacaaggatatatcggaaaagtttaataaggaatgtaaatcctatgaaaatctcctttgccaaatctcataaatcaaaggagtttttaacttaagataaaacctagaatagcttataataattaatataaaacaggggggggtatatatatataggcttcagcgtgttcggtttggaggatcagaggagcttgtcttactaggaccatcagcaggtccaaacccgagccagatggtgttgtccaaggcggcaatatatggggcgtatcacgtatggtccagacgtctttttttcgaaaatataatataaatgcacactctcatatacacgtaagtacgtacactcatatggcaaaccaaacacattacatcagtcgcaggggaatggggtcataggtccagtaccaaatcagtccatgtaaatgcaagttctgcagttagtgtccctgaaaaaagaaaaggttcccgtaatttgtgatattgtaagcttgaacccccaaaatgctgcatgtttccacgccaaatttgatgcaaaaatgtcacaaaagagagcgcccctaaatcttcccaaaaaaaattttactcaacataaatgctgaggctatgtcgaatcatcgcgaattttttttatttataatttttttattaaaagttttacaaaaataattttccattttgaaaattgacggaagtagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgagggggcatggaattttgcaggcggcccccttgccgccctgggggagggcgatttttgcctccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatatcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcaatgtcagttgtagtgagtcgtgcaacagaaggttatttttgggaactaatgccgaggg

SEQ ID NO: 79549 - DNA, 16549 bp, Oryza sativa
tagtgtgcgaatttgattcataatttcatctccttcacccacaatacctgatatgtttaactccccaagtattaaaaccggtgcaatttaactccctcgatggttttggaaagctatttgctgacgtggcggtgttaacctggtctttgttccacgtgatgtcgacgtggcgcttacgtggtattagaattaaaaaaaatatgtggaacccattttcacgcaaaaaatattgtggggttcatgggttaaaccttttacacaaaacgatgataaaagtgtaaaaagtgtaaatggagtgatgcatgttagtgagtccgcccgtcgaatggattggttgcacggttccagaggggggctgttacagacctgtttgggagagcttctaactgcagcagcttctctcggaatcagaatctcctcaaacattctagcctttggtccagtttctaagaatctgtagttgtataattcagaaaatgaactagaaaccaaaagctaaaagttgagcgtttgcagattctcgtaagttgactatcaaccagttacttcttataatcttaaactctcccaaacaaatgcttccccgaacagacctacaatactttgcactctaaattcaatctcgaatggagagccttaacatggtaacatgaaactagatctttcttggtcatttttttttatttttgctgggagcctgggactattggtttatacatttaaaaatggagttaacatgtacctagtacatttggtttgatgttgtctaaatcaatacttaggaggccaacaacaaaggagatcacatattaagagctgattgaagaactgccctttattgcttaaacattctttggcattttgccgaagattcaagggcccatttaagttagattgttctttggattattttacggattatcacttaactatagggatacattaaatatattaagccccacatacaacaagcggtctgaacattacagtaaaagaaagactccataaaacatcagttgataccaaaatttaaattttcaaacttaattttaaagttgattttaaaattttttattgaagtttatttttcaacagtaatatttaagtagctaagaacgtttatataaaaattttacctataaattattattattttgttaatacgccgaatgacattatccacatttagctatacgatgggttttgttattcctggagagttttagaagccacattgttcagcgccacaggaaatgaaataatatacgtgcatcgacttaatcactgcagaaaatgatctagatttaacacaacatgaaggccacgcacacgttgaaggggatgacagcaacagggacccaaaacattaaccacaaagtcaaacccccagattgaactgatcaaatataaatgaatttacagttatgcacttgaacaatgactacaaatctaccctatttacatctaagtgcacagtagtgaacaacccctgctgtttttgcatttaggatgacaaatccaacttcttacacaaagaggagcaacagagcaggatataagtgacaacaaatggcaaattccattttgtcaagaaactatacatcacatatgaagcccctctaaagaaaaaaaaaatccaccaactttagaatcacatgcccaagaatgccctgcactgtgactcccagtgttccttagccagacgaacacgttcaacccgctccatctgtattctcttctcccagtactctggacaactgtcaatagatgatccatattaaatttcaacttggtaacaatccttgtccttttgcgataaacgaaatatggtgataatctatgttcatgacataaaaaaaagtgtacatttgtacggccgtgcagatgactgatgatatgatcctgagcagttcagacttacctatagcttagtagcatgttcagctcatccaagtgtacagcattaggaaagactcctgcctgaaatgagaaatcaggtcagttgatgggacatgcacaagcatatggtcatcaaatttgaaggaatgttatctaaaacaaagatcgaattgaaggaattgtttatacctgtcggcacagtgggcactttgatttgcgctcggcagacttcagcccatcaacgatcgtaacggatgcagcagaacagctgcacaagtagcaatatatgtgaccacaggaaagagcaactggatcaaacacggtatcctgcaaaagcaagtgaatttcagaaatttacaatgcaataaggaagtgctatgaatttcgcagtaacaaggaacaaagttgatacttgagcacattataacaaggagaatataacctaagtacgaattcatacttcataacataaaaaatttagtgtattaatgatatccttgttaggtaaattaagatcttggtgcagtcgacaagtgcaaactcaccaagcaaatcgaacatgtcaagctaatgtcgacacgcatagagtcaaagaggttgcatgaaattgttggtttgtcatcatcgaatacgagagaacaatccccaaagagctccatagcaccgttgttcttcttgcttcttctcaagttcatgtagaaagccatcagctcacagagccatggggattgaagtatttcaatatgcagactctgggcttgagctttgaattcctgcccttgcttcgagtaatgtatctggaaaagagaggcttttagttaatagtcttacataattattaatataaccattgaggaccgtcttaaatccaaagacaagaacaatgatagatacgttaattctaacaaaaatagtcactagaaagattaaatatataaatacaactcaatcatcctctgtgtgtgtgtgtatatatatcctcgaagataccatatgagtatatgacccattgacacctatatagactagcattttgggcttcaccaaactcacatgcttataactaaaagtgtgtgaaatttttgtgttcctctctcaaataatggaatacttatatagttatcttcccccttcgttcggtttccaaaaaaaaatattccccctttgtccttagtaagctttaaatgtttctaatgcctttaagagataaagagaggtgcaaagattaaagtttaaggccatgccttgtcatatttctttaaaattttcctcatggccacggcatttataattgcataagtaaccaagtctttgccttgctgtatcaatgccccatggctcttgtgacccttgctggtgaaccacattgtatatttcttgaaacctgatgccaggtgcaactcgagaagcttcttggccttttcattgaagcagccaataacggctgacatctcattgagaagagatgggaaaaaactcccatcacatactgcatgttgataggaatttgtcagataaccaaccatgaaaggtaaggtagacaaaaataaccatcatggcgactctaatattcttttctaggcaaaccgcagtagttacaatatcaatatgaaagaaccaggaataatcgactcttttaggactctgaaatatttatatcaaaaccatcccaaattatagtagacaagtcgacactaactaaaataatcgaaagttattcaaaaggacagatgaataagcccctgctaatgaatacaaaattaagagtggactttgtgatggttgacatccccttttccatggttactacggcctatagtatcttggcacttgaaaaattacgtggttgtcattgacaaacaattaccaccttgacaatgacttgcactattataatggggcagtcaatgggctatctctagtagtgttcaatttgaagttatgttataaatctgccgtccacacgacagtagtatatgcagattttccaaatacccgaccgatcaacttaatttgttggtattgatgtttgaaagcaaacaaaacattatcgccattttaaaatccaatcttaaccatacaaggggcgacagagaaaatgcttcgaaagaattgtgctaagaagtcaaattgttgctttctctgcagtaaagcttctcttccatgcgaagctgtaattgtttgacactataaataaaagaagtacagcgagaacaaggtaggatacatatatctaaaggataaataagagaaaataggttggcattcccaggaagagttcaacttgccgaataccaaaaccgctgtgtacagcctacaggttcctctgttcccgcagaattatcaactagttcttctcacttctcagcacgatgaaactaaaaaaactgaaaaaaaaaacaattgcctcttgcaagttgcaacaagtcctaaattctaatccttttctaggtatgccattttgccaagggtttgtccttttttaaccaaaagaaaaaaaaagtaccaaaaggcatgagcccgcccattaatcctcgttttcattgaaaacaagaaaccaacaggtttcttttgaaaaaacagcattattttcagtgtaagagaatcaagaatagtcctacgcatcaaagagaccatataggaggaaattgaaaggtatagtagctttattcaccagagcaatggccggggcagcggccggcggaggagccgtcgttctcgtgggattggaggtcagagcggcatttcttgagcaatttcttgagccgcttcagccccacgcccgggagctcctcatccatccccttcatgtacttctcgtacttcttggcaaacttcatgaatccaaatttaaggcaaacttcttggcaaatttttggagcgcttgaatggataacttgtacgcctatggcgtctgcaaattgatggattcaaaatcttggggtatatatatgtttgtgcgatgtgagtatgcctgaatgacttgagaaacgatttacagggtgagctggaaacgaacaaaacgaatccaaatttgtatagctcgcggacgaattgggggggcacggttcagagaaggaatgcacatgcaacaagagacggcaatcggaacaatggctaaagaaggaaatggaggaaaactgatgaaattaaaccaccaagagaaggcaaagaaaaagggcagcgaagctcacggagatgaagagggggccagaaattcagttgagctcaggcgtctcacgtgagacagtaataagaacaaagaaagaaattaagcttttaggattttttttccgagcagggtgaaacgaaggcaccggctgcgacggcatcgcgccgaatatatacaagcgaggagaggggaaagggtggcgccatggtggatgtccatgtggcgcgctcgcgtcgtgaggcggccgcaacggcggggtccgcgtgagagcgcgagatgatgatgatgttccgtgcggtgcggggcgagcgtttcgttgcgtttttctctcgttttcccccggttttgtggcgcggggagcgtgcgtgcgcgtgtgcgcggacgccgtcggagcggacaatttttgtggaaacagaatttgatcggcggaattcagctaagctcccacgcaaacctttgaattttgcaggttgcagcttttttttcgtgaacgcgcaaaaacgattgtacgtcgatatattagaagaaaaaagttacagttacacaaccgcactcagccagatcggcttttgcagccttttttccttccggaaaacttgtcaaatcgtttgatttatattattgtcacgtgttatctacttaattatgagaatatattaaaatttttaaagttctagctaaaataagtggttagcaatacagtagagaaaattttagaataattgtttcctgtcgtgtataaaatcaaaaagggtttattgataaaaacttgttccaaataaggtcgtatacgttttgtgatttcataggtatggtcaagaatagtgtggcctaggagaagacgagagggaccaattgacgcatgaagaaatggaattctcgctttgcagttatgcatctatatcaaacgtgggcgaatttggatagggcgacggcgacgtaaacgaaaaagaggcgtgcagttaactaaattttagttgaatcttgtggctgcccgtgctgctgtgcctgatagaaaggcgcgtaatcggataactgtcaaggaaagggttgcgtttcgctacctgtttagtttagcctagcttccaggtctcaatcctctgcgtccgtcagatattctgcgtactagataagctagcgtctaaagccgtaaagcgggcgatatacatgcttaacggtctacgcctaagaggtaaaattagataacagttattttggtcaattggacaattgcatgcaagtaaagttttcctttcttttctaccaaatttgatacacacacaaatgcaaatgtacatatatcataggaggcaaatgtacatatatcataggaggtagactacagaacgatatactgttacaataaaataactgacatcatcatggtacagttagacatgatacctactagtatcagatctggtacgtgggtatcatgctgaggtccgtatggtatagtaggtaccggattccaataccaaacataatacccccatatcagatctattacctaggtattatgttgacattagttatttcgttcgaacggtatatcgttttatagtatttatgatatcatatttggacgggtatatctcaatattgacgaaataaccatatgtccgagagattggacgatgtatcttgaaattgatgaaatcatcatacgagccttgctagttggcatatctcaaaattgacaaagtcaacatatggttcattagcacacgtgtctcattggtcgtcatatcttaaaagatcgacaaaatctacatacgtcttgctatcgatggatatgccatatatcaataaaatatacttagttgtaaatatgagaacccatggaagcacagaatttaaactctggtgcaacttaacttcgcgcactgacgttttctactgctaattagaatctcagttgtaaagtttaatacgagcagcacctaacctgaaatcaaacctctttttcttagtgatcataattgctcacttttgacaatgctaccactttccaaacaacaaagacagaccaacaaccttcgtggtaaaagatgaattagtgaaagtaagcatgcctagagtagctgctatgcatattgagtcgtctgcttaattaaacaattctccactaaattgttccaaaagcaaagtagatctcaatctcatcgattttttccagtaccggatacaatcacggaggacaaatttatgtggcaccttttcatcctcatcttgggtcgtctcaattctcaatagacttttccacgagaaaaggatgtcacgatatgtaattaaaacatggaacgataatactactgtacctaccatatgaatattgttattcaaacgacgtgaattcggtttgcatacttgcaatcactccgttgtcgaacaggctaacgaatccttgtgctaattgcataagtagttttcaatttggcataatctacatggtcaaatgtggatgaacatgcagtttgaaactggatcgacttcatgacctggtagtagtatacataccgtgtccttatcggcaacgtactcttacccggcaccgatttctcgtgctcgatcacatgaacacaccatgacaacatccagtttctaacagcaataccttaataggctagtagcatatatttatcagcctaaacaactatgtttattgttagagaatgcttcttccagtgtagcttccagtgtagcaaacagtggttggtttcttaatgcgcaaatcaaaccataaaatcgatgtcaccttgcccacaaaactggcggctgctgtttgcttgatgtaaagcagcggctgctaagctggtggcatatatattctccacgaccatttgcctgccacttgcttttatctgtgaatcagtgaatccaagcagggtaaggccatgcaaagaaattatgaaagcttagcgtagcgaagaaccttactcttgcagtactgttctgaccactgcatcaattgtattttgtcatttggtcatttttaaatgattcagggatgaaaatatcaaaattactttgtatctacgtaaagtaggtagtaataatctattacgcaatatgatatattttgcgatatatatgtctatttggagaagcttcagttgtaacgtcttaaaatttctagctctctaaatagtccaaattgtcaagcagattctggtaatagttatataatccttaaaactggcttccctagattcacactagctgctctggaaaacactgcctcccccaaataacatcataatctagtttgctaattgaaaaggataaagagaagaacgttctggagccgtacggtttctgaatctgtactattttggcccggccatggcccatggattcacgggttatttatccctcaaaacggattcttgttttggattcctgatacacttcgatcctctgccgcacacaacacgcagatttgattgaggtcaacgagtaaagaggttgagacaacagaccttgtctagcgataatgcattagttagtggttgcttagcggtgcctctgtttagtggcatgccatctttgatggtgatattgagtaaagttttttgagatttcggacgctccaaaactacaaatagctagctggaatattgggcctcatcggttacccatattccctaataagcccggcttattaaggaataataaataatttataggaaaattttttatatatttgttcgtaccgacttaaaagccaacgctaaaaagaaataatgctaaaaatatcttaaaatgaactccaaaatcaaatcaagttcagaaattcaaattttagcttttgatttagcttattaggtgaaccgatgtggctcttggttagctagctctgtatccagatagacgttgacctttttctgtcgtggtagatcagatgcaatcagggatgaattgatggacatttggacaaaagtagcatggagatggatactagttcttggacggaagaatcagattctcttcccttttgcagtggaggctatggcctacttcttacctgtccaactccgatccaatccaatccaggcgagaacgttgctaaacaccggctgctgcgtcctggattagagagcaaagagaagggtaaatgtataagaaaaaaagggggctgatgagaatcaaagcttccatctgaactgaactgaagggtgagaggttgaggaaagaagaagaagaagctcaatttcggcccattaacatcggcccaaattgttagaagatgtgggctgcaagcatatattgatacatgcattataattatactcagaattcaacagaacacacttaacaatattttcttgaaagacttaacagtaattctacaatctagatacggtgattaaatgtttgaaacataactcaggatgacagagaacaacacgctaatagattatagtccctacacttaacaatattttcgtgaaaagaagcatatatgtgtcctttgtgttacaaaattctgaatacgttttccaactagaaaaaatgattaaaaatcacagaaatgcagtgcagtacctagtatagcatcctacactatagccttgctccctcatgatattggacaggaatgcagcagttgaacatttccccttggtcccagcaatatgaatagcctacaatcacattcattcagttttgtccaaatattaatcacattttctccattcaaagtaaaatcatgactcatatgcaagatggcagctgcctaatacttgaaagaaacaaatgtcaatgtgccatgcaccagaaaaatcatatatgtttccttccttatgattttaataggcagtttcaaggcaagttgtgagcctctggtgttaaggagagggtgaggtctcagtcactgggagtgtggagttcacaaaggcggccgaggtgatgcatgcggccaaggtcgaagccattgtcagagttggtcccggtgctgtgtggcactccagagcaatccatgtactcagagaaatccctgagatggacatcctcgaagttctattgataaagcaggaagaccagcggagtgagatagcgaagcggaggagcatacaatgaggtcgtactgccgtcgcactggcaacggcagaatttgacggagggagtggagataccaccatgtcgctggagagtagtggcagagcttggaatttttcgttgggtgtgcctacttcacacaccaaacttttataacaacacaaaccacatatatatacatgtacagatttccccttttgttaaatgtgtaatgcaaatatgcgacaatatctcacagcattgctaatcgactaaaatcacgagaaaaaaagtacaatacagatagttccaatgtaaacgatcttacataaatagaagattacagtgctgctactttgcgtgttctcttagccttgaaagtttgtagtactgtcttcctcactactatggagaaataaaaatctagcttaacaaatgagactaaacaatcattcaataattttccacacatgctgtttcacaaattgttattcacaaatcacaggatagattctctatttggattaactacatcactgatcgcgacaatttcaatcacaaagttaaaaccatactgaggaaaaaaaaacagtacaaaatgagctaaagaattacctgtcgtcggcgaatggctaaatgcctaaaatcagtcccggtcagtcactcagccggtggtagcggcgggcggtggccggccggcggggggcctccggcccgagaggatgaggatggggcggggcgactgagcgactcgagatgcgagggcggccatatgcggcggacttggcggaggcggaggaagatggccgcggcaacggcagaggctgccatggaggatttccaagccacgaaggcgtcggcggacggcggaggctgctcggcgtggaagcggcggcgctgggctcctctctacggcggcgtctgaattgatcctctccgtctgatctgtatgtgtgcaggggtaaatccgtccactcaattggggatggaaaataaaactagaaaaaaaaaagagaatggcgttaaataaacaattcttattctccgtgcaaaatgctaaaaatcatttaaattgattggcaactctttggaggctttgcacgatactttgttcgttccaaaatatagccatctttaggtctaatagagattaaggttgaaaacagatattgccgttcggttaaattatttattaaattttgaattatttatgatctgttttcaagcttttgattgattgaaaatggtttggacttttgtacattagaaatagtttcctaaaaaaaattgtgatacgaaatttaaattataaaattatgttttggaatggagttgtaagggataccttgcggtacactttctgctccttaattttatcccttctctaattttctggttttctcatctaagatccacgccaaaagccaataacggatgtaatggagctggaaagaaaacgcctctttctgagtcagctgccagcattttttttctgaaaatgagcgatatatataaccgaaacaaccatcttgtttggaacgtcatctttttccgagatcttagaacacggaatcaaaacaagcatgatattttctcaaaaagaaaataaaacaatcatgctatctactcaggaaattcctggattgcagccacaaaaccagcggtatctctgtgtttagttcgctaaaattagaagtttgattgaaattgaaacgatgtgacgaaaaagttataattttatgtgtaggaaagttttgatataatgaaaaagttaaaagttacaaaagaactaaatgcccagctccagatacctgtcgcaaccagggttcaccttaccgttttggggggggttaccgaccccccgcggtatggtggttaccgcggtaaccgtgcggttaccgcgaaaaaccgcacaaatttcgtttccaaatttttgaattcaaaatccacggtatggacacggtaaccgcacggtttagtacggtaaccgcggtaagaggacggtaaccgcgatatgttggaactgaaataaaaaaaatgaaaaaaataatagaaaaaaactaaaatgtgagtattttagtttatgttggaactgaaataagaaaaatgaaaaaaataatagaaaaaaactaaaatgtgagtattttagttaattaagatgtggttatacaacagaaaaattcggcatgacctactctatattgtagagtccacagtataatgtccatgattacaattctagttcgaatgaaaggaaataaacaaggacatgcatagctacgcattccactgattatatgccatattgtactcctctgtggacatgagcatcaagccatgtgaatgtagcaaccccgccttgtattccttccaactttgacctgtccatgatgatgttgtttgccactgagcgtacaattgagcataccactgaggctcttgccattcatacacccatgtagtagcaggataatcagaagcttggggacggttgtacacatacgttggatagccactttcaaagctagaggcactgaatgagctagagctatcctgttgtatgtcactgaattgttgctgttgtcggactcccggtgcaatggtagttcgttgagagcttggagcaccatgatcctggtcctgagtagcatgagtgaagtcgccctcacctgcaaatcaaaaaattgcaagaaaattatccagtactgaattggaagatgaaggttgaaattgcaactgaattatatcacaccagtgaattgaacggggctgtggtgatctgattgttgggtgtgacccctaggaggcacattagtagtgccttggcctccttgaccatcgtcgtcgccgtcatctgtttcagttcttgagctactatcattggactcttggtactctgggctttcttgggtctcttcatcgctatcaacactagtcgatcgtggacccttgccctttacctttttagatggacgtgcttttggcggctttcgagtcttccttttcccaatatgagtgtcacctacattcgtatcagcccactcagcaatactagaagctcccgtggtccttcgcaggtcatccaagttgactaggtcagacacaagttgactaggcaggggagcgtcactctcagctgaatcttcatctagttcggggcaagcattagagcgagcattgtccatccaggcactgatatgattgttagtttcatagaatgagaggtccgctaatctttgaaggggatcatcgtcctccaccctaatttgggcatttgcttgctgaattcgaaggcgaaggttgtagttcacgtacactagcttgttgagcttcttgtgggtaagtctattacggaccttcgtatgtacgaatgcgaatgtgctccaattcctttcacatccactggaggagcaacattgaccaaccaaacgcaacgcaagcttcttcaaattcggcgtgtctgaggcgaacatagaccaccattgtgctacaaaagccaagtaacatgtcatttcataattctgaatacatcaagatcaattagatatatcatagttccatgattagaaacataccaggtgaagttttcccatctatggccatccttcttgctagtgccctcccaaattcacccgtcttacgtcggtacatctcaacctccagcaaagcggcggcagccgtatcgatatccgtcatccactcgaatgcctgtcggaggtcttggaagacagtagcacttggagaatacgcgtagtgcgtcctagggttcaatgcggcagctacaaaacatggcacaggttaagtaagagttacataatatgccatgtggattatgttatgaccaatatttaccggcattgatgagagtctcgttggttaggtcgtgcatccttctgttcacgatttccatgtatgcttcaaacttgtccctttgattcgcaaaaagactgtcgtactccattttgagcaactgatatctcaaaagtacctcactcaaattggggttcttgtcctcgtcagcaaaccgaaggaatgagtacataggttggacaaaattcactactgcctctaagttctcccaccaagacagactagatagacatgcatgtgcatatctaccttccaaagtcccactaaatttgctttgcatgaagacagaggaagccatccattgcatgaaaagatctcgcttcctaaggaaactctggagaaacatgtagtttgttccgaaccttgtagcattccacttaaccagttcaccacctatagctaagaccatcatagcatgcaacttgttatgattgtatagccatctgcaaattttcctagcactctcaatcaccatttcgtggtctggcattttcccaacctccttaagcatcaagttaactgtgtgtgccacacaaggttgccacacaattgtcttgtattcttgccgtagtagtctgcacgccttcttgtagttagagccattgtcagtgataatttgaacaacatgctccgagcctatttcgcgtaccaccttccttatctcctgcattggtagataacataataaaaattagtccatgcccctaacactgacgataacaggtgatgaagtaatttgttgcatgaaccatacataccttcagcacaaagttagcatcctggctttgcccggtcgcatcaatggacttgtggaaaaacattattccattgtagtatatcagaaaattgatgaccgacatactcgtcggacctgtccaagaatcacacattatagtaacaccgtactcatcccaatccttcttgaacctatcaaattgcttcttcacatccttctctttagaatcaagatattttccatctatctcgttaccagttggagaaggtacactttcacctacaattgacgtatgaaataagtagtgcgcaatgagttagaaaaaaagaagttccttaatagatgcatatgtaccccacttttgtgtctcccgaacggcgctcacaaagtatggattatcggcgtttctaccaggaatgccggcggtaaagaagaaccttgcccatgactcaccaatggcttgcctagcttgcttccccttctttgtgaagaatcctatgtcaatgcgtggctgcacaggggccttggcagatgctaggttgtaatctctcacagcaggtgactccctatgagacgtagcccttcgtagcatattggtaattgggttacttctacctttccgtgcctccggctgagcggatccactcccaccgccatgctcataagtgccaccacgctcctcaacatccctcctaaagttttcgtcttgtcgtgaggctgcaatggctgcttccatttgttcctcctcgtcggcatcacctgttaggtcataatagttgacccttactgcttcaacccttcttccgctatcactcttacgctggtcacctgcatcttttatcctgtccaactcacggcagaagaactcacggacatccggaggcactgaattgcaatatgtaacccccttccctcttgcagccaagtgttgctttagtcttgttgccccaccaccgcccctctttgtatggcaatacttacaacgccatccaggtgggatattctccccgtgctcccacacagggtccctactatctgacatctccaccctgtatcaaatgcatgagaaattatcactgctaattataaacatacctcccattatacaataatacgacgtaattatatgtacactggtaagcatgcatccaaattcttccatactatgacgtatttaatttaacctatatgtacatagaccaaagcaatcaaatatacttcacatgcatggttttagccaagcacgggcaaccaaatgccgaaataaactcatattcccaatgtatttcacatgcatattggtaaaaatatgttctattgacctaaatccccaaatatgtccatgcatatcacagtaaaaaataccataccacggttcaagccacggtaaccacggtagggtggacggttaccacggttttcacacgattaccgcacatacgtatatcgtctcatagattacgaagccgacggtaaccgtacaaaaccgcacggttaccgctcctaaccgcgcgaaaaccttcaaaacggagggattacctcttgcccgtcgacccaggcggttaccatctcgtaccgcgcggttacccgccgcttaccgcgagggaaccggcctcgccggcgtggaggcggcggatcttggcgcgggcgcacgccgtcgccccttcggtcctgagcgcagctacgcgagagaggggaaaaacggtaggattcgccagagaaacgaagcagaggcttccaaagatattttcctcccattgtgggccttattgggcctcgtgaacagtgcatacttggcccattccatttaatcttttttcttttttataatt

SEQ ID NO: 79550 - DNA, 9458 bp, Oryza sativa
atccacacttgtcaaaagatttctctaaacaataatctcctttaagccattatgaagtcaataaaccaatcagatagtcataggacatggaatacagatacagcagatccccaaatctcagaacgactaaacgaaatagatgtactttctacacaagtgtccacccaaaacatgattccaccaatagcatgtgaaagcgtaaaaaatggttaagcccaacaaggatggtcataaattttctgtagggtgagtttaactccatattccataatgcaattaagtaataatcaaggagtgaagtaaacaaactaaagtagttatcatttgggactatcatttatgcaattccttaccacatcaccacatgatgaatgcatagaaatcaatgctctctcaagcacatataagtccactgctttgtcctcaggaatagttgatatgaaactcagaccaaaatcaataagaacctggaatatgaacacattgagtggcacattaatagctcggatgtaagtcttgaattaaatgactcaagaaaatgcatgaactgacagaaaggaagttctacacacgagttgatttgtgttgttcttgattatcatatttgaagtggtcaaatcaccgtgaacaaggcctccatcatgtagtttgccaactgcatttcctatttgtgtggcgatgtcaatgagttgttcttcattgatcccgtttgacccaaatccaaggagtatatctttcacagataagccatccacatactcaaaggttaatgtatgcagaagtgggtccacggcataaagaactggagtgggaacaccaagctttcttgcttttgtcatgcatcgagcttcctacatattgaagagagaatcaagccaacacgaatttcagtcaacataagtagttgtgtgcaaccttttttagctaaatattgcagtttaccatattactacaactcaatcaatatttgaacacttttagcctttgatttatctaatacaaagaaaatcagagaaatgctctacacagaaaacaggaatatctaaaaataaagcatgttagttatggaaactgacagcatttaagcgtttaagagtcaactttgagtccaacaatgggtgtcggtacttctttgaaaaccgctctttgattacacacttccgtcccacaaatgttgaaacaaataccctctgcaacaaacaaaacaaactatgaacaaacaagtaaaagtaagaaactgcaactaaatatattgactcctgactcactccctccgccccctgcttcagtagcacaccaaaatcctgttgttgttcctgagttgagtccataagtataacgtgccctactgcccttcaatcgaaaactgcattggagaaagaaaaacgagcgaaataagatgtcagtcaaacaataaaaatcaaccatattgttgtgctttgtgaacaactttaacattaggagtagctgctcaagaagattataagttcatttccaaatcaataagtggggtggcttttctatttggcaataagaatagctgctttactgatataaaaacaagtttacattgaattaacaaatgcacatagtaatgtgaatggtttgcagtgcctttacagtaacagctctaacgaaactaaaccttaggtgattatgctcatgttcagaaaaaagatcgatgcctgagtgactggtaacacgttaacaagggttatcacaaaagaatttcagaatcaaatagtaacaagcaaatctactcaaacatggtagtacctagaccctctatttcctcgtggctgctctagcagctcccttctttcttgtctcaactgaaccaatcttcttcttttggaccaagcgcttattgctctgcgaactcagtttttgtgctgcacaaactggtctgaatacctctgttttcaggggatccaaaagatcctctgaacatcctaacataaagccattctttttagcatcatcccacaactcctttccattctcaaatctcccattcctacaaagcttttctataagaagatcataggtatgtgtgtccactaactgacacctcttcataagtctgaacatatcaagcccatggtcaactttctcagtcccgcatagaacgcctatgagaccatggaaaaactttgcagtcggaagcaccccactttcaagcatgtcatctacaagccttttccctctaataattctccctgttaaatacaggaccctgaccacaagatagtaactaacccagtcaggggagcaccctgcctttccttctctcatcaagtagaggattctgtatgattctttcactcttcttgctcgtcccaaacaagaaagcaagatgttgaggctagatgcatccggggtgacaccataggacctcatctccgataagacgtccatagcctcagtgacaagcgcagaagggttaaacttgaggttcctatggcacaggcagtgcagataatcattgaatgatggcaaacccagtggggtacacgaagacttgatatcatcaaggactctccgagcttccttcgcattcccatggacgcaccacccgtggagcatgctacgctgaacgatgctaaccatgggttctaccgagagctcgctcttgtggtgccacacgacgccctgcgcctcgcgagcatggcccttcatgcacaatgcctgcaccattgcaaggctgctcgaccacacgccttcccctccatcacccgcgtcgcgccgaggcagcaacctctgcctctccaagcctctaaacaaccgaacagcctcatcctccttccccaatttcacgagtgcctcgacgacaacggtgaacgtctccggggacatcctccggccatccttctccgcgtcggcgacggcgatcctcatcgcggtgaggtcccccatccgggcgagcgccgcgatcgcgctatccaacgcctcgtccccaattccaccggcgtccttggaccggcaccaggacaggaaccgcagcagcctcctccctgaacccatcctctcgctacacgcatcgatcaccctcgccaccatggccggcgacacggccacgcccaggcggtccagcgcgccgcccacctcgtcgaggctccccgccccggagcacacgacttcgcgcgccgccgcctccaggtcgctgcccgagcacagagcgcgacggcccaaggccaccatcgatctcctcgcgagcgtggccatcatggtcgtggctaggtcgggaggagagaagagggagggggggaatgggggaatggatgggttggtcgaggcgggagggagtggggactgaccttgacggctcacgaggatggtgatggttgtggtggttgcggttgctaccgtggctcgctccggtgatggcggcgacggcggctcttcgccggagaggagggggacgacggcggcgctggggcggaggcggaaggggaggaggaaaccctacctaaacctgattaactgcgaaggcaaatttgcacattgaaccttcacaatccttgattttggtgattaatcctcctaaccctttttggcttttgtgcttagaacctactagtaagtgtgaaattcgagcgaaatttatgtagttccaaacataacttccacaagaactgtacatagtttgtgtgtttctcgtttcaaatatgaatgaagtttcatgagaaaattgtagccatatactaccatcatgaaaatcatgatcagtgttagaaagtctgagttacccagtaactccaatttgcctcctttgctctatagatgaacgggaatatgtgtaacaatcatgtactaataaaatactccctccgaccctaaatatttgacgtcattgactttttaaaacatgtttgaccgttcatcttattaaaaaaaatttaagtaattcttaattcttttcctatcatttgattcattcttaaatatatttttatgtatacatataactttacatatttcacaaaagtttttaaataagatgaacggtcaaacatgttttaaaaaatcaacggcgtcaaatatttagggacggagggagtattagtctagtttctttagattttttgccacaaaatttgtcatggtatatgcactaataacagcaaagcgattgttctcctgcgcgcatcttgaagttgaacgctggaggataaatgaggggaatcaatcaggaagtaaagaattaagaagagtagcaactccttctaggccaacatttggcatcatttcctcatcaataaaggtgctggtacaagctaatgaaagaacaacacagcattagttttttttttttcctaaatcattgtcctcaatagctattcaaattccataagaaatctgactacctgaccaataagacctgtgtcacatcgggcaaacagagtgagttagcgactctgtccaaaaactggctatcaactctactcaatctccatcaactaaactccatgcagagccttcgatattcctcttatcgtatctggacttgttctgcagcaaccccctatcagtgaggccccagcctcatgccattttttgacatatgaaacaaaatcctcatttgaaatccctgagcattcctgcatggagtttcaaagagctgtattaatcgtatacacattaacataatgttagcttcagatatttgaatagaagatactatcattttgccatctcattctcatatatgggtataaagaaaaccaaattttatcctaatgacagtagaggttcctctgttttttttctttgaaatagttttttttcctaatatttgcaagtcaacacgaacacaataatgagtagctatattgtcaactttatcatgattcatttaactggtacttaccacccattcctttcttataggatcatagctctcaccactatttgggtatattaatattggtttacttgtcacctgcgcaacggaaagtataaatttattatgtggtcaatgatgtttagggatcaatacaaccgtaataggagttaccttccggatggataaaactaattcatggataaatcttgggggagtgcaattaataccaactgcagcaacttccttgcatgaatcggcaatagaggcacactctatcagggaatcaccacttactacattgactccatcctttgaagtgaaaccaaaccatgccggaatacgtaatttacactcctctagtagttcaacatatgcctgcaaaagatcatattatttcactgattgcaactacattgatcaggccaacaacgcttatttggttagtttgaaacagacgaactcctagttgaaatgtacactaaaagaaagttttcttgccagatttttttttacgtaactgccaaatccttttctataagtagaatcagcaaagaatgtggaagaaatgctgagcttcaacaaatcaaacataatttgtgcaacaaaaatactttttacagtatcccactgaccacggatcatggtttgaaatatatgtccagtattaaacaggtaatggactatgctatgttgactgaaatactccagtacaaaaagatgagtgttaactcagtatcaattgcattgccacttctatgtctatttatgttccttactactttaatctgcattacaatatacagttccactttccaaacatacctgagtctcaattttgtttggaatagtttcaaaaacaataacatcaggaccagcttcagcaaggacttgaagccttctcagatgaaagtttttgaggaactccaaagtgccctcattaccgtagtcaccactgcagaaaaatttagtcagatgtaaaatatctgaaagctctcaacggaatcagaaattcagaactgattcaggcaaaaagtttcctgaaccattaagcaaatactgatacagattgctcattaatttcattattgttaaccaacctatactcagagccatctgctaggtatgctccataagaaccaactgatgccgcaattagtattgggcgcttcctgtattttgttacgtctttggcttcgtccgaaccgttagaacatttttccaggtaaatagcccgtgcttcacatgctagttcaacactcctcctcaggaatgattcactttcctcctgagaaaatccctttgaaaggaagccctgaattgtggcctgtaatagcaatgttgcatgctaattagctgcttatcatcaactttacttgaaggatgtttgagaaaccaatgaatatatacctgatatgatcctgttatcagaacacttgccccagcttcaagatagtccaaatgaacctgttcaaacaaaggcaacgcgattactattcactcatgagttatgacatgcaatgttggaatcaacaaaaagaaaaaaagaacacccactataatatgtttcttatcagtatggcttcaagcttactccctccatcccaaaaaaaaccacactgattgtgtcacatcccgcacgtggttggtttattttggaacagagggagtacaccttgattcaggttaaaaaaaagaaatatttttctttttttttgttttttgctaaaccattgaactgaagttcttgcttcctgatttccttacacctagaaggctagctgagcacatatgacacagcaaccacactgtaaagtacaacaagtctacagagaaatcggatattgctggaaaggcgacagtgctctccttttccgcagcaaaaatcaggcattccacatccctgcagcatctaggcttctcagaacggcgagatagctcaagccacactgagacaaagctccaacacgggccaaaaaccatttcccccaataggccaatataatagattcggcattgcatcccccattgcacatccagcgaaccaaatacacacgagacacgacaagacgcgagacgaagcaagcaggtgtacgaatggatcaaccgagagcgcaaagggggagaggggcagatgaggaggaggcggaggcggaccttccggatgaggtcggggcaggtgaagaggcaccgggcgctccagagggcgtccttgaggtcggcgccgttagcctccagctccgtcgccagcccgccgtcaatcacggccgcgccgccgctcccccgcaggaactccgccatcatgtcggcgtggtactccccttgttgactcattttctccggcgatgtcggcggcgcgaggagcgggggagagagagaggaggagaggaaggcgttgggtcgtgtttgtgtggggtttaagacaggggagaggggggatcgtgtgggcccgcgttgtcagcggctgtggcccgcgttagcatgcgcattgtacatggacagctttgcagttgcaggtgggggcatatgaggttcattgtacgtggacgcggcagggaaggtcttttttttttttttttgcagccatatctatggcgtcatattttttatcaaaaaatagtcggtatatacttacattgtaagtccctaaattacatatataattttagtgtatttacaatgtaagtctcaaaattacatatgtaagtactaaaattacatatgtaaatttgaaaattacatatactaattacatatgtaagtggggtgtaaatgaggtgtaactactgtgtaagtggctaaaaaaaaatcgactgtagcatatggcgccatatttctagcaactccgttttttttaggttttcggacattggttccttgggtttaggctgtgggtaggactgtaggagtggcaaagagaagagggaagatacgtagaacaagttagtctatcgttaattgagtagagtattaattattttaggtttaagaaatggattaatatgttctcttaaataacttttttattgaaatattttgtaaaaaaaattaccgtttaaccgtttgaaaaacgtacacgcattaatcgataattttctttttattgtgtcgttcaaacgaacacatccttacactgtgttctccctaatttttaggagtgattggattttttttagtttatacttcttccgttcttaaatttgcattcaaattgtataccataacgtaggtattcttgcactaaatcctattattttcatcatttctatttctatggttccaaagacaatgagatgcttaaaaatcaatttaaaacttaaaattgacataaaatgataaaaagaatcgttttgacctaattttcgtacgtgctaaataacctaaaaatccttatgttttagaactgagaaagtatgagcttaattaaaatttttgaaacatagtaaaaacacagttaaaaacaaaccatcacattattaaaaggggcaattttattcgtatttttaatgtttactattgattttattcttcttttttaggttttcaattttgcccttattttttttctgaaacgaaccttagttttaaccctaatttgtatggacatattgacagtgttaaatcgttggcaaaaagacatccatacccttacttgctattgcaagtttgacaaaaaatttgatagaatataaacaaaatttgacataattgtgccacaaattgataaaatttggacacattttgacaaagaaaatgatagggcacaattttgacacatattttacacaagcagaactgtagcaagcatcacttagtcaagaaaatccaaatcacaagtcaagcaaatccactcccacagcactcccacagcatgttgctcctcccctgccacttcctcaaaatcaagcaatatccagtcccgaagtcgagtcgacaccaattgccatcgcattcacctcccccccctcccccggccaacttgttgtaggaccgcacctcccttgcactctgctcacggtgtggcaccgcagcctccggctcctcacgttgagccatggcctcctactcccagcactgagccgccattttcgtcgtctccttccctccgcttggcggccgagatgtcgctatcgcttcctctccatattgaaccctcgccgcttagctgagccatcacctcctgctcgtaccaagcccccgccgcgctcgcttcctccccgcgtggagccatcgccgccctcgcttccttcctatgcggtgtcgttgccgtggttgcatgctcctcacgccgagccatcggcactttctccacgcatggagctgccatcgctgtcacattctccccacgcggacctgcagccgctgcttccttcacacgctcaacaatagattggagaaggattgagaaaggattggagaagtagtttgcgacagattggctaaggggctatttggttcctagcgacactttgccattacttgccaatagaaattgccacaccttgcctaaggtgaggtgatcaaattgttagtcacaacttattaagcctaaaggaatcttgccacatttttttgaaccaaatgacacgtgggacccatttgttggaaaggaatc

SEQ ID NO: 79551 - DNA, 8239 bp, Oryza sativa
tgttttcctacttctttaacccaacaagcacattctactaacttgtgccaaaacaggggcaaatgtctggttaacttagaaaatacagggacaaaaataaaagcaaaaaaaattatgggtttacaaattgcgatgtacgtagagaaagccatgtatgtgggaaacgcaaattatgggtggatatagaaaataaaatcttgtgtattattttatactccatattgctacttgattatttttcttatattttctttcctctcctgccctttttttttttctgttctaaattagtatcattttggcctcttggcctgtttggcccgcttcctgatgcaaggaccagccgagctagttggccacttgtggcacttggcctggctcagcccaattggcttgcctagagctgattgagtatagctcagtcatctggctctttttgcggaaaagctaatatgtgcgcgctggtggtgcgtgtttcgggctcgcgccggcacgcgtgcgcctcctccaccttatttttttctttttttacagtttttttttttgcttttttcccccacttttttcgattttttttatctctagcatgttttgagttgaaaattttaatttttgagttaaaattttttaaatatgaacttgaaagtttttaaatcttgacttaaaaattttaaaaacttggacttgaaagttttcgaatcttgattctcaagttgaaagttttcaaatatcaagttgaaagttttcaaatctaagttaaaagtttttaaaatttgactttaaaatttaaaacttaaatcgaaagttttcaaatctaacttaaaaaattttcaatatgttagtaatgaaatctcccaaaaaaatctccagaatcttttctaattaatatcattagtgttaactatattaactaatatagttacttaagactagggggaggagtgctcgctgcacgcgccagctagcaggccttctctgttggctatctcccgaatcttgacaggtccaaatttgttataccaagatatgtatcagccatatttaagtttttttagatggagggtgtataagtcacttcttataaatgaaggtagccaaagagaaaaaaaaaccattgttttcttatccaacggtcgttataaactgcaatgggctttaggcagcccactgcagggatctaaattgcttcacaaatcgattttaagcccactggcggtggaacccatttgggccttgggacagcgcttgaccattcgtcttattcaaaatatttatatcatgcttaaaaacatttggtgataaatccattaacaatagaataaatgataattatataaattttttgaataaaacaaatggtcaaacgttggtaatcaatgacgtcatacgataaaatacggaggaagtaattgcagtgtaactacgtataacttgtatattaataatagaatactttcatagctcagttggtatcctgcgcgtggtgtgaacaagatgtgttgggtttgattcccatcaactgagaggtttgctaatttttttctcagctcagcacgaatcttcaagtacatcaaacggttaaaaaatcccagcacggcttcaaacgttgaaaaatcgaaagtttcaaccaaaaaaaaaagtatcaccagtcttttagcaaaaccgtaaaaatattaggaaatgcgcccacaataatccgtcatccgttggcttaagaagaactgaggacctcacctcgccatgatgcgactacacctctagaaaaaatggccatacacacaactggactgagatcctctgacgttacttccctatgacttggtggctgacatgtgggcccgagagtgatgggcccacatgtcagtcatggtaaacagtaacgtcagaggatctcaatcccacgcaactatacagggatcatacgaacacaccatgtgcgcacgcgagaaggcgatcgaatccaaagctctctctcgtcgcgtgccgaaaggcattttgttctcgatgcccaaattccctgtgcaattatctctacctttttatcatgtaaagctttgtcaagtatttgggcgtctcctagcttaagcttagtcgtctccatcatggtgggacccaatcagatgcacatctttgtctggccatgatcggacccaacctttctggcattaatggagatgatggtacttgcaacgccgtgggtcggtcgagttgggcttggatcttctgctcggaattcttttatcgattgagattccatttttcccagcttgggagaaaagagatgataaattattggaaggatttcttgtgaaaacctctcttgtagtaatatataggtgggatgcgtatcacgattcgtgatgttgtcgctgggcctgtttgtcggtgactgtttgtgtttatgttctataaggaattttgattgtgagtaagcgggtgtttttttttcttttttttttaacatatggggcctgtggataaaggaggcaacttttagatgctaatgattgtgtttaagcctgagctattttttactgtgcactaagactgtactggttgagctgctttttttgtggccaattctttaattctggaaactgatggggtaacaaagtctttctctgaagacttgctgccaaagcaatgggaagttactgatgacgttttctgaccggcaaatgagagatttcaggcctggaaaagccgcaaccccagctatctggggccatgccatgtgaattgtgatgaaccgttatatgccgttggatcgaaatcagacggcggtcggccgctccagatgtgcaggggaggatgatgactaggtactatgatggaccgcttccatgatttcagagacagtttgggggagacatggtgcaatggtagaggcagtggaccattgcaaactgatcattctgattcaggtttggggtgacagaagtaatatcattgtctgatttgtgtgcggctttcttgatcctgataaaattaacttctgttctgatttcagaagttacaatgatgttctgtcagtcattgcatgcttgtggttcttgaacagatcactgtatcaaattctactactccatcagttaggagtaacagctgttggaatctcggccaactggcttcttgtcttgctctgcttccttgatcacatctttttgaggaacttttgatcagatttgattagatggcctggtctctctctgaagaaaacaaatgcccaattcagctttgcagtgccaattgccaagctgctattattgttcttaaaaaaaaagcttttagaaatctatttcttgctgctggcaaatcatcaagaacccccaaaaagacaaatttccacaagcaattcttgcacagagacctcaaacacccacaaagcagtttgatccttggaagaactgtagtagactccaagttgcatttggattctgaagtctggtgatttttaagtctgaaacaaaggcctgttcactttgatgccaaaaaaaaacttatcaaattttggtattgccaaaattttgatagaatttcttatacagttactaaaatttgacagcaaactaaatgtagctattttttttagcaattttatcaaaatttggtaagattaaaaatagcatcaaagtgaataggcccatggctccatcaagcctatagcctagcgtggcaatccatctatccacgctgtcagattagctagaccggcgcctaatcagcctctccaagctagtaagaaattgcagccacttgtttggaaggaaccaaaatgtcagaatctttgctgatggtggctaacgactgacggcagcttatcatctgaccaaccaaaccaaccactcttctgctcatcatcagtttctttttattgatttccctttacaaaattgcgggcagagaaaagtttacttgtcatcaagtataataaaaaaaaaccagttggtacagtacaacatctatcttggatttctaccattgctgaaaaatgactcgaaaagaaaaaaaaatattgctacacgtactaaatttttcttactaaatttgttcgaacaatcgtctcaactgtttgattcaagcagatggaagttataaaaaatctagatacactcatagcatgacatgtcagtgttagtaagaatttagtaaaaaaaagttagtacgtatagacttttccaaaaaaaaaatcatttcatccgaagaactgctactcggaaacatgacactgacactgtgacacagccaagaatagttcatctacatctctcgactacaaatttgcgagcagatgatgttgagttgtgatgaaaatttatttgcacataataaaggccagcttctgtcggagcgaatcggaggcccgtcattgccggaggcttgggccggaaaaatgaatcaaaaaggaaattctcatttcttggattttcaacattgctggaaaaatgaatcaaaaaggaaattctcatttcttcttctgaagaagaactgctaatctgaaacatgatactgtcacagccaagaacagtgttcatctacaaaggagaaaaaaaatattaattttctcttgctgcaatgctggcatcacaaggatgctgtggctgcactcgctgagggtggggcccacatggccgccgcctggcggcgcccaccggccaggctttaaaattccaccgcgggattaaaaatgggtttgatttagtgtgagagataattaaaaccgtcgttatcctggggtatccaagagaagaataaattggttcaaggtcggaaacggcggcacgcagccactggagaaaattttccagcgatttgtttttgcacacccgatcgattttcgcctaccatttcatgtagcaaagttaatcatccgctctattatgtataagagtcttccaataaaacaatgtgatgcacattgacaatgatagcatcatgattagaagatactagtacttctctactattgttgaccctcgtagcaccgttaattttatctatagaatttacttaaaaaaatctatatatactaaaaaaagagtaattatgactgctcggatggcctgtatattggcgttgtttttaccttgcgagtacgagttacagacaaatttcatccaaattctatcagaaacgcaattttgccataatttctacattaggaacagaaaaaggtatgcctttctatacattgcagcatactactgaacggaagcaaaagctccaagcaacgtgaaatttgtcacggacaactctgcagccacaaggagctcacatggggatcattactctgccgcgtgtcttgatctccggattagactaatcaatcggataaaccagcggcctacaatgatccaatcgaagcaaatcccttggtaaacggcttaattaattattaggagtagacaatactaccagctctggtctggaatggactctggcaacttgtcctgatggagaacccaagaaagaacattgttgagtgacacaatcacagtggggaggcttggaggttggatcacatggacatgacaaaaattaatcatattggttactcaaggagtgatactgcattttagtagtgattaaaaaaataaaaaacatggcacaaccaaatgtcattttaaaggctgagatgaaatgtaagcagtagaaaaatgaacgaaacttatttttaagataaaactctatatctgtattattactggtttaaaaactcgcaatgaaaaataaacaattaaaagtcccaaaatcaattctaatattaaaatttaagaaaataaattttaggtgcatataattttaaaaccaataagacaatggaaaccatttgataagctcatggattaaatccacaccttcattgtactctaaaaatttctacatacgtctttattgtactctataaatcttgctggaaccaccattaatgtagtgcttaactgcttactaatgagctacatatatactttgcttacacacaaaatcatagttaacatactaaccgggtaatatgcacatgatgggttacgcattaaaaaatagtatgaaacgaaggatgcggactaagcatgaaaatgcttagtgtgagagcaaagttacggtgcactttatcatgtagtatcatacaaagttcagcatgctttttaagttttctttacttatctaaaagattcctgtacaataggaaaatgccacaaagggttgtccataacatgaaaaattctgttcaattaaatgccaaaaaattcaagacaaaaattcaaacacccccctataaaacccatcatttcgattcgaatcaacaaaaaaaagctaacctttttcagtagtcaaacaaaagagaaatgccaacaacccaatacagagtttgcttaaccaaaaaccatcaattccaaatattaaaaccgttgcaccagcatttagttttagatttcacccaaataaatactccaatcccagtaatgacgcagttattcccaaaaaaaaaaaaatcacagctcatcgcattagtattaggcagcaaatcaaatcactggaatcactcactgctcctgaagaaaagtttccccttttttattcttcttgctcaattttttttttctctcttgttgggacctaccaccaccttcagtggtaaggcagcctttcttcttggtggcatcgaagcaagcactgcacagcgcagagcaagaagccagactccagactgtgagagaaggggaggcaggatgggttgaggaggaggaggaggaggaagaaaggaggcgacttggtggatccaaggaggccactgcttttgctttgctgctgctgggattccacttggtatgcttctcttctctccctttctatatcccctcgatttgcaggattggatctttggtttttcttttctgctccggttactggtttattgatctttgtttgttggtgcttgaaagatccgattttttttgtggttcttggtggtgtttatgtgatttgtttctgctggggaggaattgtttggtgttgacggggtggtggtggtttggtttggttggtgggacaaaagaagagcagtcggtgccaagcctaaggaatgtttgtgtggaatttgatcatgtgatgaatttccttccccccggtttcttgcccttttcttcttgatgatttggttggattgcttggttcgtggttcgtacgatctcgtttcttcctggtgttcttcttccgtaacatcgctgttcgcgatttcctcgaggagcttatggaattttgactctgggctattcttctgttttggaatcctgcccggttttaccggtcatcgttgagagaattctgtgtttgtttgcatcggaggatgggaattctgtgttattagaggataaggtggctactctggtggtgtgtttgcttttttgtgcatgcaacaattattttttcttatttttcctcatcttattgttgcttgatacatttttatgattcagtttcagggagttgcgacctgccagtgtatcttcctgccctttcaattaattggagaattagaacctgtaagtactactctagactactgttgctcatagctgtgtatacaacttgtttagttgatattatctgtaccatttctgtttctgatattgtaggtacaatcattgccaaattgcagtggctgttctctgtgcctttcattctcttaatttcggtttcgctcctgttctgaagagtgggggaaaaaaattaaggcagttcttagctttgggagctgcagaatattgcattgttgcataattcaagtgctgaggaagtgaggtcttaattattgtttggagttttgcttttgtggcaccaatggcggccttggtcggtcatgacgcgaggcagtattcatggtggtgggttagtcatatcagccccaagaactccaaatggctccaagaaaatctcaatggtgggtcttcttctgtgtttagctcatttagtcatgtttatgcatttctttgatccatatcatgaaattgtaattagcactgcactttatatttgctcaccaaaccgtcagtagtatgctattctttaattgtttctatttagcaatacatttccaaggcacatggtgtgcatgcaaaacactttttcttttttttatccccgtcctgattagccttgatgccaggttcaacacagtctgtatctaatttagcatttgagtatgcatatgattttttaaataggattaggtaaataa

SEQ ID NO: 79552 - DNA, 1206 bp, Oryza sativa
caacagaaatatcaatatatcaaatggagcatcaaacatgcaatctgacagaaacattcgacaagctgcatgcctgcaggtcgactctatctgtgccccctcggcataccgcttcttggcgaacctcttacccttagcaccaagcaactgccacagaacaaacgcgcgcgcatcagcaacagaaacgcaccaaaaaaaattgaacagaagaggggggggggggaatataaacagtctctcacctgccgggcatccctggatcgcttgtgcacctcgcgcgccgcccgcttgcgcttgcgctcctcgtagtccaggcgccggccatggcgcttctggtgaagctctatgtgatctccctgcggctgcagccaactcgtccaggagaaaactcaaaaaaaataaaaaaaaaaaaagcgagaacgacgaggaaacggaaagactcgcgggtgctgagatgatcagcggtgaatcccgggaggaactgggcacgcagtgaggtcaggttggaggcggcggcggggagaaagcgagggggacttaccatggcggcggcgaaaccctagcgggagctcgagctttgggtgggggaggaggaaaggaggaaaaaagaggcctcgcttcgggatttataagctctcttgggcctcctgagtgttagcccatgagagctatatgggcctcaccaatgatgtcttgggctttgcaggtagtaccgctatgtgaggtgggctaagttcacattgtctcccttagctagtgtgcgaatttgattcataatttcatctccttcaaccacaatacctgatatgtttaactccccaagtattaaaaccggtgcaatttaactccctcgatggttttggaaagctatttgctgacgtggcggtgttaacctggtctttgttccacgtgatgtcgacgtggcgcttacgtggtattagaattaaaaaaaatatgtggaacccattttcacgcaaaaaatattgtggggttcatgggttaaaccttttacacaaaacgatgataaaagtgtaaaaagtgtaaatggagtgatgcatgttagtgagtccgcccgtcgaatggattggttgcacggttccagaggggggctgttacagacctgtttgggagagcttctaactgcagcagcttctctcggaatcagaatctcctcaaacattctagcctttggtccagtttctaaga

SEQ ID NO: 79553 - DNA, 1908 bp, Oryza sativa
gaaactcgcacgtcgacgacggccggcgcctccgctgaaacagaatgctgctgcacgcccgcgtcaccgtgaaccacgcccctcctgctcatgcaccggcggcagcgtctcgttgcctctcgccgctgctccatttgtacccttcccacttgccgaatgcaagcttctgcatgcaatcacaatgttaacgacacacatgcccgatcaagaaaacacgagaaatagttgtggatagagtgcagatttgtatccgtttgttagggttgggttttgggtgatcctaactattgtccctttgttggtctagcggcggtcggtccagtgcgctttctcctagtaggattgtgtgttggagttgtcaatgcttgggtggggttatttttttcttcgttttcctggttacgaccttccaaggttgtaatcttgtattttttttctactctatcaatataaacttcgcactgtctcgtgtgaatcattaaaaaaaagactcggaagaccatatggttaaacacctatcagatcgcagtagggccgatcagacatgtactgtggtctgaccggcctttgttaaaaggctctgaatttgataattttgagctaaatcaaaactaatgtcaaatttgatcgtcaaatgtccaagtacttttttgtttttgataaagcggcatagatatgataagaatttcgagatcttaaggtttgataatatttaaacaaattagatacatggaaatcatatgcatatgtagattgtaagatcgaagaaaaaaaaacatatcaaaaactgtgtgctagccgtgatgatcatgtgcatataaataccttcttgagtatgttcaggacgatcttgccgcggaggtccatgaggtagacattgtcgctgcagctggagccgtagttgtcgacgcggtagacgatgccgccggtggagtcgtagacggtgcagccgcggccgttgagcaccagcgacttcatccacagcgtgaacaccttcctctgctcgctcgtcgtcgacggcggcggcggcgacggcggtggcggaggaaaagaggagtagacccttgccatgaatttaattacctctgccgaattgtatgtttggaagatgatgatttgaggaggaagacgatggttagtttggtgatatagcatctagggcttggtttgtggctagtaatatacagggggaaaagtgaagaaagtgcaagcgtgaggtatattgatgctgacatactgttttatttgaacctttttggaggagggcaagtcatgatgatgttcttttatatggatacaaacaatcagctgttttaacatatttatgaattatgacaaacagctggagaaggcttttttttttttgaacaactcaccggagggaagagattcctcaactgaatttcattcaaaagtgcaatagtagaaagtacatatgagagattacaattttacataggcaaagtcgtttcaatttcaggttaatttgtatgctctaggcaaagtcacgttcgttcacaggacgtaatgtaatcttaacaaccatgtttgttgaaaatattttaccttctcttaatcctaataaaattggtcagggcacttcttcgccaccgagccggcaaagaagagatgagatcaataaagataatgcaaaacccactagcttacattctttgttcttgaaagccctaacgtggcactatacattcatttggtgcatacaagattaatttgagtgagtaagaaaatgtaagaactcataacttaattccttcttgcatgtaaccgtctgaaattctgaatctatctttcgccactaggttctgcaacatttcaatgattcagttgcagagttggtcaaggaagagaattattaataaattccacactgaacggggatccaaaatg

SEQ ID NO: 79554 - DNA, 619 bp, Oryza sativa
caaaattatgtgaaacttacatataagttacactgtaattacatgtaagttacagtgtaattacatataagttacagtgtaattacactacgattgtactataattacatctgtcaaatttttggagaaaaacttgtcaacaaatgtataggtagtcccacggttttgtaagttgagggatgtcacatatttggttttgtggttgggggacgattttgtatctcgatgacaagttgagggaccttcggtgtactttttccaatatctcttcaagctgtcagaggcaaactggtaaccaacccagtttagcccaattcaacatgggcctaaactacagcccactaacaaaagcccattaagagaaagcccattattttctctttctctctccaaggtggcggcggggttggtccactcgaagagctcggcggtggaacagctcgctcgatcatggccgccgccgccgccgcctcaagggcgctctgggcttgccgcaccgcctcctaccttcggatctcctccttccccagggctttctccaccggtatggcatctgccccctctcctgctttccattttgtcctccctcctgcttagtattttgcctgtattatatggg

SEQ ID NO: 79555 - DNA, 15114 bp, Oryza sativa
gagggctctttttagaccaaggagaatttaacaaaaattctccgggccatatttgaatttttcttgtacgtattttagtgtttgccaatttcttttcgaattttaattaattctattattcctgttagaagatgatttttatttcgggatgaatttatcaggacgtgacattccgccctctcccgtgcccggctccctcccccatcctataaaatgcaacccccgcactccgttctatcgctttagccccctcccgcggtctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccacgccggcctgccctccgtttcgcgaggtgacccccggagctgcgtttccgccgtcgcccatccatttcctccgcgccggccgcctccagtcgcctccatctccctgcctgcacgccggtcgacgtcgccaccacctccctcggctccacgacgccgctctcatccccggcatcacctcctcctcgcccgaacatcgccggaacaccgtcgcccgcgccggcctcaccttcctcctcgtcgacatctcctccggctgcccctttcgccatgcccgtgcatcagccgacgctgccgtcccctccctcggcatggtgacgtagccctccacctcgtccactcctcggtttcgccggaacgccatcgccgcgagcccctccatccgcctcgccggagttgttcggccgcccgtccctccacgccgtgcaccggtcggccacacccccatcatcttcggcatcgcagctgcgacgtcgtcctcggcctcgcctcccctccgaccgaacaccgccggtgcccgtcgtcgccttcaccgttccctctcgcccggctcgtcgtcttgcggcgccgcctccgtcatcgtcatcgctgcggcgtgttccacgccgtcctcgcctccatgcagccgttgccggctgccctcgtcgtctcctcgccggctgccctcgtcgccttctcgccggccccggtcgtcgtcgtcctcgtcctctcgtcgttcccggtcgtcgtggcgtttgtccctccgtcaagccgttctcgttcgtcgtcctcgcttcgtcaagatcgctgcagccccgtcctcgtgttcgtcctcggctccgcgtcgtcaagcctcgtgccggccgcgtctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggtttcctcctctcgcttccccgccctcgtcctttcggtgtcgccccgtacccgttgtgcggtcgtcgaccccggtacccgtgtaccggtgtcggtagtcgttcacgcgtgcgggtggtgaccgtgtagtgtccgcgttagtgtgcccgctcggtagccgcgtggtttccacgtgtgcaacccgggtggtgtctagtggagtccgtttatcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttttagctttgcttgtgtgcttcgcgtagcttctgtcgttccggaggttcccgaagcgtggttcgtggtcgtcgccgaaggttcggaaggccgttatctctgagcaaggcaagtcacatcatccttgaacatattgaatcccagtttgtaaaattatgttgatttaaattattgcattatcgctttatttaaattcccgcgttatcactgttttatttagccatgcctattcacctttgttatgacattattattgctattgttattattaccttgttcaccctagaataaacaaaaccccaactagtgggtactctattcctggttccactagtatgaatttaggtagatgcttcgctgattaataggacaacattaggtggtttttataactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactactgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtctttcgcctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatatggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatagctttgggcaactaagtgacttataaatgctgcttttctgcaaaacttaacccctatattattactccttgtacccccttgcattaaccatgcatctgccggtgtgacttgctgagtactgtggttgtactcattcttgctcaatctttccccccttcagtaagagaagctttggagaagatgtcttaggcggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccagtcgcgacagtgtccccgacaacaaagatctaaaggatgcaattctgaaagaagctcatgatactttatactccattcaccctggtagtaccaagatgtaccaggatctcaaggaaaggttttggagggcaagtatgaagcgtgaaatcgcagaatacgtagcagtatgtgatgtttgtcagagagtcaaggcagaacatcagaaacccgccggtttgttgcaacctttgaagattcctgaatggaaatgggaagaaataggtatggattttatcactggtttacccagaacgtcatcaggccatgactctatttgggtgatagtcgacagacttaccaaagtggctcatttcattccggtaaagacaacctattctggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacgggcaaaccgaaagggtgaatcaaattttggaagacatgttgagagcttgtgctctagatttcggtggaagttgggataagaatctaccctatgcagaattttcgtacaacaacagttatcaagctagtctacagatggctccttacgaagcattgtatggtcggaagtgccgcactccgcttttgtgggatcaaacgggagaacgtcaggttttcgggacggatatcctaagggaagcagaagaaaaggtaaagatcattcaagaaagattgcgagtggctcaatctcgttataagagttatgccgacaatcgccgcagagatttgagttttgaagaaggagattatgtgtatcttcgtgtcacgcctcttcgaggagttcatcgttttcagaccaaaggaaaattggcaccgcgttttgtgggaccttataagattgtcagcagaagaggagaggttgcttatcagttggagttacctcaatccttggcaggagtccataatgtgttccatgtgtcgcaattgaaaaagtgtttaagggtacctaccgaagaagctaatattgaccagatagaagtccaagaggatttgacttatggtgagaaaccaatccgtatactggaaacaaatgagagaagaaccaggaatcgagttatccgtttctgcaaagttcaatggagtaatcactcggaagaagaatcaacgtgggaacgagaagatgaattaaagtcagctcatccgcttctgttcgccagttcttccgaatctcgaggacgagattctgtttaaggggggtaggtttgtcacaccctgaaaattcaaaatatataaattgttgtttaaatggaatttctagaatttattttaaaagtcttgaaaagaaaatctaattctaattaataaattccaatataaaattgggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagccggcccagtccgcagccgcccgcgcgcgcgcgcgccctcgcagccgctgacaggtgggtcccacctgtcaggcccgtcgtcttcctcgggccgaaaccctagcgcgccgccgccgagccgccgccgctgtttccttccaaatccggccgcctctttccttctccggccgaatcaatagaggggaaatgatctccgggatctcctctaccttttctcctttggaatcttcggctaaatcgctttggaaagcgttggaatcgagttcgattcggatcggttttccctctttccaagccgcgagtttccttcgccgttgccgtcgccgtgggccttcgccgtcgcctccgagcccctttaaaaggatccccatgcccttctctttccgccgccaccctcgccttcgcctctcgtcgtcggaagagctctagcgccgtgtgccctagcttcgccgtcgccgccgccgcttcagccgtgctccgccgtcgctccagctgtcgccgccgctcgggaagaccgtcgtcgtgctcgccaagtcgccgccgtcctcgtccgccccttcgcagccgtcggaacccgccggagcatcgtcgccgtcgtcaacccgaaggtagccgccgcttccttctcgtcgccgtcgccgtccgttccttttccgccgccgttttggtcaccggtgtgttcgccgcgttgtcctctacgtgctggtgccctccgttggtgccgtggtgccgccgttcgccggcgagtgtccgccgcccgagccgtcttcttcgccgagtcgccgccgtcgtcggtgacgtcatcgctgacgtcatcgggatcctatcccgtgagccggtcgtagaccgatcgatcttggccgtccgatttggatcggatcaatctcggccgtccgttcgtgtgaaccgccgcccgtgcgccggtccacccaaaccctagttgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccatgcccgcggttatgggcgggtctaacaatgtctttcgtgattagtctcacacctctcatcatagtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattattacttaactgttttgttaaattctcaaatgtttactaaatgctgcttttgcaaatgaaaccctattatgccatcctttgttatcctgtgcacttgcatatttgctgcgtggcttgctgagtatgtcatatactcaccttgcaatcattcatcataggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaatgttgctgttggagctgactagctgatgagacacatgctagcaacatgtccaatttttccacaacgggtgcatgcctttgatccgaagaagacacatcggaaactcttagtccaaacaaatgtctctttggttgatcacttgattttcttcgccatcaatcgctaggttatttgattcataatagattatgagcttacggaaatgagaccctaggtctccttaatcatcaaccaaatgtacccatcacacaacacttgcaatcttaatatggaccctacataaacttgccaatctcattcattatctcatgtttctctgttattacatgattgacggggaacagctataaaacaaaagtacttgaacaccgatacaagagtattatggttgcttctgactagcactaggcttaacaggtactgcatttgctccactgactacttggtgattggcatggttgcttcctgtaaattggcgaaaatgtggaggccgattttgccttggttggggacagtttttggagtaatgcccttcttcactgcagttgtaacaaacaataactttcttacactcgggttcttcatcttgtacttgatttctcagctgctgtattggaacttccaaaggtacaacgcagatactgacctctgtcttgtcagctggtggctggggctgaaattgagcattgacaccttgtggtagtgcactcattggagttggagctgttgcaacgcgggctataggactgcttcgggatgcatggatgacaattcgttgaggagcaagcttctgattgcggggggttgcgtggactgacgtgctggcagctacgtttctcggttttgggcacttgtcggcgaaatgacccattccttgacatttgaagcaacagatatcttcccggactcggcattttcttttctcattttgattcctctgtcctggcactggagttaggctgaaactgtaatcttggcgaggatttgtgcttccttgatgcttctctccgttggaactggcgggttggttggccatcttcttcgtcagcagaaaactgaattgacaatcttttggtacgtgatcagttccttcacaaaagaaacaagtgatcctgctcgttggacacctgtcgggtggatggtcttcctcaccatgaacgcatgcagaggcacacgagctggcaacatgaccgatttctccacaacgagagcatgccttaagttctattttattctggttaaaaccttggggagacttctcatcttcatcatctgaggagacttgatctgaatcttcactaccagacactctacctccattagctaaaagatgctctgtcaactgttgtgcacctcggaaggaacttcttctctgacattttgtcattcctggtggaggccattctgtgctggtaatgatcatcttacggacttcatcttcggttcgcattggtgcttttcttttctgctgaggacagttccttgcatagtgcccttgctcatcacacataaaacagatgatacttgcttcttttgagtcaacatgtggcatggcatgaggggccttctgggatgttggcggtgcgctgacttgtggtgtgagtgcttggactgcctccaactgcacttgaggttgtatttgactcaagttcagaattggcgtctggtgctgctgtagtatctctataagcaatcggttctggttaatcaggtgttggactagtgtcacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttctgcgacgggttctccgagatcttcactcctgcttcacatctggcttcactgcttccttcgcttcgctaacgaatccaacagccttctgcagcttcggcagacaactgacgatgtcttcttctttgccgacctgaccatctagtactagttgaaatccgaagaatgaagaagggaataaaccttttccaaatagcattgggggaaggaggaaaaaggaactttcgcaaatagtttcatttataaaatatgtccttaggttttatccacttggcttaacctacagtcgagatggctctgataccagcttgtcgcgaccgagaaaattgccttttcccgaacgctagtgcattaatccccgtcccaggaaaagccggggtgcaccaaacaaacatgatacaaaaggcacatctttattatatcgataatatttacattattacaaaggcgcttcaggcctgacaatcaaaaataaacagcagcggactagcgggcctacagctccatctccacaggcgctcaactggggtataagccaggactccacctaagacatcttctccaaagcttctcttactgaagggggaaaagattgagcaagaatgagtacaaccacagtactcagcaagccacaccggcagatgcatgattaatgcaaggggggtacaaggggataataataggggttaggttttgcagtaaacagcatttaaaagtcacttagttgcccaaagctattttataaagacgatcttagagctacacaatattattaatcaaggccgtggacccacacgaacctgccttaacccaaggcctacgatgattcggaccgaactggcaacccgacctgggtcccagctcgtcccaagccaacccaggccaacctttccacattttagttgttaagcaaattttaagaattaaaccactaacttgggtacattgctaggcttgcccatatccgagggctcggctattcgaatagatttactctgatcagaggtgtacatctttacccacaagacacatctttactccgcattccatggccttggaacccgtcgtaaacatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagcctgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatatccaattccaccataatccaacaattccatagtgtccaaatgatatgagaattcccaaagtctaaagttataaaaccacctaatgttgcctaattaatcagcgaagcatctacctaaatttatactagtggaaccacgaatagagtacccactagttggggttttgtttattctagggtgaacaaggtaataataacaatggcaataataatgtcttaacaaaggtaaataagcatggcttaataaaacagtgataacgcgggaatttaaataaagcaataatgcaataatttaaatcaaaataatttgataaactgggattcaatatgttcaaggatgatgtgacttgccttgcttgctttcccaaacgtcggcttctacttccacgaagagcgaatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggccaagatatggccatttgaaatttatatgctctttaaatggatatttgcgaatttcttcatttaaattttaattaaaaatcgggtttattgcgtcagccgagagagagggcgcgcggaccgggtccacgggagtggggcccacgcgtcagcccctcggtccacggtggaccgggtgcacgcggctgacgccgaccggcgccgtgggtcccacgcgtcagccgcacccgcgggcgcgggcggctgacggccgggcccacctggcagccgcggggcgcgcccgaaggcggcctcgccggcacggccgacggaaggcggcgcacccgcgccccgatggtcgccgccggcgaccaacggcgcggcggagcggcacccgagagagaggagggaagggggaagcgaacggagcggtccacggctcaccccgggacgacgagggcggcggaaacgacaaccggagcggaggaaggcggcggcgcggttcggatcgacgaggacggcggcgctccgacggtcggcgggcgaaacgaaggggtggacgaggttggcgaggacgcggcgaagccgaaggaggtgacgccgagtcgggaggaagtccggagcgacaacggcgatgaaccggagctcggcggcgacggcggagagagaggaagacggtgcgggcacgattccgacggggagagtgagcggcgagtggcggaaacggaggagagaggcacggggaacaattatatagcgccgggagggggagaaagcggccggaggggaaggaaaccggcgcggaggatccggccgccattgatggcgccggcgaggtttgcggaagcgattccaaacggatccgagggagagagagagggaaaagcgggggaaaacggagagggaatcgcggggagtgatttccccctctttatggcgcgcggggatggcgggatgcggcggattcggcggcggcggcggcgctagggcacgggcgggcggcgggagcggcgggaggtaggggatgacgggtgggccccacccgtcagcgagggtggcgggcgggcccgcccgtcagcggcgcgcgcgcggggaggaggccgaatgggccgcgggggagaggagagagagggagagagatgggccgagccggcccaagagggggggaaagaactttttagagcttttctttttataaaaccattttaactttgtttatgtcttaataattattatttgtgctctgaaaattccactaaaatttatttacgcattttaggcttttaggaaatatacaaaaatcctccaagccttatttgacttttaactttgcatattttaattgttggaggcttgcacccagattttaattattctatgcataatttaaaggatatattttagggtcgttttgggacgcgacaataaagggcagatttaacgtgtcaatcaagcatatagaataaaagtagttaaattagataagatcaactgaaactccgatactaccctaatcggcaaccagaaagcaggctagagattgcaatttgaagcacgacttaatagatcaaactcaactgatgcagcattaagtatgaaaagaagaacaatatctagaaaatcaagccgctggaagtttcatagagtggtagatatatcacataatctaagttaacgtcattatctaacctaatcggctgccttccattagcagatgttagccgattataggttagataaagatattatcgaagactatgtgagatatatgataactcgacgaattatatagacaagattagagtgtcataaagatggaagcactaatcctgagaacataagtcgtcatgacaagttttacctcttgttgaagatcgaaaccgatgcagctcaacccgagagcacgaactcgtcgaaataaaagtaaagcaaaagggtggcgatgcgccgagattgtattggatgtgttttcttgtttttacatagggctcgggtctatttatacccgaggattacaagatacgtccataacggacacgactattatctctaacaaactctaagataccataagtctttacggcagacttttgcccaaacatatctctaaggaaattacatagaatatcctaattaatagatacaatcgccttcccaggactctatccaagcatggcaatcaccttgaagcagatcaacttgaacccaatgactttcaccgggtcatattatcggaatcggctgtatcggctagccccgtccaattcggactctgccgatcctgaccttagccgatttagactgcagccgatttttactctatctccgcaaagatcttcatcttggatttcacttcgatctgatcttcatctccgatgccaatagtgatagaatttaccaaatttggtcgttaacaagttaccaaaatttgtcagcaaactaaatgtaaccacttttttgacaactttaccaaaatttggtaagattgaaaatggcatcaaagtgaacaggcccccaataaaaaaaccaacctagctcttacataagtattgtcattcattatactccctccatctacttttgatagtcatatttcatcttatcacacagaccaagggtaagtaactctacttatcattcatttaaacatgctactagtcattcctcgtaaacaaacaattcattaatatttacatttctcgatgcccatgtagccaatgttgtgtggaagaatgaagagtcatgcattaaatccgagaaagtcattaagatggttgttgaattgaaatattactatcaaaaataaatttttcagatttgaaaatatgactatcaaaaatagatgtagagagtcctatataatattataattattttttatggaacggaaagagtaaatgacgtaagaagatataatgtaatacagtttttgtgtcactgcatcacgactcaagccgcattcgagataagagcatatgaaaacgaagtacatgcgcttaaaacgattatttattag

SEQ ID NO: 79556 - DNA, 2712 bp, Oryza sativa
tgcagctactggagctagaaatcacacagaagagtgaaagtatggacagcctgacgttgagcctgaaagacgaaactgagaaagggttcaagctgaaacatcactcatgtcaatggagagtatgtatcctcagtctcaagaggaagtgaatagattgcatctagagattgatattcttaatttcaaattgaatgaattggaaaacttgccatctgaacttaatagcaccatcttacttctaaatgccgagcaaagatgctaccgatcttaagaaccagcagtccctggtgagaatatctgatctggagtctgaactctcaaagttgcaggctcaactggagaaaattgaagggaaagtacagatgctggagcaggaactcaaacataagaaagaagaagtggatagtctccaaatcagcatacaagatgaagcccataagcgcagtgaaggtgaagcagctctccttgcaatgacgaatcttaactctgagtctcaggaggaagtgaataggttgaccctggaaactaagaagctgaaagtgaagttaagtgaggtggagaacagtaatacagatcttgagaatatcgtagccaagcacacacaggatatccatgtccttcgtgaaaagaatgtttccactgaacttatgataaaagaacttcatcatgagttggatgccctgaaggaattgaatgtgaaacttgagagtgaaatggggttacatataggcgaaaaggaagcacttcagagagactttgcttgtcaaaaagaagagaagcaaaatctagaggggatacaccattctctcgctgaggaaatgagtactttaaaaagcagatcagcagcaaaccagaagttgattgaggacttgcagatcatgaacttaaaactgaaggaagtgtgtgcgaagaatgaggtagaaaaggcacttctctcagaaaaggttcaagaggtggagaagctttctgaagaattttcactcatggagaactcactttcagatgcaaatgctgaaatggattcactgagggagaagattaaagtgttagaaacttcagaaggctctctgaaggatgtaatttcctctcacgtttctgaaaaggctatccttacatcagatctagaaactcttggtaaaagttatgctgatatttcagagaaaaattctaacttggatatcttaatatctgatatgaaagctgagattgaaaatttgagaacaaagctgacagattctgaagaaacctgccaggctcaccttgcaaataactcagctctttctgatgaaaagaacaatgtgttctctcaggtaactactgaagttccttctgtaatagagataaattcttgctatgtttcttttaaaacttaaatccttgtatgtaattaacattattttgtcacttttgtttttcagctggagagcgttacagtggttatgaaagccctggaaagtaaacatgctgatttggaagacaagagctcctctttatcaagagagatgaatcttgcatatgatcaagtaagagaattgcaggatcagttaagagtaaaggatgaagaatatgaagcatttgttaagtcacatcaaacacaagtcaatgactttgaggagcagatctcttctctgcaaaagaaaagctattacatgaatgagttgcttgaacaggaacaggagaaccacatgagtgcatctattaatgtagtgatcttggagaactgtttggctgatttgaaagacaagaacgttgatcttttcaatgaatgccaaaagtttgcagaggcaaatcatgccgcagagatgttaatttcacagatgaaggatgaagccagatatcatcaagatgagaggaaatttttgctaattcatactgagaaactaagagaagggatttcacagcacatgaagatcctaaatatatgcaaggatctaggtcctgctaatatagcggaggacaaaattattttgcagactgtctcagatgaagcctccaacatcatgaaacttaaagagcaaagtgaagatgcaaacaggctcatgtacactgagctgacagttctcgcaacagttatgttgcaagtaggattggaactcagagatctgaatttgcagaagcgtgcccttgagaaagaattggaaactagggcagcagagttcattacattgcaaaataacaatgtccagatgttggagtggaacgaacagctgaagcaagagttacagcaaggctgtgaaagggaagaggttctgaaagctgaaatacttgttttacaagagaagctatcttgctcaagagagtcctaccagacttcacaaaatgaaattgtgagcttgactgagaaaaatgagaccttgtgtaaagaataccagtctttgattgagaactacaatgctttggaggatgagaatggaacccttctttcagaatgcatgaggctcgagcacttgtctttgttccttaggggccataacaatgaggtagcaactgcattgggatctcttactgatgagatggctttgttgagtgtaggtaaggatgaacttgattgcgaagtccaagagcttagcagaagaggtatgatgcttgaatcggaaaacaataacctaaaggagtattttatctacctgatagagattctcagcgctcagttagccctctcagagtttgatttgaatatcaacaaaagcatttgccaggagttggccagtg

SEQ ID NO: 79557 - DNA, 4506 bp, Oryza sativa
aactagcgttgtctacttctcacctccctatttaacagctatcttctttttttcataggaagatgcagaggtaccttttatgcaagagcgcaaccatgggccagaatctcaccccttgccggaaggaactccagagctacagcggttaattgcaagaatgggagcacttcaagttgctattttaaatgccaaagatcttcatgatcaggagtcaaccaagtctgctgctacgttggcagcagcacacagagatattcaagagcttaaagcaagaggcgggtcgcagatggaggcaagggaaatatactccgacaatgagaagctgaacaacgtcgagggctccaaagggaagcaggtacagatgatgaaggatatcgaacttgatcaaatatccacatgtccaccatatggcactggagctgcgctctacccacttaagaatggcgcgaatgctgggatggatgacgagatgctgcagctgtgggaagctgccgagaggagctgcaaaaaccaaacatccaaatcatcatcagctgagcacgacatagaagcggttgaggaggtgaagagtgagtacccttcctctgagctagcaaggggaagagaccttggaatcaataagcttgaggtgtcgacatcatctgtagagcctcatgagcaatggagcaacaatgtactggagaagctctcttctgatgctcagaggttgcagagcatccaagtgagcatcaaggagctgaagcggaaaatggggagcccatcaaacgggaaatcgcccatgaactccgaatacaacaccgtcagcactcagctactcgataccgagggatgtgtcttggaacagatcaattacaacaacaaattgacaaagcgggttgagaactatcctgcgctatcagatagcatgaacgcggagcaagaagggtaccccagtaggaggaaaatatccggacaggtccagaaaggatcggaaaacgtggggagattggaactggaacttcagaagatacagtatgtcctgctaaagcttgaagaggagcatgagtacaggaggctcaaggtctccgataagcgcactcgggttcttctgagggattatctgtatggaaggaaggagaagcgcggcggtgcgcagaagaaaaagaagagggcacctttctgtggctgtgtgcaatcaagaactgagacttgaaccattttgttctggcgggaaactagctataaaatgaaaagggaagatgagagatgtcagctccaagaggctgtagcactgctttgagcaggccatgttcttgggttcatccccattgtaattgagttagtattttagtgctcaaaacaaagcatatgtatctaaaattttggctttcctgtctaaatgaggccatctaagcttagttcaatatgttatagttttctttccatagcaaatatgatataggtataatatagcaaggcattttatttcaaactatgctgcatttgggtggcttctgcaattcatttttttccatcaaggtctcaggctacaaaaacaggtagttcgtctgagaattgctactctcattggattttgattctctttctgatagagtttcacatttcctgtggctcgctactgtcatgctctgaatgccaatgattctgctgcgtcttctgtgctttcaacgactgaacataacaatgtctatcttgtttgctggggtatcagatgacggcaggacatcaggctgtaaaaaaacatttaatttaaatttaaggacttaacgtttcctgtcaggcagtatgtgttcatgtcaataatcacaggaaagacatcgatagaccaatcttcatgtagaagttatgcaaatggattataattctttcaggttgaacgtttcagacgaatggtcacattcaaattacagtattcatgaattatttcagatgcaactaagcaatttaaacacaaatccactatgaatttagagtcgatgaatttactcacgaatgcagttctccatgaagagtgctccagggggagaaaagaaacacccaaaccttatcatttcatcaacttcgttacttgcaaactcatatcgcctaagcttcatgtcagtatctcctgtaagcaacatcttccggcttcaagattcagaaaggttatctctgtattcctttaggttaaagaattcagaaatgtagtaggtcgcccacgcgtgggcgactcggggggaaacctagcaccgccgctgccactctctcctcctctccctcccctcgcagctaccggagaaccgagcggccagctgggacggcggcggcaaggccaaacgtcgacggcgctatgtgcatggaaggcgggccggcgcgcggagcagaggttgaagacacggcgtggaggcggcagattcagcgccgccgcggctggatccggcctccccatgggtggatctggatctggccggagcaagccgctctcgggcagcgacgacgggaggcgaaggcggcggcgtctggtggctggcggcagctggtgaaggaggctagcgcgtgcgaagctgcgaccggcggcggtggagactggcacgcgcggaggacgcaatggccgccggcggcggaggcagtagaggcgtggctggcgacggcaaaaaccggcgtgtgcaaaggcgcggccggtggcagcggaggccggcgctcgtggaggccacggtggcagccgcagctgaagctggcgcgcgtggccggcaacaggagatgactaaacggcgcgatggagcggctgagggcggtgtaaagcctgtcggcggtggcgacgctcccggtggttggcagtggacggtgaggaggacggaggctgccgcagtgagagaatggaggcgacgacgatgcgaccaggcacccgttggaacacgagcgccctggtcgaggcggcgacgacggtcatgttgtgaggggggtgttgaagcctacggccttttgcggggaagaggggatccattcttttctcaccctctccctctccaacccaatcacgtgggtagcggaagctggtgcgcgtggccggcgacaggagacgactgaacggcgcgatggagcggctgagggcggtgtaaagcccgtcggcggtggcgacgctcccggtggtcggcagtggacggtgaggaggacggaggctgtcgcagtgagagaacggaggcgacgacgatgcgactaggcacccgttggaacacgcgcgccccggtcgaggcggcgacgacggtcatgttgtgaggggggtgttgaagcctacggccttttgtgggggaagaggggatccattcttctctcaccctctccctctccaacccaatcacgtgggtggacttgaagcacgacaagggttgagactcttctttgatggccggccggcggcgaggcgtcgacgtggtggttgcgcatcgaaggggattagatggtggttttgctgaactggcatgcactctttagcgcgggagagtagaacaatgggtgagccggcaatggcaacgcctgcgggcgtcgttttccccttggggcattgttgtgttttctatcgtttcccaatgggttcttcaggtgaaaacaacgtcctggttctcaaggacaggcggcggtggcgcttttggcgtcgttttcctccttggggcattgctgtgttttctatcgtttcccaatgggttcttcaggtgaaaacaacgtcctggttctctaggacaggcggcggtggcgcttttggcgtcgttttcctccttggggcattgctgtgttttctatcgtttcccaatgggtccttcaggtgaaaaccacgtcctggttctctaggacaggcggcagtggcgcttttggcatcgttttcctccttggaagcgtcgtttagaagacatattccttgggggtgttgtgtgcatattttgttttgttttagcagtatgatcaaacgtagacgcgtggtgtggtgaacgcacgaactttattagcttcaaaatgtttttatttcctgatacaatgcacaggctattctattcatcaattttcgttgtttgtattactatcatacgaaatctataaacaacatgtgatgtaattattattagtgccatattaaagttttcatcataaaagaattacacttaataattatttattaccttactgtgtggttttaaatcggtgtataacttttacctggtactcgtgacacatcctaaaactgtgaatttggaagagagcatgtccaaatttctacaactcccaactacctaatcacccataagcaaatatcatttaataggatattctagtattttaatcttacccagtagagaataatcccttatattatagaatgaagggaatatccgggaagttgggaagtatccagtgcaatagtacttctcggtgggagaatgcgatatcctattgctagcctttagatttgaaatggacgcggtagattggagcacttcctattctcttagttgacaaatgcaaaaaaaaggaccc

SEQ ID NO: 79558 - DNA, 5063 bp, Oryza sativa
  unsure (1)..(5063): unsure at all n locations
gctttgatagaatatgatttggcttatgaaccattaaaatctatgaaaggccaaattgtatgtgattttatagtagaccatcatatagatattgcttatgagggagaggtttgcttagttgaagttataccttggaagatttattttgatggttctttttgcaaagaaggtcaaggcataggagtagttttgttttcacctaatggcatgtgttatgaagcatcggttcgcttggaatattattgtacaaataatcaagctgaatacaatgctctattgttcggcttatgtcacgcccagaaatttaacccaaatttccagactattttgcgtattaaatacctgtccaggaccagccagggtacacaaaacgacaagtaatatacagttctaaacgtaaataaagcgtaaaatacttacagaagaggcacttagtcctcagaccaaaacagaacgacagcagcggaaaaaggcgatccttgcggggcttcagctccactccacaggcaaaactcaactggggtctgagccttggtcctctaactccatcttcagctcagaagcactacacttctggaaaaagggggaataatagcaagactgagtacaaccaccgtactcagcaagccacaccaacgatgcagacgtgcaaggggatacaaggatggcttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacagtgtattgggtcgatttattaacatgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgctcacgtcaccatgtcgagtgattgtgacgagacccttcgcataaccctcccctaaccatccacaccacgctaaggtttcacccccactcctcaaaaggcagtgggcggtcccctcttgcgccgcggtgaatccggcagctagacaaccggacaccccggccgacccaactccatcacgcccaccctcgccaccggtgcctaggaaagggtcgagctatacttcagatcaagcggttacccactcccgcttgtggcaagcgctgtaagacttccagggtttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccacggttgacaaaggacagatatcaagtaaacatggcacaagcgagcagataggtaaaaccctaaccccatgtaattagcaaaacatgcatgtttatttgcaaacagtaaaacatttataaattaggatcaacatgctcaaggggaatgtgtgacttgccttgcttcttcacttggatcttctgaactcttatcctcgcgaccgcgaacttccgaaacgacagattctacacgctggcacgcaaaacgaggaaaaactctaataaaaaccaaggaaacagtacataaaaactaaacaaacatgtagagctcaattttagatgaattttgcaagttgaatggctcaattcagagttcgaatgaattagatatgaattttagaagttttgagccatttaaatgagtttctagaattattaacgaattatgacgcaattattatttatttttccaaaggaaaagagggttgctgacgtcatcaaaggggaggggccgcgccggcaagcgggccccaccggtcagcgtcacaagggcgccggtccaccgtggccgggaccaccgaggcggtccaccgccggtccacgggaaccgacggcccggattggcccaagccgatcggacggccacggggcgcgcggctggggcacggtcacggctcaaagccggccagccgagtgatggcgcacggcagcgcggccaccggcgacgacggccgacgacggcgcggggagcgncagcgcatgcggcaggtggcggcgcacgctaggaaacggcggcgcggcgcggtaaggtaaggcggcagccggctgcccggcacagccgncaacggcgcggagcgcggcgncggcgacccggtcgaatggccaccggcgacggcggcgcgtcgcgagcaggcacaggaggtgcccgacgaaggggaggaagggaagagggaggggagtgctcaccgagcggcacgacggcaaacggccggccgacggcaaggaacggcgccggcggggctcctcgggaagacggcgcgacggagctccggcgacgggcgtcgctcaggaaggggcggacgggctcggcctcggtctgaggaaaatcaaggaggggctagggaggtgagacctggtgcgaggtaaatgaaaacgactgccgaccccgacaatacgaggaggagctctccggcgacgagggaggtggagctcgggcgtatttccggcaaagagggccagtggccgaggatctccccgtccctgcggagctgagggaggcgccgacgcgggtcggcgaggaccgaagcggtgttgcgacgcggctggaggtggccatggtgaggaaaacaggtggtgcgcgtggcggcggcgttccgcaggcaaaatgggaaaatggagtagggaccggggtggagctcggcgggacgatcccgacggtggcggcggcacggcgcggtggtggctggagcggcgaggagcggcggctggagctcgtcggtgagtggtggagagagggagcgcggtggggagggggttccgacgatggaatggggaaaacggagcggagccgaggtgcggcaaggcacggcgaagccgcaggtggcggcggaacagcacggcgacggctgtagcggtggtggcgagcggatggagagtcgccggtgagcggcggcgatgggagcaccgaggggagagcagtacagggcgcgagaagctcgggaaaattgggggaaatggaaaggggaggccggggatgctttttatgggcttggagtgacgggatcatgctcgagagaggtggcaaccggccggcgagatgggcggggcatcgtggggtggtggagaggttaaccggcggcgattttcatggggagagtggggaaaagggtggaggacgtggggcgacggggtcccacgaccggcgggcttgcgcgcggggtggatgaggtcggaaacggcggcgtcgtggggtggctcgggcggccctggcggttgcagccggccaaccagaggtaggaggaggagctgacaggtggggcctcgggtcccacctgtcggggagagagagaggggaaaacgggcgagggaggtaaagcagacttgagggagagagagagccgagcgggccgagggagaaggccggcccgagagggagagaaaaagggcgcgtgggccgcgggagggaaggaagacttgggccgaaaatggcccaaagagaggaagggggaattttatttgttttctttttattttaattgatgaaatgaaatttgtgctattaaaactatttctcgagctccgaaaattcacggaaaattccggagagtacattagggcacaaagaatattacaaaatattcccggccaatgatttttaaaggaaatttttaattccctcaataattcacttgattaagttgatttaacttttatttaatttctagaaaatgtattattaattgatttttattcccgaacgaaaatcggggcgttacagcttacaagttatggagatggtcggagctaaacatgtggaggcttttggtgattcggaattggtggtgcaacaagtcgccggagtctacaaatgcttggacggatcactaaataggtaccttgattaatgtttagatattattgccaattttgataattttgctattagacatattgctaggcatgataattctagagcaaatgacttggcacaacaagcatctggttataatatgaaaaagggataatttctggtattagtagagccggtgcttgattttaaatctttgtgcgatattggcaaaactggagaccaggggcggtctgaccggcgttgcacggccggtccgaccagtgaccaggggcggtctgaccggccgcatgtcgccggtctgaccggcgaccccgtgcggtctgaccggccctgtgtgaccggtctgaccggttctggacagagcgctggggggcaagtttcaatcattttggaagccgaattaattgtgaattcgtacatttgtgcctaggaaacagaagaagattggagaattcctttgattcaatatttgaaggatcccacacttaaggttaatcggaaaattcggcggcgagcgttcaaatacacattgcttgatggagacttatatcgccgaagtatagatggtgtcttgttgcagtgtttagatggagatcaatctaaagtggctatggaagaggtacatgaaagaatttgtggaactcatcaatcggcccacaagataaattggttgcttaggagggcaggattctattggccgaagatgattaatgattgcttcaaatattataggggatgtgaggcttgtcaacggttcggcaatgttcaattggtgcctgccaccgtgttgaatcccataatcaaaccatggccgttccgagggtgggctttagatttcgttggtcaaatttatccttcgtcacaagggggcataggttcgtgctagttgctacggattacttcaccaagtgggcccaaaccgtgcctttgaagaatatgactcaaacgaaggtaattgactttattttgaagtat

SEQ ID NO: 79559 - DNA, 4911 bp, Oryza sativa
gagtgaaggggagggccgcctatctccatctggcgagcagagcaagagcaagggaggggatcctggtgtggtgagcatccacatcctcttcatgattcatctctctctctcccaccgggactacttttgcctggaatttgctttgctttcgttaagctcctctcttaatttccgatacttaaccttaatacaagtagtaacagtttgtttgttcgtctcaagttggattctcgctgatgtttcttgaaattctctcagtttcttggtgcttcttgggaatttttcaggtgttgttgttgtcgttgttgctcgccggatgttggaggtctgctgctgctccggcgtcctcggcgggtcgccgccgtcgtcgaggactgcgggggtttcctcacctggactatcgccgtctcggcccagtaagcggcgaatcggccgcgcccgggtgcagccgcgcgcgccgccgccgtgcgacgagcggagggcggcggaggacgtcatccacgcgctcaggtcggcggatggccccgccgaggcgcttgagcggttcaggtcggcggcgcggaagcccagggtggcccacacgaccgcgtcgtgcaactacatgctcgagctcatgcgcggccatggccgggtcggggacatggccgaggtgttcgacgtaatgcagaggcagatcgtcaaggcgaacgtgggcacgttcgcggcgatcttcggagggcttggtgtggaggggggactccggagcgcgccggtggcgctgccggtcatgaaggaggccgggattgtcttgaacgcgtacacgtataatggcctggtttatttcttgtgaagtccgggtttgatagggaggcgttggaggtttatagggtgatgatggtggatggtgttgtgcctagtgtgagaacctactctgtgctgatggtggcgttcgggaagaggagggatgtcgagacggttctttggttgttgcgtgaaatggaggctcatggcgtgaagccgaatgtgtatagctacaccatctgtattcgagttcttggacaagccaaaagattcgatgaagcttatcggatacttgcgaaaatggagaatgaagggtgtaagccggatgtcattacccataccgtgcttatacaggttctttgcgatgctggccgtatcagtgatgccaaggatgttttttggaagatgaagaagagtgatcaaaaacctgatcgagtgacctacattactctgttagataagtttggtgacaatggtgactcgcaatcagtgatggaaatctggaatgcaatgaaagctgatgggtacaatgacaatgttgttgcttatacagcagttattgatgcattgtgccaagttgggagggtctttgaagctttggaaatgtttgatgagatgaaacaaaagggtatagtgcctgagcagtattcatacaactcgctgatatcggggtttcttaaagctgatagatttggtgatgccttagagctgtttaaacatatggatattcatggacctaaaccaaatggttacacacatgttcttttcataaattactatggaaaatctggtgaatctataaaggcaatacagagaaatgaactaatgaagagcaaagggattgtgccagatgttgttgctggtaatgctgttttgtttggtcttgccaaatctggtagacttggtatggtaaaaagggtatttcatgaattaaaagctatggtggtttcttcggatactatcacctacactatgatgatcaagtgttgtagtaaggcattaaaatttgatgaagctgtgaagattttctatgatatgattgaaaataattgtgttcctgatgttcttgccgtgaattctttgattgatacactctacaaggcaggcaggggtgatgaagcctggcggatcttttatcaactaaaagaaatgaatctagagccaacagatgggacttacaatacacttttggcaggattgggaagggaaggtaaagtcaaggaggtaatgcatctgcttgaagaaatgtaccacagtaattatcctcctaatttgataacatacaatacgattcttgactgtctctgcaagaacggggcagttaatgatgcacttgatatgctatacagtatgactacgaaaggatgcatacctgatctttcgtcttacaacactgttatatatggccttgttaaagaagaaagatataatgaggcattcagtattttttgtcagatgaagaaggttcttattccagattatgcaacactgtgtactatcctcccaagttttgtgaaaattggactgatgaaggaagctctgcatattatcaaggactacttcctccaacctggctccaaaacagataggtcttcatgccattcactaatggaagggatactgaagaaggctggcatcgaaaagtcaattgagtttgctgaaatcatagcatcaagtggtattaccttggatgatttctttttgtgcccattaattaagcatctctgtaagcagaagaaagctcttgaagcacatgaacttgtcaaagagttcaagagctttggagtttcactaaagaactggattatataattctttgatttgtgggcttgttgatgaaaacctaatagatattgctgaaggcttgtttgctgaaatgaaggaactcggttgtggtccagatgagtttacttacaacttacttcttgatgccatgggaaagtcaatgcggatagaggaaatgctaaaagttcaagaagagatgcatcgcaagggatatgaatcaacttatgttacttataacacaatcatttcaggtcttgtaaagtcaagaaggttggagcaggctattgatttgtactacaacctgatgagccaaggtttctcacccacaccatgcacatatggccctcttcttgatggtctgttaaaagctggaaggatagaagatgcagaaaatcttttcaatgagatgctggagtatggatgcaaggccaattgcactatctacaatatactactgaatggacatcgaatagctggtaatacagagaaggtctgtcatttgtttcaggatatggttgaccagggaataaacccagatataaaatcctacacgattattattgacacactctgcaaggcaggacagttaaatgatggtctaacatattttaggcaattattagaaatgggtcttgaacctgatctaattacttacaatttgctcattgatggtcttggaaaatcaaaaagattagaggaagcagtgtctctattcaatgagatgcagaagaagggaattgtcccgaacttgtacacttataattcactaattctccacttaggaaaagcagggaaggctgctgaagctgggaaaatgtatgaagagctactgacgaaaggctggaagcctaacgttttcacatataacgctcttattagggggtacagtgtttccggcagtactgatagtgcctatgctgcctatggtcggatgattgttggcgggtgcctacccaattcaagcacgtacatgcagctcccaaatcagctgtgactaactagttagtgactgaatgtacttcttctgtatagttttgtctataaaaggaaaaggatcaactgtagatagtccacttcaatatatctgagggttctgctggttcttgttctacactatatttttgtacttgatggaagaaaattattcaatacacagctgacttgatcacttgaatcatctgttcaatttaactgacattgtgaggttacagttgttaaactcttatcaagtccatccattatatgtggttcaagtacaactgatctgtgtgcacattacccattttctttctactggtatgtctcttcagccaaatgcttgtgacatagttcagttttactgcctgtataggtttactgatgtgtgcgcatctttaggaagttgagctagtggttcagtttcacagtgttacgctgcttagcaacaatcaactttttccctgattcacctttttctcatatgatatagcactgccaatggactgcttgagaaggttctctattgttgcaatacatggaaatgcagttagatgcttcctttccaaaagtttctttgttcacatgatagtgaattggtagcattttgcatactttgggtcaaaagatgtgctcatttcttgtagaccataattacaacactggaatggccaatttccttcatgaaaattttcaatgagcagccaatgcaaattcaaatttactatttcctttagtttggttgtgtctaatctgtaagtttatggtgatttttactagaaaaggtatcgctaagtttctgaaattattttcatttctcttcagtctagaactctagattaatttgttgatcttgcttatatgccaatttgtttgactatattttcctgttgtatctatgatatgctctctctttgttttggggtttatcatggtatatttctatattttatggtgttgagctgttgatcatgagaaagtaaacttgcatgttaaactgaagtaattgacagtttgacattcgtaataccttgatataccctgatcaaatgtatttttgttccaaactcaagctactactagggaacattcatcttgatctatttattcaaagctttcttgtggtgctcagttttgttttctggttttagattgtaattttgtctggtaacaagctcttcttttgatatttttccccttgaaattcaaagaaaggtgtattttgcttgcctacctaaagagaagtttgcagttctagttgaacagttgtgcatctgtgaagttcgttatggatgtcccctttaggatgcgtttggagtgaggtattgaactgaagaagctattaattttagtgacctaacttcttgagtg

SEQ ID NO: 79560 - DNA, 19966 bp, Oryza sativa
ggggagaggagagagagggagggagagttgggccgagccggcccaagaagggaaggggggaaaaaggactttttagggctttttctttttataaaaccattttaactttgtttatttcttaataattattatttgtgctctgaaaattccactaaaatttgagggctccttttagaccaaggagaatttaccaaaaattctccgggccacattcgactttttcttgtacgtattttagtgtttgccaatttcttttcgaattttaattaattctattattccttttggaaaatgatttttatttcgggatgaatttatcaggacgtgacagcagttatgtatggtggatgcatggccccggacatattatgaagttccaatcatcgattacagggaaacaaacatgcgtttagaggtagaagagaaggccgattgcatatactgatagagctatgtaattgatcagtcatccattaatcgtaacctgtgtaaatgacaataaattggtaattgattagtagttaacgccatatgtaactgtgcaagaaagcatggttaaaattagaatatatcttgctttccccagaaaaatatatatcttgcattcgcacaaatgggtttacaagaatgactaaaagtcaaattttagacatcaaccattagaggcaagaagaaaatagatttggtttagtggatgaagcctacgtaagtggcagtgatatagtggatgaaaacatatatagcgatgtgatcaagcaacaagtggaaatgagaattagtgaattggggcttgtgtccagtggccagttcgtgtccggctaaaaattaattagggcgtagcagcaaacaaccaggaaggagttagaggctgttacgactgaaacaattactaaattaccattgtagtgcttttttatctctaagttgccctttagcaaatcaagggccgatgatgctgagtactccctccgtcccacaatataagggattttgaatttttcttgcaacgtttgaccactcgtcttattcattttttttttgcaaatataaaaaacaaaaagttatgtttaaaatactgtgagataataaagtaagtcacaaataaaataaataataatttcaaaaaattttgaataagacgagttgtcaaacgttacaagcaaaaactcaaaatcccttatattatgagacggatggagtagtttgagaggtgccttgcattgggtacctcccaagaaccttaaaagctctgctttatctttggtgaagatgacggaagggtgcatatatgcgcagtcctgtatatatacttgaaacatggacaagaaagggattttcaggctattcaggtggctgaagaattgtactatcagttaattggacttgttaattagttgaagtacatcatgaagctgccagcacccaggaggcccaggagggtaaaaggtgccatgagaattatatacgaccaagactgactaacgaatatattgtatacatgataggtttacctgaaagctgggaaaagaactcatgtgtgatcgatgcttgtttatgatggaacaaagggaatttaatctgtacatttccttcctttttttttaatagtggaaattccggccttggcttgaacagacgaaggtacagctaatgttatcttatacctacttaaaaaatcggcaactttctaatcggcaccgatgcattttcgtccgttgtcttgcgcctttgcagctcatgcccgcttcgtccatttgctcacgtcgtccacccgtgttcaaataaaattaaacaaagacaggctgagcggataccaagttcaacacaaaaggtagtcggatacggatttgatttggactcaaaaagtgataaaatcaaccccataaatacaacaaggattgcacgggatatcaattgctacaataagaaatcaagcaagacacatagcaattagtgagatctgacataatttcatgaaggtggctttgacttgcagtgtcgagctccgagcggcagtgcacggctttggtgagggacggaagctcgatggcatctccccaccgatgagacaggttcatgaggaaccagaggaggcctggtgaggaagtggagtgtaacgccccgatattcgttagctataaacacaagacaacttacaccagggtgttatgcattacctgtgagatagtaccagtcccaggatacactagctagtacacacagaataaatgttgaatcacagtaaactgttttattatatcactaggtagtagtccttacaaacgttgccatcatggacaggcccatagataagcaacacaacattacagaaaaccataaaagcgacggcatataagcgaacagcgcggagacactaagcgactaagcaactaagcactaggcaaagcacctagaaaactaacttattccacaggcgagactttgggctaggcacgaaacatctagaagtcttcatactcggcttgctcctagagacactcctcagcggtcgagtcgacatcttcatcctcgtactctatagattaatgtaagggtaagggtgagtacttaacgtactcagcgagctaggggaaagaatgacatgttcggtttaaacaaggagactagggttttatttgcggaagcggcctttttggcaaagtgatttatttcacaaaactcctagtgagtcaaaatgttagttgtcgggaggaggctcacgcctcgacccattccacaagttgctttgcaacaacttgtcacaagattaactaacaataattaatttgcttcctctgttattttctgttcactttcacaacaacatagttcacccagctatctcagcacatcaacaccttctcgcccctaacgacatctcggtgttagacgacaccccgggtcacacagatccattcctaactacaaaggttagccgtctgccacataggcggactctggaaatgttttccttcccaataaccactattccttaatcatttgtcaaatgaatctacactatgagaaacaccttacactcgcccttgaccgtgggcacggctgttcgaacagttcattaatctctgcagaggttgtacgatttacccacacggcacgaaactgacactgtttactcgtcggtaacagaagttcgtgataaggcttttccaaagctaacccatgaaaatagcatgccacctagttgggctaagtctcttagccgagtatcaggcaaggtcagccttcatccactcaggaaatatcgaggatgtctcctactaatatcgcgtgccacaatagaggcaataaaaacacccaaaagggctataaagatccaaacttcgtctcctcaccctcggcatcccacaaccattggcacaccgcactcctatgtgataacaatttacttagccagaggcatcccatcaacacccgtgtggtcgcgctgtaatgtgtttggatggattttccaaaggaaacggtccttaacgataatacgtggccaaaccacaaaggcatgactttgcatcatcactatttacacagcacattttatttcacagcacctcggtacaacatactgaattttttagcatgtaattggaataacctagtttcctacacggtaaatcaacgttagcatggctaagcaaactacctcggtagtcgcataacgataccggcgcaaatatttgtggagctatcaaaggtaaagaaacaacaacatatgtaaactaactgcaactaatatgtcagtccgtcggttgtataaacaatccgaggcctaaacatgtttatcgtgtatactaagcaatgcacttatcaaacaaacatatcttgcaaatataggggcaatgtgatcaaagaggcttgccttgcacagggctggggtcttctccctcaaaagcggcctccaaagcttcctcgtactcaggctctaaacgtgaaaaacaaaactaattaacaaaaggcaataaaacaagctcaaatcagagaaacaatgatgccactgtgtagatctcaattttagaaaaatataggaacttgaaggggtcaaacggagttacggttgaatttctatgaattttcaaagattaaaaggattttttggaatatttggaaatctatttattaacggaaagggaatattccgctaatgcggacagcaagaggggcccacctgtcagtgactgaaagagagaaggaggcacggggcccggctatcagcggtggggttttcttcttcctcctctcgctcggttcagctctggggcggaggcgtgacgtggcagcgaggctcggctcggcgaccggcggtcggggaggcggcagcgaactccggtggagctatgccagcgacggcggcgctgggaggcgaggtgcggcggcttgagcagcggcacagacaaatcaggagagaagagagaggagagatgggaatggcgtggtgagcatgggggctcgggcccttttataggcggcgtggcatggcgggacgtggcggtgagctggcgtctaggcgcgggagaactgtgggtagctggctagccactacagcgggaatccgggaggggatggcgacgcgacagcgtggcgtcacgcaccggtggcgatgcgacggcgaaaacgacggtgacatgacacgaggtgacgcgcggagagagggaatggcgacgggacaacgatgacgcgcagtcgacggcagctacagccaagagttgggacggtagagctcagaacgaggcgacgggagcgacgtcacgcggtggtggcgacacgacgcaagagagagggagagacgcggtcttggcagcttcccggagtggatgggcaacaagacgacgagacgatggcaaggggacgcgcatccgcgagaactcgggatgggacaatgacggaacaacagatgacgcaaagcgacgcggcgccgtgtctcccggcaggaattcggagcgagggagcgggattcacagctgctcaggaaacttctcatcaatcgagctagcagaagtggatggttcagtgagtggctcgatcgttagaggttcctctatcttggacacggatgcctccggctggggttcattggattgcgtcatgaaggaagtattttctagaatgcgatccaaaattgtccttccttctgacggtgttttgtgcatgaccgatcctccagcggttatgtccagatagaatgcagactccttatccaaacccgtatggaaatgttgaagaagcacatactcgggtaaggacagggttggtccggattgcactaaattagtaaatctggaccatgctgcaccaattgatccgttcttgatctgtttaaaactgagaatttctactcgaagggcagtaatacgagtaactggaaagaaggcaagacagaatctgtctcgcaacttttcctagctaccgtttacacatccaacggtagaggtgtaccatttctttgctctctcttgaagagagaacatgaacaatttccaccgcacagtttcttgtctcatgccacgcatcttaaggcacgagcagacttgttcaaagtctcgcagatgatggtagggattttctagatcaaagccagaaaaaagatttttccctaaccatactaattagttcgggacgaatttcatagccagttgtataaatgggctccgatgaagaaggtggctcatagaattcgccccgaggagcagacagctaaaaaagaggttgctccatggtcgagaagagtttgacaggaatacttctctaggatagcaggggtaaaggtataataaaaaacttaaaaatgatacgaggatgaactaggttcggaaatgatcagcaaccgttccccggtgacggcgccagaaatgcttgttggtagttcttacgatcacagataaaatccgcaagcgcacggatataccgatgcagtactttccctatggagtattccaagggtattgaatccaagggaacgtgtgtgatcagatcttccttcagttcatccaaggacaccaagcagatgataggctaggatagagaggatttagtagtgagaaacatctagggaaagcttaattttaatcgtaacgcaatacttcaggcactggaaacccgttgttcccagatatcgctctactacgtacccggatagggaggacttaagtgatctcgagggctgtcaccacctctacacccacctcaaacgtactgtgggatacgcagtaattactggataacaactacctaaacaccacgtctaagcaattaatatctactttagtttttataactcactaaagcaatcactatattttagttggttatagtgaacaataatcctgtatgctatttaggaactaaccaagagataattctcatgagataaatctaaattactcaagaagaatattatattgaactcagagtaataaacagaataaaagaaataggagaagattaccgacaactccggaattcttccgacttcttctattctactctcttcctattctagtacacaatatagtacaatagagcctcttataattcagctcaagcttggaagtgtgtgtgagagtgaatgaagtgaggtctatttataggacaggtatgacggttataggaaggggaattatccgaagtgccccctaaccgccatcaggaatgcatctggagcgtccatgccaaaacctgggatcaacggtgatcaccagggttcggccgaacctgggctgggcccccctagcctggcctttggcctggctcctctcctggtcctcatctatccattcttcagagttttgggttgatttactgatgttttgatgaagttccctcctggcctggcctttggcctggctcctctcctagtcctcctctatccattcttcggagttttgggttgatttactaatgttttgatgaagttcacaacccctccttgtatggatacgtaattctcctcactttagtccagatttcctcccaacatcaggttttatcatctgcatacaaatatacaccaacactgtggaatatatgctctattatctgaactttatgtagatgttggcggtatagaattgacatttaacagccgccaacagtgatgctacagaaaacatgtgctctcatttatggattaattaggcttaaaaaaatgtcacgcgaattagctctcatttatataactagttttgtaagtagtctatgtttagtccttcaaattaatgtccaaacatcatatatgatagagactaaagtttagtccctggctccctgcatccaaacaccacctaagctcaaagcctggtttggttccccaaacttttttcccaaaaacatcacatcgaatctttggacacatgcatggagcattaaatatagattaaaaaactaaatgcacatttaggggggaaatcacgagacgaaccttttgagcctattagtccataattagccataaatactaaagtaacccatatgtgctaatgacgaattaattaggctcaaaagattcgtctcgtagttttcaggcgagttatgaaattagtttcttcattcgtatccgaaaacccttccgacatccggtcaaacatccgatgtgatacccaaaaattttcttttcgtgaactaaacaggtcctaaggggatcgatcttatccaaacccgttgactggttgacgttaccactactggggaagggctctttattcccggtttacaaccccttttagtcctgggttgcaaatcaggacgaccaatccgggactaaagatataaacgggagtaaaaatgaatctttagtcaccgttggtaacaccaaccgggaataaagttcccagcgccattttagtctggttggttaggcgcttttttttcctttatttttttgcttcttgcatttattgtcaccttcaaatccacacaaatcatccccaaatcatgcacaacaaatcatccacaattctcagcccatccacaaaatcatccacaatccacaagtcattcacaaaatcatccaccaaatcatccccaaatctaaaataatttacaacaaaatttacaaatcattccaaaaataaaagaaaatcacaaaacaagccgccgttggccacccagccgtgtgccgcctcccggcctccgccgcccggccgccgctgctcagccgctatcgcccggccgccttcgcctggctgcctccgccagggagaggagagggggaggagaggggaagggggacgaaggggagaaaaggccgggagagggggaggaggtggaaaaaaggaggggaggaggaggagaagaggatgagagaggggaggaggaggagaggaggaggggataaggacgagcggggagaacaaggcacggcgcgcgggtcgaggcaggattttcatgatttttttatgttaccaaccgggactaaaaaataataggactctgacatgtctttgaaccgggagtaaaaataatacttagtcctgattggtaacaccaaccgggactaaatataaaaaaaaaattattgtgtgttttcaaaccgggactaatgtgatttttaagcgatccagcaaaatcatttctccagtagtgtcccaggtttttaactgggaaaagaaaaatctaatgtttttctacaacatggaagctgaatatatgcgtgtggtgtggaacttggaagggacagacgcggacacacatgaatgcggtggtggagccattgatatcgtgaagcccgaatgagtactaacattttccagtaatattcgactaatttttttagacatgaatggctattaatttacagtgaagacgttagcggaggagcctggacgacgcccgacctgcccggggctagctccgccactgcgtgatgaatgggctacacaatgtgggcctggatgcaggacgctcatgtacatattcgagaggttttctagaaaaggaaaaaggaacggttcggtccggcttgtactgtttgagtttagtcgatggttcaataactaaaacagaacaattaattgataccaggatttcacatattgagaaattgaacgatataactacaaatccgcagaaatgtaatctaggtccaattcaaatgctgatcaaacatctatacgtgtgggcttgtggttatttcttagttagtatcattatttatgaacatggaactcctattcccgtttaagctgctcgcgtagtacaagccctgttaattcatgttattttatgagatcactgaaatttatccgcatccgcatgcatgctgtgaggtcaacgaaatgtaagagctcgcctagaacttgtgacttaattagtaggtcatgtttggcataactccaaatctaatacctatgatagatataaagtttgtatgttaaactatagtggtttaaaatttaaaattttatttaaaatgtgaacaaaatgatttatctaaatgctatcagcgtaaccgtagatccatatccatagatttgtggagctgaaaatactcagctctaaaaaatcttgcatctctggagctatatcaaaaagtgtctagtatcaaaatttcacctcttgaatatggtatctcaatatgctctcctaaattaattattgcttgaataccatagtggccgtcaactccttacgcactcactatttgctcctttggctctctccaccaattgttgaggtgttgttgtctttgtttgcttatccgttagcgcgggtgttttatcttttcctactatatgacttgcgtcttttattttactggcacttaatttgttcgttttgtttatatgtattattcagcttcctgtctataagttggcagggttttacccatcatgactacatacgtaaaattaaagttttttttatccgttgcaaagcacaggtattttgctagttatttggtagcacctaaggctatcaataagactttgaaatatgacaagattataataaacgataacacccactagagtgggacaatctgttcattggctggtcaattccgtgtatcttctgtgatcgaagtagacaatcaagattcttcactccacatgcatgaaagaaaggagtgcagaacttctgcatgtaactgaaaggatcattggtctctctctctctctctctctcttacccctctcatgtttttactcatttgtttttcatttattaatggatcgatttttacatttccttggctggtcaattctgtgtatcttcagtgatccaagtagacgaaataaagattcctcactccgacatgcatgaaagaaaaaggagtgcagaacttctgcatgcaacttctgaaaggatcactgatttttagctccaaacatcacaggattcataagctgaaaagttgcgaaatacacaaggaaattgaaattacactcacagacacatggtacacaacacatgtactctcgtctctgctcctaaatactccatccgtccctaaatatttgacggcatttattttttttaagcatgtttaaccgttcgtcttattcaaaaaattttataaaatatgtaaaattatatatatacataaaagtatatttaactatgaatcaaatgataggaaaagaattaataattacttaaattttttgaataaaatgaacggctaaatatgtttaaaaaagtcaacggcgagacggaggaagtatataggcgacgttgacggactaccgtggcggcgccgacatggagctatcaacgtcgtcggcgtggcagcggtggtgcggcgaggcctgctcgacgatgtgttgtggcacggcgggcagcttgccgccgccggtggcggcggtgtcgtgcacgggcgcgtggatgatgagccaccagatcttgcgcaggagctccgccgcgtacacgacgtagaggaagacgacgacggtgaggacggtgacgtagatggagcagggcgccgcgtgcgtgctgccggcgatgtaggcacccatgaggcacaccatgtcgagcaccgcgatgatctccagcgccaccaccttcgcctccgagtggtagaacgactcgttcatcagcaggatgatgatcaccaccgacgtcacgaacgctgtcgcgttgaagtagaagaacacggtgtaccttatcacatgcacatcaaacattgaaaagaaagattaatggaggggtctcgccgtggtcggaggcaaaaattagttcgtcgttgttacctttgtgggaagttggactggagcaccggcgtgccggcgacgtgactctcaccgtcgttgtgctgccagaagccgccgggagggttgagtccggcatggtaggtgacggaggcggcgagcacggcgagcaccatcagccagccgctcatctccttgagccacttctcccgcttcttcttcgcctcgttcaactgccccagcgccgccgcggccgccgcctcctcctccttcttgtggtggtgcaggtacagcacgcccgtgtacgccggcggcaaagccgctgcgtccccgtcaacgccgggacgggaacgatgggagatatcaggacttgcacggggttccccgtggccggcatcgcctgatcgccggcggcgtcgtcggcactggcgctcggaggttggccattgataaggttaagatccatcagtatctccacggacattgttggtgacgggattcttgctatctttctgcaactcggatgatccgatcgatcgagcacctggttgatttttactgatgctgaagtgtttcaggatttcagctaggagatggatctctgtgtaagtaagtatataagtactccaagctgtccatgcatattgaagctaagcttgccgacgattggcgcacacggtccatgtggcacgtgagtgcgaagcgtagaaccaactgtccaggacaggctgtcactgcaagagagctcggcacatatatatatatatgtttagattcattaacatatatataaatattggcaatgttagaaaatcttacaatataaaactatatgtttagattcattaacatatatataaatattggcaatgttagaaaatcttacaatataaaacggaggaagtagttgttagtactcgtttttttgaaaaccttgttagtactcgttaggctgcattctgtgtaagactcacgacctcgcgtaacgttacatactgtaagagtcacgtcacgttattaagatcattctgttaaaccagcatgaatgaagtatgaaggttacactgatctccatcttaaaatagtaaccaaatgttaaaattagacacacaatctatattatgtttaactgagggaataaacaaaagtaatcagtaaacaccatacatgacaaaaatgagacttggcaccgttcaaatcagatgggcttatcggccgcacataaatctagacgagttattggtgttgtgaaacaaatctctaggagataagtttcttgtgggccaatctaaatcagagtagagataagttctatctcctcctaagactcctagatatacaggggcagggtgtaatatttaaggttggcttgtactccagatgagatctataatgaagagagaactccaccctatatttgtgttcattgtctacttctgcaatgttcttgagggcaaaggaatgggcgcgggtgttcgacatgatatcacgtctctattgttgtaggagggacagggaaaggatccggtgatccgctaataggcgtgttggtttacaacacgttatcagcagctcttcgttcaccggtttgtcgttccaatctattgctattagattgattttttttaacgacagattgatttgctcggttgttcttggcttgcatgtaccggtggatttgctatctaatatagcgcagtgtcgtctgcatctcttcatgcacgacttcacgccggcacgacctagggttggccttgtaacgcgcatgtatggatgcatcttgcgtccttggatgcttgagatcgatcggcaaaaagcatgttgcaagcatgcatgcatcagtatatgcatctaattttcttgttgcttaggccttgtatagtttggttttgcgtgtgggtcctcggactcgtaaataatcatgtaatggtgcttttaaacattctaatgcttttaaagttgatgcaattccaataaaataatttagatacggatttctaggttatgatgcttccataaattgtgttcacatagtgttgaatctccccttggaagcattatgatgggtttattttcctgcatcaatatgtgatggttttctgtgtgacataaatattgggaatacaatgctaaataagaccaagtaaataacagaaaatcacctaatgcatgaaaattctgggaaattgaatatccatggctatggataagaccgctctttactgataaactccttcatacataaatggtgatattaatgtgtctacaagatggagacacgtattcttgttgtacgagatccatgcttttgccgaattcatcacgcatattgtccgtttgcgtcttgggttctctgagaactgcatgaaatgatttggacagatagtgtgggtgatttcacgtaaaggccttcaatgactatagctttgggcattaatgtagatcactctatccctatgatcacactcaagaataggattctgagtcgttgaaatgtgtgaaattagattatgggcttgggattctctgtgcctttcccctagtggcttaacatctcaattagagtacagtcggactacggtcgacattttgctttcccaatggttgagagcacacttttctgatttggagataaatgattatacctcaattttctagcaacttggagttgcgaggttcaataatttgagatatttttcactcggtccggtgaaagatgtaaagtgttttccatgtggtggaatgacattgttcatatggttgcccctattgtgcacatatcttctcaatattattttgaacctgatgtcttgcaaggacaccggaaaattggagccaaatctagcagaataagcccgagggtagatactgtgaatatgcatgattcccacttcactatagcaccaacagctaaacttgggtgttgacccaatctcgatcctcgcgtggatctagcgctaaatggccacctttggttgatgaccaatggttggtagtgtttgtctaataaagttgttttgacaatgggagttgtatggctagtttcgagcatgtcctaggagaacattggtcggctatactgttgtctgttgccaagcagtttatcttttgcttagtttggaactttgcattagatcgatattttctagatagataaagttcttggtctttcctattctattctaaagcttatcttcatgctggaattgacaaaatgctttagtttagaagaacaattagtgtatgatccaaggagttacaactactaacacaattcggtgtaactgtatttcagacaaatgttggctatgcactattgtgttttatcgtgttcttgtagtcggtgactactccctggttgtgttggttgatcagccatcggttgatgaccatgcttgtcgcacgctggcgtttttcacgtgtggacgtgtgcaagccatgcaaagattcgtcgtgttgcataagttgagctcgttgtgccaacgatgattgcatcgacacaccccactatttttgtggatatgtctgaacataatggttttatagtgaatattgttggaggtattgattatctcccgatggctatgtttaggggacataagctaatgtggtttgacaactcgcttatgaatcgtacctaaaacatgctgcttaacatgagtgacccaattctagaatttggtatgagtaattggatcgttcttgcagccttgttggaaagctgccatcacctccgtgttagtgacatgcagaatggtgttgcgacgttccgtgaagcggcgaatgtaattggagaagcgttcgtcgttgccttgaacgatctggtatagatcccactgagtgcccgggtggggaaaggtgccctggaagttgacgatgaactgccccttcagttcgaaccaactgttgatggtgtacctcggtagccccgtcacccatgcctgggcggctgtggtcagcatgactagcaggcagtttgccatgactagttggtcgcccccggcagcttggatggtggtagagtagacggaaagccatgcgctggggtcggtcttgccgtcgtatacttgttgatgcccatgggcttgaagttggccggccatctgactcgacgtaggttgacggtgaaagctggtatgccctcggtgccgtcgtcgcggtgtgggagggggtcgggcaagtggttgcggtagtcatggtatggtcgatggacgacaatgtgttgacgaaaaaaattgaacacaccggcctgggagatctgcttagctcctgtgcaggtccaaagattggtaagatgcgggtgtgccagtcagtttgatcctgcaactgacaagatatgcaaataatagacaaaacagccgatcggctgacaagccgatggagtagttccagccgatagccgataatagccgatgccgataccagccgatagcgatagggttttgagcaatcagctatacgtctaatgtagattctaacactttagtaaataatgatatataggcaatcaactactgataataaaatataacaataatattgtccagtataaaccaatcgtctagcattgatatgatagaataagcactgatctgaaggttaaagcatacatcggctggagatccgatgtcatgaaatccacaaggttagattaaacagtgaaacctttgttgtcatcggctaaatccaacttatatgtatatgcaatccttatgagccgatgcaacgtccagataactcaccggctgaaaccccgatgaaacccttattggcaatcaagaagcaggctagagattatgtttcaaaacccgacttagtagatcaaacttaactgatgcagtactaagtatgaaaagaaacataatatctagacaatcaagccgttgactaagttttcagggtggtagatgtctaagctaatcccgataccggcagaaaccctaaaacgagaagcagccgatagagctaaattgatatgctaatactagattaacagagacatatgataaataggtaggcaaatatatcatccaaaccagagcaatccaaaaggtcgaatgtactgatgcagccttgaacgacgccgatgtaaacgatataattgcctgggccggcgaaacatcggtgcagccccgcgtcaggtgccaagtcccgccggacgataaaataaagtagaaaaggtaaaaggaggcgatgcgccgaattgtattgatcgtgaagataaattacatagacctcgggtgtacatatttatacccataggttgatacaagtccttctcggacaagaaagaaactttcctaaagataaaaggaaactaacaaactattcctaattaatagataaactgacatgccgcatccttcttgaactcggactcttctggataaattccctttagttgatccgactccatcgagaacacggttgctggcgatttgacgactctcatcggctgattccataactctgaaggcgatactgactctaagtcgatgatgactttgggctaaccaaatttcgttgttaacacaatgcagccgtccggctggacgtcggcgtggcagcggccagcgtagatgttgtcctcatgtatccgtagacgttaggcgtcgcggagctggcgacgcttgttcatgacgttgcggaggtcggcgtttagccgacgtcccacctcgatcttgtcgcgcaggtcgctggtgcgcagacttgggtgtgaccttcccgcttgagatgcctcgacacgccttgacccggtattttgtggccgggatggtctcttgccagaggagtcgctggcagtggaggcggtcagtggtacttcggtgtgctggacagcggcggcatccaccatggccttcacctgagcgatggtggtcttgacggccgggtcgcctggaatcggcatgttgtcgaggagggccttggcggctatcatgttgttctgtagcgtggtgaagacatcatgttctcccaacttgacttggaggatggcattttgggcgagacggccgcgctgtcgcagctcgtttagacgccgagtgaggtcctcctgctgctactggatacggcgcttctcctcttcgtactcccttttctcctcgtccgtctcttgaaagacgatgaagacctcgcgggagtgatggcttgaagtccgggtgttgttggagcttcccgagtccgagtcggagagacgtacagactcatcaaggaaaccaacccagcaggatctgagctcccgcggcagtcgaggacggtgacgcggagcggccgtggtgtcccgggcaccgcgggggtttggacgtgatcgggcggctggtgtcgaggttgccgacttgaaatgccttggcagaggaagcaacgaagttgctgataccgagaggtgctggcggtgtagttgtcgatggcgtgagttcccacgaagccagcttgaggacgccggagttggtggcgaagaagtcgagactgccgaaggagagagcttgattcctggagggtagcggtaggctgtaaccggcccgatgacgccgaggctcacctgacagaccttgccgaagctgtcggcgatgaagtcgaatgcgccaaaggagatttgggtggtggcagggaagtggtggtgttggtgatctcaacgccggtggatgccatctccgccttgaaaataatcaagcgccccctacctggcacgccaactatcgatttcttggatcggcaatatattttatggggtgcgctagataagaagagatggtgacacataagtttatcctggtttaggccctcagagtgagataataccctacgtccagtgtgtttaactctgtatccggtggaaaaatgatccgaagacctccctcagactgccaccggcgccttttatactggcttaggcccgccggcgctaatcagggtacagtatccttataatctagatacttgcctactattacatgatacgtggttcattgccatatctgctatagcttaccaactatacaacacctaccatactcggaattgggtcttcggcccacccctgaggacgcgatcttagtcctcaatatggggtacccgggtgccacatacctcacactttttatgttggttttaatagttagagagggagtcattattacgaatcagattcgacccatatctgaggtagctaaatagacttttttttcctaattccacgaaaaacttaaagcccatctgaaatcgttagttttgctcttgctcagttgccagggcccatctgaaaaaattttaaagcccaaataatatggaggcctatttcacctggttttgcctcgttcaacgccactcccctgcaggaccaaaccaccaccgccgccacttgtgccaccatgcatctcgatcgccgcctctgaccaagtcaccctcccacgcccgcgcatctcccgccgtccacgcctccacgacgcccgccatcgacggcatccaccaccgccacgtccgcaaccgcgaaaccgcactcgtacgtccactcctatataatcatccctcctcccccccggccggagagatcacgacatcgacggatcatccaatcatccaatcgctgagctgagccaactgtattagtgttcgtccatctgtgacagttagcaacagaagtagtgttgctgccatggccggagcagcgctgctgttcccggctaccgtcatcgccgccgcctgcgtcgtcctctccggcggggcgtcggcggcgccgccggggcgcgtgttcgtcgtcggcggcgacgggccgaggggttggagccagccgacgggcaccgacgagacgtacaaccactgggcctcccggaaccgcttccacatcggcgatttcctcggtgagatcgatcgatcgatcgccatttccattacatattgcttgctgcattgcattcgtcgtccatggtggtgacatgatcgcggcattgtgtgtgtgtgtgagtgtgcagatttcaagtacgccaagaacgactcggtggtggtggtgtcgcgcgccgactacaagctctgcagcgccgacaagccggtgcagcggttcgacgacggcgccgacgtcaggttccgcctcgacaggaacggcaacttctacttcatcagcggcgcgccgggccactgcaaggccggccagaggatgacggtccgcgtcatggcggaccacgccgccaagggcgccggcggcggcgactccccggccggtgcgccgtcgcccgacggcgacggcgacgacgaggacgacagcggcgggtcgtaccgcacgccggggtacggttactcgtcggggtcgccgccgacgccgccgcacgggaataccagcgccgccgccgtcgtctcgccgtcgcgtggtggtggtggtggcggcggctaccaccgcgtcgccggggttgccgccgccgcgctgctcgtcttggcttgagatgctgccacgtggctacgtctgccgcttaattagctagactcagtgatgtagtttgtcgtgtgcttcttaatttaaacctatcatattagctagactggtgatgtaatttgttggctgttagaaatgttaaacctgctacttagttttcgttaattactggtaccgtacgtggtgcatggacgtctctgagggcctttttttttcttattaacatacataattcggttcttgttaccacgaccttttaactgttaaacaatatgttttatgtaaaaattttgtatataaaaattactttgaaatattaaataatcaaaaaaattaaattttaaataactaaaacttaattaatcatttgctaataaatagggctgca

SEQ ID NO: 79561 - DNA, 3800 bp, Oryza sativa
gctgtgatgcggttatgcccttttttcctgaggtatttttagaagaaaatttctacatgtttcatattgcattatcagggactcttcaaactgttcgtccccggaagctgtcggcacagtgaggaagcagatcaccagccatcgtagctatcacaatgccaaagagccaacaacaaaggtcagggtcttgatctcttgtatgcccagtaacaggttaatcctcctggctctctgtactgaaacaatttctctggatctctttcccttttgttttggaccttatacaacctgctgatggttaataatgatgttcttgaataatagatcatgttaagctgtttgcatggtctgctgctgtcaaatagttttatgcggtcacaactcttactaactgatcaggttgacttcaagcattgggctaaaaactaagattatgtaacttaaataacatatatgccatcatcttcaatttaagtgatattgtgtcaatcttctgatcaactgtttacatcttcgggttatgtagattcatgtcatcttcttttactctgaaatgctatatgagattggcagaatgtcctgatttcccaggcatggcgatggctgtccaagggctgcttaaggagagctgctgctggaaatgcccagcaaattgctgatggatggaggatgcataatcactcagtgtggtgaccatctgatttagcatggcgtatttcgcaaaaggtttgaaattcaaaacagtgtctcatcggatacgccatagtgattttcagtttctcttattggcgtacctctgcttgtggaaccctcctggatctgaatattgcattcccactgttccatctggcttctccttcaggccggcaaagcattgcaaaacagacctaacaaagattacttccccctatttgtcgtaagaaactttggatgttatgtagaacagaccttggtatatgcagttcttgaccataagttcactatctgtcttctgcttgtaataattgatccacctagaattacaaagtggtcttattatttcatctctgaaatcctcactacgaaagaaactggagaagactattgcaactgtcatcacagcgacctcagttttgcttcgacagcttcttgtcgcagtcctaacacttgtatatatgtacataccctaatcttaatcttgctccgttttaaatcttgtgctatcagtaatcaagtccagtttgagctatgaactgatctgtaattagatattacaatcaatacacgaggagaagaactgggcaaacaacgtgatgctggtataacttcatcaaatgttatattagaactcatatcacgtcacataagtgtacacagaaaactcaagtcacattctgatttttttttttctcggatcatgctagcagatgagatgaggaataaataagattggaaatatgttatgtaccagcgagaattcttcacattctgttttagtttgctccctcccaactgttagtttttcacttacagattcaagaaaattcaagctgaacgcttagattttagtatgatacatttcttttataaagggtaggaccccctgtcgttattgaaaccaaatgttggggatgcagaaatttcagggctagggatgccagctaaaattaaaggatacaaaagacctgcacatcagagttttgcagaccaaagaatctaacaacaacaggacctcacaggagaaacaataaggacaacacacacacacgaagacccagtctcctgaaaacactacatggtcaaatgtatatcaaatattgtgcaatctcaaacaggattaacttcttgtattaacttgtataaatggggagtgattctccctcccacaaaactctaaataaatttgttttcctgctctatcaatacacaaggcatagttcttgctttcttagaaaacattctcagtcaggatcgctttggagaatttgcatgaaaatgtttggcgtatcagtcgctatcgctactaaattcctcaagttttgctctatcctccatctgcaatagcacactcttaagactgaaaaaaggcatttcaataccgcactcgaagactgaaaaaagaagataaccttaaaaaaaagagagatcaactcagtttgcttaggattttttttgttcaattaattaccgttttattgcgagtttggcgagtaagtccactgtaaaattttacagaagaacttcacatcagtgaataactggggccacggcccacacccacccttcaacagttaagaaaggaagtcctctttctatgtatgtttcaattttgaagatgtatcacaaccaagcatgtctaaaagagatccagcgtcatattcaaagaacacagagtggtttaatattgtagcagcatgaagatgaggtacagcaaacgccaatctcatatcgcggtttccattgaattggaacttgaaagttgaaaatatgacaaaaacatcattgtgggaagaaaaaagagaataaacagtaatcatctcgaaggaaaacataaattggttgacagttccaaacagaaattggtgatgcggatctacttagctgctggtagaacccttggcatcccgcgtcgccgctccatccatcaccgccgcccgccggcgtcatccccggtctcggcgccgcgcttcttcggcccatccatccgccgtcgctcctcatccccaatcttccctcttcatccttccatctgcttttcaaccattgacatatcgtcgaacccatagtctgaatcagccgtaataaacaattgacgcatacagttgacgaacaagtcaatcaagtgttttgtagcgcaaatttgccagaaattccactcaactcgatattaccaaaactgcttgtccatcggttgaacgcgttcgctccctgcgcgcgcttaaccaccactccatccgtcccgccccacacaacctggggccgcatagttttgaattaaaaagaacagctacatcgtttttggccggtgccagtaggagaggcagtgttcaatacgtcagaggatatcgttgcgttgagagtgacacgcgagacgacgggactcaccttgtactctcgcggtggtctctctcgacagcaccatggtctgcggcaacgtcagcaccgtcgtccccatgttgcagcacaccagcatggccagggagcagaagttggtgctcgacgccgacgccgacgacgacgggttgcaccacaccggcgcaggcgggaagcagcagaagttggtgctcgacgccgccgccgacgggttgcacctcaccggcgtgggcgggaagcagcacaacttggtgctcgacgccggcgcgggcgggaagcagcagaaattggtgctcgacgccgccgacgacgggttgcacctcgccggcgtgggcgggaagcagcacaacttggtgctcgacgctggcacgggcaggaagcagcagaagttggtgctcgacgccgacgacgacgggttgcacctcgccggcgtgggcggaaagcagcacaacttggtgctcgacgccgccgacgacgggttgcacctccccggcgtgggcgggaagcagcacaacttggtggtcgacgccggcgcgggcgggaagcagcagaaattggtgctcgacgatgccgacgacgggttgcacctcgccggcgtgggcgggaagcagcacaacttggtggtcgacgccggcgcgagcgggaagcagcagaagttggtgctcgacgccgccgacgacgggttgcacctcgccggcgtgggcgagaagcagcacaacttggtgctg

SEQ ID NO: 79562 - DNA, 2917 bp, Oryza sativa
ttgatgcggagaaagtctaacagtttggacaagtgggatggtgggggaccaaactgttggttctgttgcgcctgctgcaacatctgatggtaatgttgttgcatctgttgcatcatcattgtcatcatctgagtgaccattgggttctcgggcggtggagatggactgctgctagatgcaccactggtatgagctccatcggtctgctcttcgctgccactggcatcgttggagtcacggggatcgttccttgtcttcaccatctggacgaggataggtagaaataagagaaaggaattaaacagatggctcggcaactaatctttcttgtaaatttaagtgcaattatcttaatcttgattaaaaaactgaaaaggaagcaaacaactcctaattaaggcagccataccactggcacttgatatcgaccgccgactaacccacaagcaacaaacctaaacacagaaactagcaagcaatcaaaactaagaagatgataaggctaaaggcgacgactctgaagcttggagcgtcgcttgcgaacgaggaacaggtctaacatctaaagaggacagaaggataggaaccaacacatgctcaaaaccaaattaaataaagcaacaaatgactcaagtaactcgccgagcatgatgatttttatgcgtggaacatttttcatgaacccagacaaagatactaatgcaactgactaaacgataaattaatgcacaaaatagatgcatagctataatacacacataaaattgcccatcgaacctagacacgacttagtgcatatcacctaacaaattcccgactgactgccaaataaattccaaataatgtttttctaaaacaccatactattcctagtcgataaatccaattgaaatagcgatcaagatttttcccacgaatcaaaagagcaaaccccaaaattttcccaaaacaaatccaagtgcaaaaggcatgtgcagatgaaaaggtttcagagggctcttagggtttccagttggcttgtcctacggtcaaggtcggctctgataacaacttgtcacgcccaaaaattcacgaaccagaatttctaagctgaatgtgcattaaacccctgtccaggaccagccagggtacacaaacgacaattgttgacatacaaatctacgtcttacaaaaatataaaagattacaaatgcagtggaaaagaaaaaaacgagataagcctgaagacttgactcctgcagcgggcgactccattccacaggcaatccttgacggtagcgacgaaaccaacctcttcgagacatcaccaactgagaagaacttcaactctggtgtgggggaaaaagagagcaagactgagtactacccactgtactcagcaagtcataccagaagaggaggtatgatgcaggatatatccaagggaggctaaaggttcttttgcataaagctagcatttaaaagcagtagttgaaagcagtaaaacagttgcagtaattaatcaatattaaccaatcactgctcaacgctacaccacgttaagacaggcccaaaccaccacctgaactaaccagttccattagctaactaggggtgagactaattacggtaaatctggtcgaccgcccataaccgcgggcacgactattcgaatagttttactctgatcagaggtgtacaactgtacccacaagacacagccccacgacacgtttccgtgcgccgacatgccaccacgacatactgaaaagaggccgtgacaggacccttcgcataaccccctctaaccgatcgcaccacaccttagggttcgcccccgtccccagcgggcaacgggcagcccccctttcgtgccgcggtgaatccggaagccgatcaaccggacaccccggccgacccaacaccatcacacccaccctcgcctgggtacgtcggctagagggaagctatactacaagcccagtcgttgcccacgctggcttgtggtaagcacgataaattcttccagggtttcccgcgaaccggtccttaatcgccatgggcacaactagcaaaaccatgcacccacagcccaccatgtagtgtattttaattaactaacaccattgcggtggcactaatccaaagctatgccaataatcaaagtctatgcattaatgtgattcccctttgtgtactagttgaactaagcatggctaagcgttccctaaaccaacatctaatcattttgatacccaagttatcgatggcataaggtaaacaatatatggctgagtagtaggacccatcccacatgatattgtaaaacaatgcaacatttaatagaaatgcgggacatttgtaaattgggtacaatctgatcaattgtaatacatgacttgccttgctcttccactgatgagaccatagcaacgtcttcgaggagccacggatcgacgaaacgaccgaaatctacgcgaaaaacaaagcacacaagcaaaacatgctataagtctactgaaacaggagacaaaaccatttttaatggattctatacatttttacgaatttactgagacttgaatggactaaaacggagctcggatgaattagatatgaattttagaagattatctgtatttttactaataaagaaaagccttaatgtatttattgcgcaatatgtcccagggctgacgtcatccaaggggtggggcggcgccgacaggcggggcccacgggtcagcggcacaagagagagggtggtgacctggcgggtgggccccaccaggtggtggcttaaaggggggagaggaagaccgccctggtcggcttattttcaagccggccggccgttatggcgagggcggcggcggcaagcgaccaccgacggcggcagcggcaagcgtccaccgatggcggcgacaggcgaaaagac

SEQ ID NO: 79563 - DNA, 4437 bp, Oryza sativa
ccgatcaaatcatcccatatttaactatacatactttctaatacccgtatggatcttcagaaatccacagtcattctttcgcatgagaaatagcaaaaccgttttttcagaaaaaactagagaaacaagtgttctgtgctctataaatagtcttagaagtgtggtgcaacatatatataaagatatactccctccgtcctataaaaagtccaactttggtattggatttttttttatagggggagtactgctttactaaagatgaaaataagaaaatctgactctgcactgcagaagtcacttcagatttggaagaactgttccagatgcttcatgcttgccattgagtagctactggctagcatcttgtctgtcacagttctactaagcacaatcatgttggctcatgtttttagtactactacagagcatgcaaggccaaatgccaatcatgaaaggaagatgatttgctgccaatcagcaaaagggaaagaaaaaaggaacaaaataaagaactatgctagtagagggacagatgctgagtaggactcaggtgcttggttagttggtttggcataattcaggctatgtatatacagtagtagcttaggagaaggataatctaaccatttgctcctttggaatactttgcataatctgattctgcctgagatgccaagcagaagggatggatccaaaatgccgagtcagatccacatttcaacatgtattcccctatgttagggtctcatcaatgcccctgtgtatgctttgttggctgcaatgatgatcataccctgtactgaatggccaagaaagcctagatccatggaacagtctaccaccagtggtcatgttcatgtaagctgtaaaattttcttcagattaacattatagtagatcaattgtccaacctcaagtttttactaggagtttgcatctgtctaaatacctgtttgtttgataggagtatgtctccgtctctaactgtactttggtctagacttgggcacatgatggtgaaagagacttgaccatcgatttctgtcgcgatgaaaatggtatgtctggcaagaggaatgtagaatttcagaagcgcatttgtgtcagctatgctgctgtttccatctctattttcacttttttctattatttttgctcgacaataaagaagccaataccggtttttacaggttatatccctgttaagtactacctccgtcccgaaatataagggattttgtgtggatgtgacatatactaatactatgattatgaacagaccctccatcccgaattaaaagggattttgtgtggatgtaacacatcctaatactacaaatataaactacgaatatgaacagaccttccgtcccgaaatataagggattttcgaaatataagggattttgtatgaatgtgacacattctaatactacgaatctggataaaaaagtatgtccaagtgtcacatccacctaaaatcccttatatttcaggacggagacaatatgaaactatttaaattactttcatgatacttgtatattacactgatactagaaatgttttcataatatatagattgatcaatatatcctaatagagagttatggtcaactctgtatcaaagagacggtaaaaattcaaaaatgtaaaaataatacatgttttaacagtattgatcaacattcctcctatataatgatataaacttctaagctggatagtggccagtgctcaaattgtagtagcttagttcaggtgcctggccttgctggcaagggccacgacagctgctatttcaggttcagaatcaaagcttcaagtttcaacctcccttagtaccatgtttagatggagtaatatctcaataacatgtaaatagcacaacaatcatcagcatttacatagttggatttgatcaaaccaataccagatcaactcagattgagaaattagaatataataaaaaattggctatcaatggcatttagttgtaatataaaacataataatattatatagttctgattaatgggatagtaacattatttgttaacactatgcctgctgatttacaccagaacatcaacatggacagccatctaagattggaattacattgacagaactaatactccagcaaagtgcttcttgactgctaggtggcaaacatagtaatgtagcaggaactaagacaggtaacttccaagtcttcacatagggtaaatatgaacagcaaagccaacctgcataagtacaggagtctaatatcaagcatctagtaagggaacaagcatttcacagaaatctgaaaaaacaaaatgaagcacaaacctaccatattgggacttgcatgttccgcagacatcattgtctaactttgttcctcaagaccatcgaggcttgaagagaagtagaaaactagagctcatgaaagcggaaagggattcggagggtgtatgatgatttgaatataggttggtactaaatgcaacttgtgaagagacatgagatgaatctagaatgaatgaaggtggagagaacatgtcatgatagatatgcagcaaactgggaaaaagttagtattgacatagaagggagcaagagaggggacagcttccatcttccacccagcttcttccttccaaaaagcagaagagccagtgaggagatatattggtgttctttgcagagcaccagggaggtcaggatggttgaagggtgagaatcagttagctaggaggttatatatatgcaaagaaatgcaagaaaagtagtttccctagaactatttaacatctgattggggtctaagatactagaatgtatgctatcgttaacaagctgccagactatgctattctacctgaaatgaactaaccgcagatgtttctgcactggcagagtgccactgtcagttcatcacaggtgccatggatgcaaataagattttatactacacctaaaacatcataggtgagcccaagctatgaaggtatgtcaactgccatccaccctatccttaccccactgtccaccttaacaacacctacatatgacagttttcactacccaactttcagaagatgcttcacctacaaaactccacctccaccataaccttgaccatacagtactacctaacttattattctcattactctatacactactatgcatgtgaacaactaaagtcagtggatgataacctatgtacacagacactacccttccatcctcccatcattcaatgatcggaaatatccagatggagaatcctcctaagattctccgtcgcaacagcagtttcattatcattgaagaagtcaaaccctgatccacccaccggcgaggaaggagccgatttagcatgcggcttcacctccacttcatcagaccgctcaaatagtggcaattcaagtgagatgctgcggttctgtcgcagagagaacttggggattgggagcgaactaggcaggtggtgaattggagaatgctgggcccgcccacagctcagggcgggatggaggagaagttgtttttgcttattgagatgggccggctacgcttgccaccacggcgctgcagctgttgctgctgctttggcgtcttaggctctggtgatgagtacctgcgaccacgcggaggtggtggggagggcaggaggccagcacatacaccggaatgaaaagaccggcagttcatgccacggaagccatgggagaacggcggcgatgagaagtgaggccccgtcatcttgcctcggccaccagagtgttggttatggtggttgcgctgctgtgagataaccacaagaccctccatcgtcggcgatggtgatgatgattgcggtgggcgtgaaagctcgacacttcgcgatataacttaggcagcttggagcagtaggtcacccaaagccctagtgcaaaacaaacataaacacactatgagaccaggtggcatccccttcactagtacaataaactgaagttagcgcaatcaactgtagttagagtaactacaacagaagaaaacaaaaaggacagtctttaaagctaagttcagcataatcgcaagacacaacgcttctaacagttgagaaacaaacagagaactatcactaacaatcacagcaccaactgggagtactaaatttctcagcgccacacatcaatccacaggaaaactaaagccgcgacgacgattagattcatgatgatactgtgagcaacaaattccacgggaagaaaagggattattccttttcgatgggggttaccttccagatctacagccgatgcgcaagtcgaatcctccacagaaatcgtcgtctccaccaaccaaccagactctcctcttcctctcctccgattctccgtcagatccaccacccacacggatcagcacacactgcatccatccacacgagca

SEQ ID NO: 79564 - DNA, 1158 bp, Oryza sativa
catatactaatagtataataaacaactattgtataaattagctattaaattggctatagataaattagagccagtagttggctataccattaaccttgctctaagagcacccgcaatagtaaagtaaggtgctatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatagagagcctatagataaccattgtgggtgccctaatactacatgcataatactacatgcagtcatgatgacctgtgaggctgtgactgttgggaggagaatgaaaattgatgtcaccggcaatccggcagtcctgcagacgggcagaaaaaatgtgtctgcaatgtgcagactctacttggtgcatactgtatgcagtacgtaaatttcatccaaatgccaaatctgccaccaaacgccttggcctcatatgccattcaacatttcatccagatgtactatacactacggtgccgttcttacaagtttgtataacttgaattccatagtccagactgcaacaatccgaaatccatgaaaagtataataacttaaagggtgaattaacttaaattctaaattagtactacagttcatggaacagatacttcctataacttgggaagttctctgccgaaaatcagttgttctgctcagggtacccttttgactgctccagggaatcagttgtgttccatgtctcttagttgacgtaattttgtacaattgcttccgcacaccagtcgtgcactcgtgcttccaatgttatgcctggcgacaaactgccagtgacacttccacagttcaactgatgctacacgttggagcagatttcttcgtaggtattacctccttcctgaaaatataagggatttttgcattgcgaaatcccttatattttgagatgaaggtagtaacatgcttttcgtcttccacgagtttatatagcctaactgccagagtgtctcacgatataaacgtccttccatttgttgttattggta

SEQ ID NO: 79565 - DNA, 1388 bp, Oryza sativa
caaggtttgttcattacctcgtgaatggcactgcataagaatttcatttcactgcatcatacaatcatagttgaatatatgaaaatggtttttcagtagcacaacattgtaaatgtgaacttgctgccatggcaatgttcttttgaagtagtcattcataaatcatggcttaaattcactgcgtcatatgccaaatatctgcattcagcattcgccttctgtatggccagttgcctggtaaatggattcagcaaacaaacaatatcagagagtacttgcgactacaattctgcagttatcctgtagaactgacaatatgaaaccatatgcagactgttccagcatctgctatccctgatggttggatgggccttgatattggcccagactccatcaagactttcagtgaaactttggatactaccaagactgtcatctggaatgggcctatgggagtgttcgagtttgagaaattcgctgctggcactgatgtgagtactgtttttgaacagatttatcagcacaggtttttgtgtttgaagctaaatgtgttcttaatcaattcaggcaattgccaagaaattggctgatatcaccgccaaaggtgttacaacgatcattggaggtggcgattctgttgctgctgtcgagaaggccgggttggcggacaagatgagccacatttcaacgggaggtggcgcgagcttggaactgttggaaggcaagaccctcccaggagtccttgctcttaatgacgcataacactgggggcaagcatatgacccaatttccctagccttttgcggtggtctggttcggaccttggtgtaagttggtaaaaatgcaaagtcagtcgtctgctacctttgaacttgaaataggcttcgcttcaggtattgctagatgacagtgaataataataagcttttggcgtcctcggcatgagagaaatgcccggctcaaacaaactataatggtgtactatattttgccatattctagttgcagcagtttacactaagctataatatcgctcttgctgttatgaatgagacctgtacatgttgtgtatggagacaaatgccactgtgcatactgttttaagccttctcacgtgaagcttctgggctgccagtttggttttgggcgttggtatgttgctttcagattctatgtatcatccaaagctaactttgtgaatagaacttgatgatgaattcgttgcaattagatgtcatggaacgtgaggatggctagctgtttctcaagaccttttctgccattagttttcttgcagtaggcttttccaatgtgcaagatactggaccgaaacctggcacgatctgtgtcgcggttaatcacaaatagaagaatcttatcatatgttg

SEQ ID NO: 79566 - DNA, 3168 bp, Oryza sativa
ccgctggatttgataaaagatcttggcgtccggggtgatctgggccgttggatcgggtgtgggaggctcgaatggacggtgatcgtgcgggggagggggtggcttggggctgaggagtggggggctctccggtgttttggggttaatcacggatgtgtgccgcttggggagttgggttattgagcacttttgttggagctaatccacttggtcatttgtagaaagatgcttatcaaaagtgctttccttttttttcttgtaggggtaatccaaagtgctttctaaacaagtgtttgctaaagtatcctcaatgagcaaatactacctccatcataaaataattgtaattctagattctttagtacaataggtggattagtagttgagggtaaaacaagaagaaatttgaatgaaaaagtaattaatgagactattagtactccattgtgacaattaatttgggacatattcaaatcctaaaaatacaaatattatgggacaaagatagcagtgatacgtaactaagcaaacgctaccagttatttagtttagaataaattttatgagtcacattttattatcgaagtttcgatttggataacattttaaccaatatttttatttggatcatattttattaccgatgtcggtcgaatttaatcctgacatggaagttagttttccccttttccctctttgcagaacttttttttctagttatttacaaacagggaggaacgcgaattgaaattaacaaagagatggacttgaaagaacatttttttcacaagttattctcaagtggaatggaaagtaaactatctgcaatttggctattcatgtccaagttgagatttccctatagttgtaaattttgtcttaaggcaaattttgacataagacacttaaaattgttatactttgctggtaaatattgtaaaaatgtgtgatggttgaaagacacctgaaaaattgataatttgctagagaatacttctagcctgatcaaagagaaaaactctttaaaatgacgcgaatgcccctaaaaccaaaagcttctgaactgacgctggattgatatgatgtatgctagcaatgtgcatcggatgatagaaaatttagaattggcttgcatcctcatggacattctcatctatttgaaaatttcttcaattggactaaaagtgtcatccaacaaattaccaaaatttgagggtgtcctcccactgcagcatgtatttgtgatgtttgccaacaaattacatacactataagtgtccttttcttaaacactttttaagaaaaatcttcatccagggcggcaaaaatcatgagtcacgtcattttgctagttcaacagtgtcaagaacatgaatagtaaactgttgtacattgaccaggttaaggataaataatgataacagatcagaatgtgatcaggtactactagtaccatgactgtatttcaaagacttcaattgcactaaacaagaattttctaaatccttcctgtgagtctcaacatcggcaagtaaagccacacgtcgagtatatattcctcaccggcactgcacataaagcaacactacatcgacttcatccgtgcctctgaattctgattctgggtgctactttacagtactgaatatataccttgtgttttagactgtaatccatcagattacagatgaatccacttcaaaaatctctcaaattagttaagcataccaaagtttaattactctgagacttttaactttcagcagtggcactggcaaacactattctgaacagtaagcttttggccatcaactctgtcaagagagatgggcagcttttgaccagatgatcaaatccatcagccccttcatacaccagggtgggggcaccagtgagagagatcggcaggtcatggggccatccgaatcggtgaggtcagcaaacggaagttcactgcgacaacgagatcggcgttgtcttcgttgaggacagagaagaggggatgatgcgaggctgagagtgtggggggcgaggacaaggggcaccatcgacaaggtggaggtggtcgtttcctggtgtgggaggcgattctggtgttgacaaagtagacaggaggtggtcgccaggtgcttcctgcatgtctcaagcttgccgcatcgtgctccttgctagctcctcgctgctcgtctccattgtttacaggtacgtcatcctcagctaattatcaggtaccagacttgataggtatcaagcctgatacccaccggtattagacttggtacccaagtatcagccgatacccatagttatcaggtgccaagtaccaggtatcaagtatcaggtgccaagtactaggtattaggtatcaggtgccaagtactaggtatcagttatcatgtcgcgaggaggaagcgcaggttgtcactttctagccggctagttagccatttaccaccgatttctcctctcctcttctccctcctctcctattctccctttctctcctcgacacactccctcctttccctactgttgatgcggctcacgaggggaggagccaactagcggagctgtgcatcacccgtgtatgaaagctgccatggctactccagctagatgcaacgatgcatagacaacgctgacgagctgtcgggtaggaacctggttggggaaggcgcggtcctgctcaaagtagttgcggcggcgctccgcgccaccgcaggcgaggtattgcccgtggaggcgcatgataccgagtaggctcttggatggggaaggcgtcgccggcgaggtttttgcgtggaggtggtaggtagggggaatcgtgtggatggcgtggcacttggtcgaaaatggaatgtattaaatcggccgagggtgtttagttatcccgtgactttcatgttgtaacagaatcccatgcggtagctgccctctttgtttagtgtctttcaggaaaactatattcatcctttaagagaatatcccattatttttacatttcacttaaaaaggttatcaaaaaaaatttagtaagatagattaatataaaaatttagtaagatagattaatacgtgacatgtcacttcacaaacatgcatattcaaattcaacttatataagtagaaacaaaacaacaaatgggactatgaataaaacgcataatt

SEQ ID NO: 79567 - DNA, 853 bp, Oryza sativa
tagaactgcagaagcaagttcagatgaactaacaatgtccctggagcattgtttttttgtgaaaatgtatatatagcagtgtagtaaatgtgtccgaggaggaaatgggggacaaaattgctcagagttccaactgagaatgtatcaacagttgtgagattagatagcaatatatcgtactgtatcaaatcatcaagtgcacacaaagaagaaaaccatgttcaagagaaaatgagaagtatatggctaatagtttaatcgttacaggaacaaagaacactgacctcctttctccatagtccatagaagttcgggaaaaggttgcatcatatagcttgtcagcttatagtgatgacctgctgagaaatcacagtcaaaaaagaactacagatcaacagctcgatggatcagaaacaaattgcatgacaaaacaagataacatcgatcagcaacctaccttaagacaattacgaacctgtgatcgaagactggagccccgatgagatggttttgctggtagtgagagagtgaagctgcaacatgatctgatcgatgaaattaaagacatggatgccttcaaaccgatcaaatccatacatagctcagaacaacgaatgcagatcgagatcagaactgcagtagcagctcctggctgaattcaatatattcagcagtgcaactcatggaccagatcatgctggcagcttcagcctctcacaccagcaagaactaatatcttctgaccaaagaaaaatgcgtgctcaaacgatacttctggcattgtgtcaatccatccatctatatgtatatcatcagtggcaatttcggtagggcagtgagacaaaatcttgcg

SEQ ID NO: 79568 - DNA, 1105 bp, Oryza sativa
tgtttaacgcgccgttttgcattttagcaagcatctgagcccagaatctgggattttacgggcgagttaggccgtacaatctaagattgacgtactgttcgcttaatcattttgtaacttgaatccttgatagctcgcctgtttataccatttcgtagttttcaagcaatatgctatgcggctgcgcctcaatcacgattggcgattcgtttgttcactactgctggaaaggagctacaccaacccatcccacgtacgcaatgcaacatggctccttaccagcagctctccacaaatcacaagctcaacaacatgacagtgcgaactttgctaccattcacccatataacaaaacaatgggagacgttaagttcgaatatacacgccgttatagcacacagcagaagtgttcgggagatatgaaattggtaaaatactgcagaacatatatatccgggcgatatgaagttggcaaaatacggcagaacatatatattgatttatgccatcggttataccaagtggaagcataatctggaagtcccacgcccattaaaaatataacccttaaaaataacgactacactaattacctcggtacagcaaatttgatgaaagcatctataattctgtttgagaacagtattccagacatcaccaagtaaatggatgaatatatgctgtagatccaaaaaaattgcagtacaacagtaacgttttcacatatgttgggtctcacaaatatctattatgttggatagggaatgaacaaattcatcaaaacttcaaaaaaattattgatgtcagcgtcactagttaacttgacaaatccagtgcaataaatgaccagaaacaagtatgttcaagagtcaaaacaaaaacatgaacaactcccaaaataaacaaacacaggatgtgacgcatcctagtaatactaatttgaactgacgtcacatcttatactagatttgtttttttgggacagagggagtacattataacaaacaattcagttacaagagaagcaaagtaaggcattacgtcaaaaatatgacaacagataattgccacacgatacatacaaggatttacaggtgcatgaaag

SEQ ID NO: 79569 - DNA, 4484 bp, Oryza sativa
cgccccgaactagtaccgaccggaatagcccgtgacgctccaaattaacctgtaattcgatatcagtcccaggaaacagtgctggtatcacaggaagacagattatcacagcaacagaggtctctttaatatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactccacatcagcaggatccgcttcatcttcttcagcaactagggggattatttatatagagcaagggtgagtacgggagtactcagcaagccaggggaaataagtgtttaatgcaggcttcaaggagaggctggtgtttttgcaattgattttatttgaactcttttctgaaacaactaaatgagtgcttctcaaacgacacggatgagacagtgcgtctcgtccggtcggagtatgtgcaatgtatcagtctttagattttgaaacgaggttggcacccggccaacagcttttcaaacggccactcgggccaacaactttcaaacggccacccgggcctagctgattccatcagctacagatttttcaaacatcgaacccctttccacaacagcaatttcacaagcagaagttaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgccgagaggggtcccagaccaacaacaggttaggtcccagaccatactgtgccaggaagcccaggggtcctccccgacaccacctcggcgaatccacatatctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacctaggtgtcgggttttccaagtcttttgtaaaacccaagttttacccaagttgtttttcagattttaagtttgaaggcgtccgtcgatactcgcactgggtgcacgaatatcgagacgcaactagatggttgcaaggggacatggtatcacaattaacaaaggacggatcaaatgcaacaaattaggtaggtctgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacagcgaaaataaagccctattaatgacctctaagcgtgtcattagatagatctcgagatttgaggaattttggaagttgaacggagtcaaacggacttacggttgggaagatattgaatttctaagattattggatttttgtctaaaggaaaaggatttaattaaatcctttttggaaaagaaaagaaaaaaaaagagggagggaaaatagacttccctcgggcggctagggcgcggcccgagagaaagggcggctcggccgagcttaacgggccggccggcccaagaaggcggcccagagcggcccaagacgcgcgcgcgcgggagggaggagagagagagccggtggaccgggctcaccacgcgcggtcccgggtgggacccgcttgtcagcggctcggctcaccgtgcggagggagcacgcggcgcggcgctagggtgggggagggacgcggtgcatgcgcgcggttcgcggtggatgcggatgcggaaaccgacttaggcggtcaaggcacgggctggcgctctggctagcggccaaaacggcgacaggaggtgacgccggcgagagggaaaaaggggaaaagagggagagaaaaggggagcttgcctctttggggaaaaggaggaggggagcgggggcgtcgcggcagagggaggagggctctgcctccgtcccttggcggcttgcgcgcggagaggcggggccaaggcgatgacgacggcgatgacggcggggtggtgtggagcggagcggcgacacgagcgacaggcgcggcaggcgctgacgacggcggcgaccaggcggttggccaccacggcacgcgcgcgcgggaagcaacgggcggcgcggcggtttgagcggcgcggctcgggcacgcgcgctggctgcggggctgagcggctgcaggcgcggcagggtagcggggccgggcgacgcggacggcgcagacgcgactcgggcgacgaccacgcgggcgcgcgcgcgaacgacgcgcggggagcgacagcgagggagcggagagggaggactcggctcggcgcggagggctcacgcgcacgcgcgcgggcagagcggagggggaggggcgctcggcgcggccctcgcgcacgcgcgcgcggcgcgcgggcggagcggggtaagggagagagagagagagagagagcgccggggaaggaagggggagatgggccgagagggattcggcccatcgaccctggggaggcaaaatagacttttgcggagggatttgatttggaaggatttggattcggaatttaactcgacgatagatcggggatttgagatcttgagatggcacggacactagacaacaagcgaagaaacaaatttcgcaattagggtttttaagagataattttcccgctagacgccacgacggaacgggcgctacagaccaacccccctaacaagaatctcgaccccgagattcagcacctaagggagcagctccgggaactcggcgtggagaagatcttctcgttcccaggttgcctcatcttcagaatggttgctccattgaactttgtagaacttgatggtcttccttcgagtctgacgttctgcctcttcaagaaccttgatcggtctttccttgtaggtcagattcttttccagctcgatattacccagggggacttgctcttctggaactcgaagacatttctttaactgggatacgtggaacacgttgtgcacatctgcgagaccttcaggtaactcaagctgataagccacttcgccacgtctggcggttatgaggtaggggccaatgtagcggggtgctaacttgccggacatcccaaaccttctcataccacggagaggtgatacccgcaggtacacatgatctccttcttcgaactcaaggtcacgcctccgattgtcagcgtaattcttttggcggttctgcgctgtctttaaacgttctcggatcagcttaacttgttcttctgctgccttgagtatgtcaggaccgaataccagcgcttcgcccacctcattccagcacaagggggtgcgacactttcttccgaacattgcctcattcggcgacatctgaatactggcctggtaactgttgttgtatgagaactcagcatacggcaaacaacgatcccaagtgcctttgaaatccagggcacacgcacgtagcatgtcttctaggatttggtttaccctttctgtctgaccatcggtctgctgatggtaggctttactaaaatttagatcggttccgagagcttcatgcaactgcttccagaaccttgaggtgaactgagtgcctcggtctgacacgatcttcttggggcagccaaatctacatacgacatgggtcatgtagagttctgctagtttctttccatcataggtggttttcactggcacgaaatgagccgatttcgtgagtcgatccacgattacccagatggagtcgtacccgctaggggttcttggcaaaccggtgatgaaatccattccgatttcttcccatttccactcgggaattggtaggggctgtagcagaccagctggcctctggtgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaattccttcttggccagtacacagatgcgtggaccgcaccaaactgtgccttgatcgtctatggagaaattggtatctttcttctcttgtattctttttattaactcttttatcccttcgtcgtctttct

SEQ ID NO: 79570 - DNA, 1881 bp, Oryza sativa
cccacgtgttctatacttctgtgccctaagaggcatcgtactccaccaggcaccagcctccatgacgagcagataaggcaccagccattgcggtgaggaagaaggtgactgcaagccaactagggttctaggatgagcttacccctatcttcttttcctttttctactgtttttttctctaaggccttcttctttcccttacatatatgaaaagtcaaataaaaagacaagacaactgggagaaaacaatactgtgtaaagggacgctacattgattcacaagaaccaatttcatttggaaggaaggaaaacagaaccaacttaaagaaacatagcaagataggacattcccttttctttctctctctctcttttttttttttggggggggggggcagaaagaagtagagaaaggattacagcacttgttcagctgctaaaacacaacctagaggtaaaagaagatagctatgctccgattgcacaaaactttgaagggaccaccaccacagacaatacagctctagagataggccagagatatttctggtaaggacactgaaaaattaaatatggacaaaaaaaagtacattttcagagccatctattagtaacatcatacaagaaactcttacacatattagtagtacgtatgcaagtgggatggatgacccacctactcaatctctgcacatggcctatagctatcgtacggcatctttatgaacaaagccagatattagggtaaagcaactgaatgatcagtgtgtgggttggctgaccaagcccagttacatacttgcatcctaacagaaaccccattaatcttatccaataaattccaaacaaaccggatgatgccgacaatactgagtagcaaataaaaggccaaagggcagatgctaccaattgtacaaatacagcccaatttacttatctaaagtatgtttaatcccacaaggaacaaaacaatgaaacccatatccctcacaaacaacacagtcaacagacaacattgttgataagaaacccaacgaatctaagagaatacaaggaaacccaacctaaaccaaatagaaaacaatccatctctaaaacatccagattggaaaaaagaaaaaaaaagaaatacatcactactgctttactttaagcattttctaatttttatcacctaacctaaacaagcaagccctacaatcaacggcatgaatgggaaacaacaggtccggttagatttcatgggaacatacatttataaggcctttactttaccctaatccctaaaatcagtgcaaggcaacgatatctgatgtaaattaggttccgagatcaacttggtctgggcgtttgtgcaaggggaccatgcaactgacgggagatatcgccgtcatcgccatggatgcgggagccagtggtcgggtcgtgccgtgcaacggacgccccccgttcaccgaacaaacgctaaccctaggtaccccaaccccgtggattacctgctcgaggcgtcgccgcggagggggagacgaacgaaccgcacgacatgacggtaatcgcaggttgtaatcgtcgatgccgccatcggcggcgggtggtgggaagggggacggtcatggcggctcgtggtcgtctagggttttcgatggcgaggcggatctagaagggagggggcgatgccgtcggtgcgagaggaggccggaggggaggaggaagaccaaaccctaggaaggaaatcgccgccgaatccgcctcgccgcgccgcgccggccgccggcgagaaggggggagagagagagaggcggatcgatttggggattttttccgagagggatgattcgggaaaggattaatgggcttcgttgtgggtgggttagccttgta

SEQ ID NO: 79571 - DNA, 5233 bp, Oryza sativa
atagcaccctgatactaggtagggatgaaaatgatcaaaatatacacgaacaattcccataaccatttttttttctttgaaacagaattggagtggtagagctggaaacgatgacgatattgatactaccggaacataaaaaatatcgggaacataattattgaaatagagcctctgaaacaacatatgtatcaagggcaagcaagtcatattcaaatttaattaaaactcctcattttcaaaatataaggcataactactttttcagatatttcataatatatggtgggcatgcatgtatgcatgcaactaactagcacattctctccatcaaattattattatttaaatcatttactctcaagatctctgatttggatgcatgcactgtatttattagagtgatccaaacgaggaggtgataataaatatatattgtgtctacagattaagggtggttatgccttatattttaaaatgaagggagtatgtgaagactcaaattaaagcattaagtaactaacttgaatattttataacgatattaatcataacatctccattaacaacacagggttatggtaatcggtaggtttctcttatcctaattgtttgtcagtactatacgctaatttcttcggaaattccgaatgaaaatggtataccgtcaaaatggccgggaaaaatacctctacaatttttgttccatttctaaacaatacaaaatcagaataaaacgattggtaaaaaaacagaaacaacagccactatggttgggcaatctccgtaccattttcaccactaataccaggtatgactatgagggcaccggctgaaggatagttcagcatccatcagcatgtgagcagaacaagaaagaaaagaagagaagaaaagaatgaagaataagaagacaacgacagcgaaggttgagttatatggcaatttttttacccatcctttgggcatggaaatgactggagtgaaagcaaagagaagacatgacccttgatatgagagaggagagatggatccatgcaaccctagctatctagtctcctagaggcctaaagccatccatggcagcaaggtggccggcctagccgaaagcacaaagctcagcagtacattttttgcatggggccaagccaaaacgatctcatggacagtgcacagcaaatgatgctagtttggtgaatggtgatcatgcatatggattgaaggaaaaaaattgcaaaatcaagaactagagatccattgttcattccaaaacagagctagtagattttttccacacaattttgcacgaggctggttttaaaagtagaaatggattagctatacaaactcttgcttttgttttaatcaatataattgtattttgtatgtaactaaatcaattaaatctctgttacaatctaacctaccacaatcaaacgacattcttacccttttcttctgattaaggtgataaatttttaggcattcagagagaacatggtatttcttttcctccatctccttataatatagtaatggaaacaagcaaccccatctcttcgcttatgcatatacttataagctaatatttgagttttaatatttaatttacatcatagtttatttgtacatcatttgtttttgaatcgctaagaacatgtatataaaagttttacatttattgattgataataagccatatgagaataagcacaagcataagaacgatggggctatccatccacggatccaccatccacattccctaacctgccctgattttgcatgcagttctgaattgattatgtcttctgctaatgattggggagtgccacaaactgtcatgactcatgagctgggggctgctgctcttttcacagcatcatgtcctagctgccctgataactgatctcacctccctcaggtcaggatcaaaaagcccctcattctggtctctggccatgcacaaacaacatagcctcatatattgatttgcaatagctaccaataattacattgcatggcatttatgccttgtgattaatcttttttatatcttgaagaaatcagtagcatgggaataaaggaaggagatcttacatattggatcggaaggcaatggagtgaaagtgtcacgcaaccaagataattagcttgtgatcctacttttaagacaagtacgtgcaaaaacaccatcaattggctcacaagtacgcatgcacgatgaagaacaaaagagcaaagtgcttattattcgatccggcacgaatctcgaggcacggaaagtagtgatatcagcacgacagcacctcaccttcaacttacagccttccaagggaaataaatccatagctcatatccgctgttgcctcaacaagaaggcctactgctacttcacaaatactgcattcttttctccaacttagctgtagtgctttgtcatgaagaattatggatcaaaatgcacctgcttttgatcaaatggtaaatgcaatttgaactacatgaaaagaggacgccgcgaaaacaaagcttcagttggtacccatagccaaagaacatttcaggagcaccctagacaaggcaaccagcacatcagccttttgggttgaaaggacttcggaatcggaattggagaagaacttgtgaagtgaagcccacctttttttttttttttggaaatgggagttttgcttggagagagagagaagcagccgggagaagcaactgtagggttttatcctctctaagagcaaggataataatacagctagctgcttactgtatagatctttatagtctatctcttaactcacttatatagtggttaactcttcactataaatatatggcccacctgtctgtatcacagattttcttggctcctgcgcctaagccgactgtaaacttacaccccgcttctcatctctctcctctgctctctcatccacctcagcattcagcctttttatagccctcttacttgctctaatcagtctaatgtatggagaaacttcactctgcatttctgttgttcctggacagataagaacacatcatgcatgttagtccactagtaaatagtaacactcaaaaacaggtttgcactcgatatttactcttgtacacaaactgcgtttggttcttgaagctgcatcaagccaccaaccatcttttggtggtttttacagacaagagttccaagttaattgttagcctgaagaccttagcatactggagacaatctacctagtgtgcatttgccaggcaatacctcagtacatatttgataacaaactagatctttatgactgctgcaagtagcacaaactaagttttttcttttaggcaatgcttataaattggcagtttgggaaagctttttgtaaaagtgaactcagctggattcatgcattccatagttatctacagtacacagaacacactcatttgaaaatgtttctcaaaaatcagcattaagttaaaaataaacactaaatatagtagtactgaactttataataaaatatccttaaaattctcaataatcatattgcgctattgtaaacggttaactacatggtcgtgcagttaagaccacttgagtagcagcattgcagcacatcaagcttcgagtggcagattgtgaagataataagagcagtcagatcaaccaaaggtgtaacttttattaccacggctatgtacaaaatcattatggtgagcattgtgctcattgagatctcccctaggcactagctagctatttcattcatgttctggatctagtagttgaagtgacattgttttcaagacagttccttttgtaacttgacttttccgtctaatgtgcaaatatgttaaaggcatctgcctctggctgagccaatctctctttttgaaagaagataaaacagcctgcgtttgttgatgaaggactgtgcaccaggaaggaactatcaagagaagctgtcaagaaagatatagaaatacctttatcaacaaatcgcccctttcaccaattgagctcatagtgtttgtggctaagaaaccatatatttcatatgcaccaggcccatttggaaaagaagccttctgccttcatgtatgtcactttgtgactggcaaaaaaggaagaaaatttagtagatactactaaagttgttagtatatgaaaaaagtaagtgcatttgaagtagtagtgcttgttaaacattttcatcggaaattaattattaagagaacagtaggggaaaccctatagtaatataatataaaaagcgcacagatgatctacaagactgacaaggaaacttaataaaagcactaacaacgcctaagctaacagcacaaaagagttatggagtaaggcctgatctaagctttagtgcccaatacaaggtacataaattgttaataattatggtgactattgtttgacgctacatatccatgccacaatgtcatgcttgacgcagatacattattagcgtcacagtgtctctgatgcaagagaaataaaagtgacgctaacgagatagaagatcaggtccagaatggatgttatattgataattgtagtcaccaatatttgggcccatatgttagtaatgactttttcttgagatttgaagtggtttttcagtacggcgcttccctactgggcactatgcaaatggaacaaatttaggagaataccacaggtacaccataatatgggaagtagccattgctgtctgaggtgttcattgcagcaaacagaacaacctaatatcaatatagaatcaagatattatttctgattatgaacctcactagcaggaatttacaaaatatcttaattatgacaagttgtatctgtcattagtagttgacattgcgaattaagtgtgatgcatgctacattgttttgaatcagcttttcctgttattatgctacaaatcaagccatgataaatccccatgctaataatagaagagattcttacaaacacatgatagcagtagacatgtgcaatgaaatacaatattttcaatgaagcaatgtatcataaatgtatgcctacgtatagacttatctgcatagttaagttaaggggtgcaagacattgaataatccttccaattttagagcagaaagatgtgcaccctattaatactaccaatccttgttatgtaagattttattaccagaggtttccatacagtggtgtccatccatacagtggtagca

SEQ ID NO: 79572 - DNA, 2105 bp, Oryza sativa
tggatagaggataccatattcagattttactagcccaacttgttcctgaagcttatctgataatagcttgagtaattctctcgcatctaactcaagccttgcaaagctcttatctttgaagaatgaaatatagtttagcatttgactgtcagtacatacagatttgttcgaggaacctgaattaacaggcttggttttctcataaggaagataaattttgttgttttcaactgcttcaagaactgctttagctgcttcaagtgaacgtttcgtatttttaccctttttaagcatatccaatatcatatccactgcagaatccagatctccaaatttcaagtggcaggagagcaagcaatcataaaactgcctgagctctgattcactaaggccacaggcctcattaacatgtctcctcagcttctggatctcatctctgtgcccattctgttcatatatccgggccataacaatcaacgagctgacgtcaggcttcaaccctatcctaggcattaattcaagaagctgctccgccttttttgtagtgccaaacagaagggatgcagtcagaattatgttgaaggtcaatgaattgggcttcattaatagcaatggacggttgctcttcttccgtggatcaaccctattattctggaaaaggtagccaatctccattaccatgtcagcagcaagaaatgcaccagttgcagtttggcacatatgcgccacgatagccgaccatgctgcaacaggtgggtatgcttccatctttatcaacttcctcacaacatttatagaaagattaggaagagaagaccgtgcgagtgcaagagagaggaaaataaggggctccttctccaacagtttgctcttctcttcaaatgcatgattaaccacattgtaggactggttcagccagtgagcatcacaggtctctgcgaagccagtgatgagcttactcaaaacagactttctggggactccatccatgtgaatatgcttctcataagccctccatgcatcatcaaacctctgctgatcaattgcattctctatctccaatgctagcagggatgggtcatgagcttggaccagaattgtttcagtaagagttgataagcatggaccataactaccaatatttagctttgtgttcaggaacccaattgcaccagtccggttagtccaacaacacttggagcccaagaaatgtgggctttcatgaccaatcaaatgtcttggacccaccaggaatgaagaaacagcacgggttgaagatcttgaacaaattctcccaacacgaagcatttgcctgccatggacaaggaggatcacacaacagaacaaaaagaactcagactaatatagcaaatgttagaattctgcatcgtgttagctggattcaacaaaataactagcaagcaaataatgtattggacacatggttgatgcattattcagtgttactcctcccatcctctgcccaattacaacaaggcaatcacaacagaacccaaaagagatatgcaatgcaaactataaagatctgttattgtggaacattgttgcaactaaagggagcttgcaagggtacaataaccacagccagaatcatcagtctgggttaatcaaaccaccccagtgcatgtccactaattagggaagattgtccttcagcctgataaaccagccccagtgctgtccgctaagcagggcggaatgccactcagactagataattgagtgacatttcgcagagaagctcaattgcaatgtacatagagaagaaaatctaaaagaaaatgtcataaagtttctctcatagtgttcctctagaacaagcttgcaaacaatgctactctacaaaccgcaaatttgctctaacagcactcctaaactcttctgtttctcactacccagcattctattatattagttcccatctaattcccttttcctcaacataaaacctccaccaccaccagcgccctaagcgattccagcattctagcaccacacagcagtagaggagccatgaaattttcattgagtgcgtgtcacaatgactcacaaagattgattttacacaatacaatctgcgccaa

SEQ ID NO: 79573 - DNA, 823 bp, Oryza sativa
ccaattattgtcacttggtacacaaacagtaggggctcatgccttaaccattctttgttgcgtagggagtacttgtgtagggtaactaatagccaaagcatcacaaatcacaaaccagaacttgacagaaaattggcctttttaaccagcacctgacaaccagccaattttctgttacagcacaaagtacactgttacagcacttgacaaaaaacggtgggcctgatcggaactgctggctgctgcagccgtcacgactgtggccgttttcagctgctgctgtagctgatttttagctctcgcagccgcagcggcggcagcagcaagcgctaccgatctctctcagtgtttgacatttccgacctctttaaaaataaatattttttatacaattttataaagctacttaaaatctgcaaaatttttacaatccaaaagaaccatttttttatgctactgctatttacattgaggtgttgctttgttggcaaatggcaaatcacactgaaactctgaaacccgatcatatataccttgacagcgtgaaatggctcgattaatttctctaggataagaacgaattcgcaaatgctcctcctacggtaaacaagcacatcaccatccagggtgcgcacgtacgcagcacattgcaattaccttttttttttcccttgcttttttgcagctagtgagtggagtagtgaccaacttatccacagcaaaagcaagcaaaccatggacgccctcgtatgcacgtatatccaatttatccagtgctgtgctaataaactgttaatccgtcgcatttacggggctgcaggaa

SEQ ID NO: 79574 - DNA, 2480 bp, Oryza sativa
ggcagccaccgagtcaggagtgccgcgcgcaggacgggggtgaggcggcgcgcaggctcacgagccgcgacggcgggctacgcgtgagcagagcgcgagcatgccagagtccgcgtccgcgtccgccgcgaggggaggggatcccggcgacggcgagccggcggcgcgcgccgcctctctctctctccgacgcagcgtgcgccggccggagaagacgagtgggctgaaataaaacgaaacgccaggcagatgtaagattgggcttttgttatcgtcctagtgggcctaccgaagcccaagtttgttacaaaagcccatgtaggcccatccgatgggctgggacttaatcgcacggcccagctaggttttagaaaacaaatcggcctgaactaggataaaaatcaagtttcgttgaaaacaaaatcttttcaattttggaggaaaacagaggactgataaattgataatactagcaagttctggatcgagaggcaaagagctcatctgaaccatattttttttatgctgttgagtgctactattgcttatccaattgaaaaccatggtccatgattttctttctggatttttgtactgttctttttttaggttgttctcaatgactttggataattctctgttaatacatatagctaatactctcgattcatgtttcaacaaaagcaaattatggttttttttcctacaagaaccattaacaacatgttcagatgattcagatttcctctctaacaaaagatttacaaagcatccatgcacagaattgcttgtaaaactgaacagctatcagcaataagctagaggcagagaccaaatgcaacactgtacacttgctgcttagagatggacagtccaatcaatccgtaccactattaccacactgacccactagcactgccattagtgctggtcactagcactaatgacatcactgacatgcaaatcatggaacgcaacagttgcatgaaccactcttatacatacttaaacaaaaacagggacaatgccaatctctgaaggcgacatggatctcaactctgaagtctgaacactagctcctaattgctcacctaatgagcttagctaccactctacaagaaccagaaaagggagcagattaattaagatgatctgacaaagaccaaatatctgaacatttgccatttggaattgaggagggagaggccttgagccacttccagtttcaggatcacgctgatcttcttctccaatttctgaaaattaacctggctgattgaatcagcaagttggagtttacaaaatagaagatctggcgagtcgatcggtgtcagagttcttcgatgccctcgtcgaatagcatctcgtggtagcggcattcgtggctgcagaaggccttctcacccctgaattaagaagaagaagatcaggcattctgatattcagaattggtcactttatcaattcttctgtagataatgatcacttgatcaaatggcatcaaacagtgtgaagaacttaacaatatttgtagtatctttttgcaagtgccaggtgatacttgacagtagtttaattagttagttggcgatgtggttatcaatgtgcataaatgtccatattaaactctatggaagtacagacatgataggcttttcactgaatcatcaccgtcgccaaattgcttagagcatcaggaaagttttaattcattgtaaattaactccaaattgcttagagcatcaggaaagctttaattaattttaaattaactaatcaagcaggtttatagatgagacatacttttcggcttttcgctcattatctttctttcagaaaaaaaatcaactccaaaaaacttaaaaagatttttcaaatctttgatattgaaaatgatactgaaatctgaaggtgatcggatgaacactctattcagttcagagaaatgaagagtagagtgacctgtacatgaagatgtccttgcctaggccaaggtccttgctgcagccatggcagtagcgcaagaagtcgccgtcgccgtcgtcgtcgcccttgccggcggcgctcggtggccagagctccggcgggaagtactcgccgtcgccggagctctcgacgacgcggttgtcgaagatgtgcgtcgtcctcgggttggccccgcgcgcgatgacgcaggtgtagtcctccgacatctcctccatcatctccctcggcgacatccaccggcggcgaggaggaggcgcgtactgcacggcggcgccgccgctcttgacgccgaactccgtgcacggcgcgtagtagttcgtctggacccggagcctgatctgcccggtcaggacagacgacgccgcggcgtcgccgggggcggcgtcgacctctccgtcgtcgtcgtcctcgtcgtcgttcaaggcgccgacgagcccgagcccgacgggcctcgtcgcgtcccaagggcggtgggtcctgcactgtccatcccc

SEQ ID NO: 79575 - DNA, 2216 bp, Oryza sativa
cgccgccgccgccgaccgccgtgatcaaacgcaatctcgtgctgctgcttgttgctgcctccactactgctacttggcttagctctcttcctcaacatgctaatactagcatcaaaatcaataattaccacagcaataatcctgcaaaagaatcaacgccatgaacgcatcagaagattgtgcaagaaccagtgggagatctcgtggacggacgcatgcatacacgcgcgatgaacaagatgaaagaaatcgatttcgtttacctgcagctagctaggctagccaagcatgcagagctggctgttatcttcagttttcgcaggagatcagcagcatgtacagtgtgtgtagctagctacgatgtcgccattagcgaagctccagtggtgtctgttaaatacatgcatgcagatgcagttgatgcagtgcagctaagcttctctccggttttgactgcagctggatatatggaacgcgagcaggtaagcgagctagctaggccctagaggactgtgcaacacactgacacgtgggaccgagggtgtggcagggatgggcgagaaaatataatgtggaaactacgtatataaaatgtaaacctggaaactaccgttgaataaaaaaaatagacgtatgatattagtccacatcatcacgggtaaaaattttacttgcagattcacttagagtaaaattttaactcatgatgacgtggacgaatctcgaacgtccatttttcgatccaacggtaatttccaagtttccactacgcatatagagtttgcactacatattttcctgtgatgggcggatggcccctcttgttgaaactcaatttttaaaattgattttgagcactttagttattataatctattttccggatttagcttttaaaccgctaataatacaaaggcaaaattagttccacaccatcaagcgttcccccacttttactttatatcactaaacgttcccggtacactttaataccacccaaaatttgctatgactgttagatattgtttttttccttttatttttggctgaaatatgaagggatacaaccatattacccatgcgctacacatctaaaacatgagccctaatcaattctttttatcgatcgtcgggcattgcgcattagagaagcagcacgagcggtggcgcgcataggagaagcacggcgagcggcttctagggcaagacgtacgaacgactccggcgggagttgtaaaacaatcctagagttcattattagttgacgttagagccttaactgtttgtatgaaaaataaatgacgttttagctttggtggggttagtttggactaatctgagaaaattgatattttaccatcttcgggatagggtttccctggaatgctactcccgaatatggcttcgttaaaatgtcactttcaaacaaagccaactcgctaaaatgccatttcgaccaatttaggttatttcgaaatgttttcaccgtgatccgacatatttgcccctagccatttcgttgacttgcgtgagaaaggggatcgatcccacccagtcgtcttcttcctcccatcttgccgccggcaaccaccacttcttccaactccccctttccatcttccccttccttgccggccacgcctatctcaccacgccttcctctccggtgaccacctcggccgtcgcgccgccaaagaggaattgtgaggtgtccgtgtccatgtccatggttgcgtcggcgtcggcagtccggccgccgatgacgtgagggacgtcgtcgctgccacacaacctccgcgggtcgcccatgtgcgggagctccatgcgcaggtgctcaagcaagggctccacctcaacctgcgctccgcggcgaggctggtgtccgcctacgcgctactccgtctcctcccgcgtcttcaacgcggtccaggacccgcacgccgacgccttcctcgccaacaccttgctccgtgcctacgtgctcggcggcgcgccacaggacacgctcaccacgttctccgccatgctgcgcagggggcatggcgaggcactcaaggaggaggtcgtcggagaggacgaagataggagccgacgacgtgggaggcgatagttgcgaggtggagcaaagactgacaagggcattttggtcgcaacaagagagcaaaatggtggaaaacatatcggaatcacctaaaatgctcgaaatggcattccag

SEQ ID NO: 79576 - DNA, 914 bp, Oryza sativa
caatactatgatcagggctcattttgaactaagggttttaaaacatttttgtaggatttcatataaagtatttagctttcgaagaaaatacttgtgttctaaacgagcccttatttggtacttcctccgtcccataaaaaaccaatctagtactattttgcatatactattttgcgtggaataccatgaattgtggctaatgttacttgagtggcttgatggatcaattccctgatgtgcttgccatttggatcgaccttgtcagcaaacaagtacatgaaagtgaagggtgttatcgatcgaagcctccaatctagcgcatcaaggactagaagctccatccgaaaaattgtccgatgctcaaatatgtatcttgcatcctccatctgtaaatgtacaacaatgtgcatgtatgcatgttgtaagaaagtattttcgtaaaggaagtactatcagaccctaggatgaattaatattgacagaaacaatgcaaatataccataaatggaacaaatatttggttaagagcacttaggccacctttggaacacaagaatcgtaaacggcaggaatagaagaaaaaggattttggtagaaatgcatatgcaaaatagagaaatagaaaacacatgatgaatggttatttggaaagaccataagaaatgcacaagaattgaatgagagagatagactcaaataaatttttcacgaggttgaatcccatgctaacttttctccaacatcttcatggattgagccattaaaaaaatcatagatccagtcctttgtttaaaggaccatttttttaaaaaataactataggattaaaatcctaaaaagaattcttcattttcctttgttccaaagaggatttaattgagatcaaaacatcaatgtgattgagtgattggttt

SEQ ID NO: 79577 - DNA, 2606 bp, Oryza sativa
ccccgccggaatcgagctcgcgctgtcgctctctctctccgcaatcgccgccgagctccggtccgctgccgtcgtcgccccggaccaccttccccctcggcgccgcctccttcggcttcgccgcatcctcgccgacctcgtccacccctccgtttcgctcgccgaccgccggagcaccgccgaccccgtccacccgagccgcgccgccgccttcctccgctccggtcgccgtttccgtcgtcgccgtcgacccggggtgagccgtggaccgccgcttcgtttccccccttccttcccctctctcggccgccgctccgccgtgcctatggccgctgccggcgaccataggggcgcgggcgcgccgcctcccgtcggctgtgccggcgtggccgccttcgggcgcgccccgcggctgccgcgtggggcccggccgtcagccgcccgcgccctcgggcgcggctgacgcgtggggcccacggcgccggccggtgcgagcccgtgtgcgcccggtccaccgtggaccgtggggctgccgcgtgggccccactcccgtggacccggtccgcgcgcccctcccctcggctgacgcaataaatccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacatttgggaaagcgagcaaggcaagtcacatcatccttgaacatattgaatcccggtttataaaattattttgatttaaattattgcattatcgctttatttaaattcccgcgctatcactgttttatctagccatgcctatttacctttgttatgaccttattattgttattgttattatttccttgttcaccctagaataaacaaaaccccaactagtggacactctactcatggtatcactagcatgagtttaggtagatggtacgctgtttaattaggtaacattaggtggttttacaactctagactttgggaattttctcatcacctggacactatggaatggtttaaatattgtggaattggattcacaccgcccccctctattcagaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtacgtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttgggacgagctgggacccaggtcgggttgccagttcggtctgaatcatcgtaggccttgggttaaggcaggttcgtgagggttcatggccttgattaataacagtgtatagctctaggatcgtgtttacaaaatagcttgagcaactaaacgtcttcaaatgctgtttactgcaactctaaccccttatattataattcccttgtactcccttgcatttattctgcatttgtgggtgtgtcttgttgagtacggtggttgtactcagtcttgcttaattttcccaagcccagatgaggagctccttgaagatgaaggcttcggtgtctagctcgtgcctgccgtcaagcgcctgtggtcttcgccctagtcttccgctgtttttcgttgtctttgtgtgctgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaaaacacgaggcctgggagatctgcttaactctagtgcaggtccaaagcttgccttcggatgtatgagcgtgccagttgatttgatcctgtaatcaacaagagatagaacaaagaaaccgcaattaatcctataaatgatagccgatcggctagatgccgatgacatatcatttatttcaagccgatgtcatgcgtacat

SEQ ID NO: 79578 - DNA, 684 bp, Oryza sativa
agttaattgttctatgattgaagtcacaagactattgcattctttgttcagtttggaggagattttcagccccaagcaaaaaaaaaaaaactcattaacacatgattaattaattaaatattaaatataaacttaaaaatgaatttatttatttatcgaagaacttatatatatatatatatatatatatatatatatatatatatatatatatatatatatatatatatatatatatatatatatataaataaaagaacgtatcgtttaatactttgaaaaacatactaacggaaacagaaagttgtagttcgaagttaaagaaaagaataatccggagttaaaacaattttagcacaatactcctaatttaatcttaaaattaagttataattcaaaaatgattgcagcttataagctaaatctgaaacaaatagaccagctaatctgaaacaaatatgcgaagtattgcttaccacatgttttgtacttttaactatagcaaagtcaagacaaataattaactttacaaacatatgaaccgtgctgctaaaaaatcgtcaagccgtgctgctaaaaagatgtcgcatcccttaggtacgacaataaacgtccaacaccctaacatatatatgctccatcccttttccacgagtgcgcgtgaaatttagcgaatgatatatc

SEQ ID NO: 79579 - DNA, 1304 bp, Oryza sativa
agaataatgtgcaacagattagataactgatcagggctaattgtgcttggtggaatattaaccaaagtactccttgattacctaccagagccgcaggtcaggctggtcgccgtcgtgcggctgcggccacagctgcagcaacgtgctcgacgccgccacccccttctcctcctccgggaagaagcaattgaacgcctccgccgccgtcgtcgccgccgccgccggcggcagcatcgtcagcgcctccattgccgacgcctccccggaaccagggctctgccagttctcgctgtgccagttctcactcatctaaagccgaacaaattgagtattataatactcctaaattcaacgtccacatgttaaaaaaagaataaattaaattggaaatagttaacccgcattcacgggtatatttgtcatttttgttgtaatttataaaagttgaatttaaacttgtatgtttatggagtgaaatattttcatattgatctatcttatcagttcttttaaaaaaatttgataactattttatactagttacatgcccgtgctaacgctacggcgaaacaacaaaaagatatacaatatattgtttgggctatcaagtatagattcaagacattaattaagacttacatatgagcgagtttagttaagaagcttattagaagttcctcagttattatatactcgaaagggataaacaagccaaataaactacatccaggacaaggttcaaaatttgcaaaacaagccataaggtcgacccattcagtcgacgatgtattatgtcttcaacgtcttttctccatgtcacagaaaaaccagtaagcaaagaacaaaagtctgattgatatattaagttctaaaccgattccaggacacattcagtcaattcagttcaaatacataatcatgcgtttcaacattaattaaagtatcacattcatatatcagtacatggcttggcaaaccacaaagctgaggctgccttaatctaagctacaacaaaatttcttttttttttgcattttagaataaacagtaaaagagaatggataaatcacatgtcctgaagctgtaaatttctacgaagtcctgagcagctcaattttggagagggtagtagtgttgttccctttatggttcatctgatgcatgaagaaggcaagttcaatttctggttcagtaactcttgttgttcctactgcttccaggaagtcatataaaccagaatcgccaagaattttcttgcttgatgactgtaaagagatgaaagttcaaactggtcattaaaaaaa

SEQ ID NO: 79580 - DNA, 1313 bp, Oryza sativa
ttaggggggcttgtttgcaaaactgggtgcatgaaactcagtgaagtgtgctctaagcattgaagtcactcatgtattatgttcttgttaacaacgaaatattgcatcagattcggattagaagaagaaagattgaggtggatttggtgtggaatcgagttgatctccaagttaggctacgcatcggctaagtatcgtatcggctgaagaccggacaaaatcttgacttggttgatatagcaagcagacgatacggtacaacttgggcttggtttgggcctagatttagataaccgtcatttccaataatagatagagcccaattaaggcaattgtatctatttattagattagtttaagtcgtttgtgactaattttgataagagaccactgtatatggtcttgtttatattttatctttagaaaagtttgagtcatatccataatggactaagtttgtactcagggtataaatatagacctcagagctctatagtacggaagacaatccaatacaacttcgatgcatcgccaccctttttattcttattttcggcgagttctctcgacaagaggtaacccgtctcgatgtcttgtgctatcagcgctattatgtcgttttagatgtttagtccttttatcatgaccatctgttatcatatgtcttagttaatatagtcttagtatctcaatttagccttattggttggttttcgctttaggattcctaccggtatcggctaaattgccttactagattagattagctaaggtatttaccatcttgaaaaatggttaattcctagattgtttagactttaggtttctttacttactttgacatgcatcatctctagtcttatctagaaacctaaaaactaacctggaattaatcaaaattagatatagcatcagagtttcagccaatattatctaatatacatgcttctttattggttttatgtatatttgccacttatatagacagatcatcccataaaatcatatcaagttagatcagtatcggttgggctatttgaattactagctgatcatgatttgatatgtccaaatagattgatttggttatataagtttgcactaaagtattagctagtactttatcattatttatatattcttctctacatattgttccattggctattttaaaaatattgtcttaaacttctttatcaaacctagtaggcattattatagccgattaggcatgtttagggtcttttgttcattgatctatccagtcaatagccgatttggtctaactacatggattgagaccgatacgttat

SEQ ID NO: 79581 - DNA, 1349 bp, Oryza sativa
atgagtgatagaaatcatggcagcaagtatcattattgtgatcacattctgcatggagaaatgtattttttccaagaatataagcccattcctctgctagtaaagttcccatgtcaacctattttactttaaaaccaaagaaactgtaaataaaaaaacgagatagagatttgcaattcactgggtacaaaagttagatgcacttctttaacattttagcagattgcttccaacatatgacatcaacttcccagtcagttggttattttacaatcttgaaaagcaatatttttctatcagtccaactaatttgagaaaaaaaattctgaatgagatatgtcaagagcagttgtgaggctgaattgttcagggatgtatggaaagcaagcttgtgtttgacgcaacaaatatgtgtatatgtaagattgatggagtatggattctgagcgatagcagtagacaattcaatcaatattttatcacctaaagatcatgcatagtattttgacgaaacaacggcagatgtgcaccttcaagatgaagctttactgacgatccaagtcgttgagggggtctaagatccagaatccataaacactctccagaacacatgcattgcaggtgaggagccggacgggacatttcgccgagcaccccgcgttcattgtactctgaggaaaagcggcaagcgctggatgatgggttttgtttcagaatgcatgatgaatccggatgaacctccacgatgccaagttccggactggtcacctgctgatgaactgcatgatgagttttgttcaactactcacctctcacgggattcacctgctgctcccccaccggcaaggaactccatagctgcagctcacccctgcgatgcagaggggattggtggagacaggcgatgcagaggacggcgcggtggctacctagcgacgggagcacctcgtgcggcggggatcggtggagcagaacggcggcgacgacctggcgacgggaggacctcgtgcagcggggaggcggaggatcgtggagggcgagccggcggcggggatcggtggcagacatgcgatgcagaggacggcgcggcggctgatacggagcggagcactgatggcggaggtgcaggagcggaattccggcggagggcgaaggtgcaggtgtggtgggagagcgatagggagggggggggggcggtgcgggtcgtccgctgattgagggaggtggaggtgggatcgattctgacccgttcggatttaacgcggatgatcccccccgttgaatgatgaatgtaagagtgtaagagtaaaagatgagtaaaacgagttggtgaattatagggctgcagg

SEQ ID NO: 79582 - DNA, 6746 bp, Oryza sativa
  unsure (1)..(6746): unsure at all n locations
ttcctgcaccccggcaattgctatttgtctacctgcacctcaatgggaaaaaaaaatgcagttttaccccttgctcgattgctcctgcttttttagtgatttcacttcagtgcctgttcgattgataagttcatactaatctgtgcagataattagatatatccaagttctgtttctacttggatggttctatcatgtaggatatgctcagctgaatttgtgagatgagcacagagacttttgagttagcattttgtttgtgtgcttgtacatggtttgcccattgatgtctcaggtctaacagaatttactcactgggttgctgcattctgtctaagaatggacatgatataacaattaagagatgtctctatttttagaagacaaaattgacatgactacattcgattttgatctgcttttaacattttacgatagatgtgtttctgttgtttccaactgtttgtttgttttcttattcttttatggaaaaattctgatatattcttcattggcagtttcaggggttgctggtggtacctgactgctgagtaacaggatggttttttggccgagtaattaacaagatcgtgatgcaactactgttaattggactagtggagtccagtttcgtttgccctttctgtgttctgaaccactctggcatgtcatacaattctgaaccgctcttggcatgtcatataattctgaaccgctcttggcatgtcacataattctgaaccgctcttggcatgtcatgtaactcacctagcaatcgactagcgtactggtaggctttcttgttcatgtcacttgaatttctggaaatattgttaatctggcatgaacacgtgatcgatgtcgtggatgcctgctctcatattgcacggctgcagagtttatcctcagagcactgcatttgtgatagtggccgataagatttgaacatctctttctgcattgagcttagagtattttcagatattctacttcctgctgtgcttgattctgactgctaagcaaagcagcttgcagttaaacaattcagacatgtatctgaacttgcattggtacattacattacatggcattggctcattgctttcatcaatgcctggcaatagtggtttcatggcagcatgagctgcatcgcgcgccgggaggcacatgcttttagcttcataggatgttctggtttaccagctgcacggtggttgtagtagtagagtacttccgccagtattatcggctatagaaacaatctaagccaagccactgatttatcagttctattatgtagggaaaaaaattattctatagtctatggttgaaatggtaatataattactgtagtttattagatgataaaagattaaaaggtctgtatttactgtgctaccagttgaatctaccgtaaaaattgtccttccaagttaggccaagctaggtcctcttttagatatacgagttctttgtgttttcttaaaaaaaaaaaactgaggtcccatgtcaacatgtagaacaaattaacgagaaacaatttgctttccacgagaatcagggaaatattttgtaaatcaggattaaactattattatcaaatcctaaatcctaaatatccaacagattttgtatgttccaatggagaaggttaaaattggactgaaccatatagaacacttttcacacttctgaaggaaaaaaaatgggacaaaattggttgtatatgatgtcaaaatgatgagtaaattattgtgttcaaaattccccctctatgagtatagatcacaaacttaatgttccaattaaacgttgaaagtttcatagatttgacctttggaatatacaagttttgctgtattatgacaagaatcaattcaatatatcatgtagggtgataggtataatttcattgaagacaacacaaaattctttcattttagcacgatacaaatactcttttgtcatacaaatgtttgaaatagtttctcaaatgcgtagtataaaggaacaaatgacgtacatagatnttccttgaataataatatcataatgtcacaaacttatatgtttttaataaacttactttggtaaaaaaaatgatagtaaaagtaccaaaaagaaaagaccaactctttttttttttttgcggggaagaccaactcttattgttacattgctgggtacaaactgttttggtttaggttctacacttaacaagggtactcatatttaccgctaattatttttttaagtgcttgtaccaatctacatcaagatattcatggtaattttatcaatatcaaaatatgtcggcccggtatttcaaatgtgctcataaggataagatatgtgtgtatatgttcatagtgtgtgagtgcgcgcccattgtgagtgctacgtttgtatagtactcccttcgtcccaaaataaatataattttgtactgtttatgtccaacgtttaacctttcatcttatttgaaatttttttatgattactatttttatttttattagatgataaaacatgaatagtatttttatatgtgattcattttttaaaaaattttcataattttttcaactaagacgaacggtcaaacgctggatatgatatccatgactgcatttatcttgggacggaggtaatttcttcgtttcatattataagacattctagtatatgttaatgatatatgtgtgtctagatttattaacatctatatctatataaatgtatatgtctagattcattaacatatatatgaatgtggataatgttagaaagtcttgtaactgaatcggaggcagtaatatttaaaaaagttgatccccatttggatccgggctttaccggcacggacccgacccgacaaggcgcgacaacccgaccacatccgcattcaaagctgaagttaattcggtctctcgcgtccgccgccacacactctcactcactcactcccaactccgccatagctgcgagcgagcgagctagggtttggtctctctccatggaggcggccgggggagcagcgcgaggtttccggcgccgggtgccggagccggggtggtgggtcctgagggcggtggagaggtccctgcgccgccgcctctcccgcgccgtggccgcctggcttcccgccaccgtcgtcgtgggctgggtgaccgccgtcgccgggatcgcccccatcgtcgggcgctgggtcggcggcgaggtggggcgcgccatggaggtcgcgggcgtccacgtcgtcggcgccgggcagcacgtgttcatgctcctcgtggtccccatcgccgtgctgctaatggtgatgcagctgcgtctgcttgctgggccttctgatgggaggcagggggatggtatgccgcaaaaactaaaaaaaatttcttctcctatttttatgtattttgtttctctatttttgttgtttgactccctcagagctgagtaatatatataggaggcatcgtgtttaattatcctgatctttcaattccatttcagatgatgctttgattcctaccgttgttcatatgtgttagaatcaagaatgcatatatgtcgaccatagtccatagcagtgtttgaaatatcggttcgacatttcggagcacccccaaacccaaccccacccaccaacccaccaattaatggaactatttcgtccgaaaatttattttatttttaatttagtcaaaatttgttcaaatttcgttcgaaattttctcggaaatttctgtgcgccccagtgtaaatagcagatagtaattcttttctactcaatagtcagtcacgacatgtccccaaactttgttgctgtgttcatcctagatttagaggctggggatgtgatcatcttccttgtcattaaacaagaaagtcaccacgtcttctcagagccaattgcagcaaattctgaagttccatacataatctaaattttacttgcacatgatatagcagctttacgcttttacaaatcatgtgcttctggtttttgctgtattttttgaggtaccatggaacagcacttggcatcttttacatttgtaatcttagtggtgtttactgtgtggtggtcagagttcaagatcccagcagtgactggctggtcactggtcctaagccagtcggctggttaccattataccagccagaataatttggattcaaattttaaatttaattttgacattatgtcaagttgattttttccatacaaggttatttgttgttacattccaatatatagggaagaaagatgaaaatatatattgtaaaattgtatctattattaaagtagtttgtgaaggactatataacagattacagacttacagttatgatgcatatccctttatgcgattcccttatgatcattttgacataatgtgatccattaatatattatgtatattggatatacaaaaaattgcattctgtcacgccaaaattctctggccattaattaccggtaactagtttttgaatagtatttttgggggtagtggtatttttagtgaaaccaaattcaaaattttggttgcggttcggacagcagtaataaccatcagctatttggatcgaccaaaaacctttcctgcatcgttacataaatgaagtttgcaatatttgtttcttattaattatgtgttagaatgttctagagcctatgtattgtaaactaattctcttccatgcctactcaattatttgcatgtcatggtggttacaatagctggtaagaacaattgctacaatggaattatccatcctggagcaccatcgtgaacgcagaggaaaatggaatcagctggctcaagaaatcgtgttcccactcagcattagcttcgtcctcctaggagttgcgatgattggcttgatgatcactggattttcaccagaaaaagaatttagcagaaagaatattggctggatacttgctgatgttggatttttgggttggcatgctctagtaggattttttctacttccaaaagtgatcctcacacttcgggtacgttcctagagtgcaggtgtggccgctggggtagcatgccggtacaaggtacatccctcttcactgtacatcttaactggtaatagtgtttctgtgatgccctatgttatccttcgttatatggctgtacctgatttatatcgtgcttgtactctttgtggaaagaaaagaaactttgatttgcaagacctacatcctaggtctccgtgttccatcatctggtttatgttcttcatgtagcattcagatcaaatgaccctatgaaattatgttgatactaaaacatattatgggtaatgtaggcgacatccctattttcctccggatctcttaattaccattgcttagctttcagttcgcctctgaccatcaaattaaatgtgaataactaacttgatcctacctttgcttgtttgtcttccaacacaaatattgtagttattagtaggcacatttttcttgaagtgggctatgagttatgtttgttcattagtcatacattctcgctctcctgctttttattctccttgcttaatactatattgttgcattttatgtctggtacaaaatacaggctccaaccttagacttgtaatatgtctttaatgtggaattttagatgcctctataataaatgaacatgcatttggctataccctgtttgtaggcatgttatcatttcatttggtcagaattagacgtgtgtacctgaaaatcaaatcagatcactatttgttattattaagttgcatgcaccgaccagctcaacccaaaagcctaagctgataggaaaaggcgggcaattcactttatacactccaacactccccctcacgcgagaccccctcaagtctcaagcgtggaatattggagtgggctgcaattattttatttnnnnnnnnnnnnnnnnnnnnnnnnnnnnnnnnnnnnnnnnnntgataccatattaagttgtatgcaccgaccagttcaacccaaaagcctaagctgatagggaaggcggacaattcactttatacacttcaacagttattttgtttggtagatgttcagagtatttgttacccatctggtacaaattaaatattacatcttttatctgttattagtctggtatatatctgagtaataactatctagcagaagcaaatttgatggagttttgatggcacatgcctagaacatgaacaaacgtaatggatattctgcctcctaactttctaatactatgtcatcgatcaagcaagtatctagactcttaagacttcaaataagatgattgtatattactctgtttctgttctattgatgtctctggcactccttgaactttcttttcaacaattcacgcaaggaaaagctactgacatatgtcacaatgattattgcagttttgggaacctggaaattattggagaatactgtgacaaattcacttccggaatctgcaagctatcgtattaagtgcatgatatcttgcctgttttcttcacgatgactatgatactatgaacaatatttggaattaattaccaggcgtgatgcttatttattttaggtgttgctttgagttagcgtgtctccactctccagcagtcaaacaaaaaagcattgaatgaatgacgttcgtattttcaatcaggcatgttttgtgattgaactaatagttcatatgctgatatggttgatttttgatggacctttgggaaagtgattt

SEQ ID NO: 79583 - DNA, 6855 bp, Oryza sativa
catatgaatttggactatggacacatatgaagcacatgtatgaatctattcaaaatccaaaatgtcttgtagtgtgaaacataggtagtagttggtgcttaaaaactgcttaattacgtgttcccattgtggataatcagttgctaaaaattccatgtttgcatttgttgaaaacggatggattctaggatttatggatgcaatacctctttaattagaccttttttagcaccatgcatggttcatgtagcatggatttggtttatttgcattacttggtatagttatgcttcaaactttgtggacaaaacatgaggtaggctacacttgcacaacgttgggccaatttgttccagcttcggcttgtaaaccatcctaaatatacttatattttaggaacctacgtagggagtataatatttttcacgcttctaaagaaaaaggacaagattggttgcatattatggtgttcaaaatcaaatcctactatccgctttttggccctatatatgcgtaggtcagacaaacctaattaaggtcacaattaaatgttcaaagttttatccatttggccctcctggtatattttgccgtattttgacaagagtaaatttaatttccgtaggttttgcaaaaaaaaaaaggggggtagggtggtatagaaatcattgcttccaaaattattcaaaatttgttcattctggtagaatacaaattggtactgctatgtccatctttaaaaaaaatgatttgtacaaacagaagactaattaagttggaggaaacaacaccaatatacccctcattaacaggtaagcggtgttgaagtgatcatcttattttactacaacctccgttgaaaaagacaagatagatgctttagatcaaataagataccaaaaggctatcataccctcccttagtatagagagagagcgagcagaagggactactaatgttgaagtagtgattagaaggctaaaatgagaagaataagataaagtgatattaagagttcgagtgtacctacagctaaagagacattctttttttatggagactggagagagtactaccttaccacctactaccattgtggagggagggtagataaggggcttcaaatcaactctttgtgataaatttccaacaccaaaaataattcattttggagtacatcaagctcgtgcatctagcctaaactctcaaagtattgagatcctctaacttacaacatctataaaagaatggtcaaatggctctccaacgatctctccatctagctggccaaaccccacgactcactggttaaacttggagagccattttgccttgccaaccatgggtcgcaccacccctccaccccgccccgcctcgctcacccccccccccccaaaaaaaaatcactcgagaccatggtggcagcagtattgcggtatatttctgactcttcctgcgctggtattattcgctgttgcccgtcatttagagctttagccatcaacagtgacggacacaggattaaaataaagatggggcgaagatgctcgtctcaataagaacaactaaatgaaaaaataccatatttatgttgtaatcatataaacatatagtataatcaataaattaaggcaaacaaaaaacaaaaatgatattaaaataaagtaataatttttgctccatacataattcatcatacataaaaagatactagtaaacatatcaatttgcaaatatgagtcaattcataaagcatggttaatagatatcttttaaaaaataaatatatgagaagatatcgcatacctagaataagatgattattattttgcttagaaaggagagagagagaaaaacattaggcacctaactatagtaggggacgggggtgagcagtgtcgaggaattgactgaggaaagcatcacatatgcaggattaaaattggacacttgagctgtttatttatgggccaattgtgaattggatgtggtggtaagcggcccaaaaaggatatggaggtttggggcggcccgggccgtatctgggccggccgcccaacctcgcctaatgggtggtaccgcccctggccaccaaccctctttatggtattataaagggtttatttacaagcgtttgttaaattataaagggtctactctcgtggcatcgcaatgtctctaagctttttttttccgctgggcaccaagctctggtttcctcttgattttagctatcaaaacggtaggtgtcgaagcgaatcagtgaaaatcatagttaaagctaaatatggaaattaggttgctgttaaatccagtttaacctaaacggcaactaattgaacatatctggaacaaagcgatacaaaattgattttgtaataggttgaaaaaaatgactaacagatgattataagcggtaacgtttattagcaataaagaatagtttatgcataaaaagattttatataatgttgaaaaaaaaaccacaataaaaaagcatcaaaatcatctaaaattaagatttaaaatttaaattccgactaaggctaataagctaaagaacaaacgatgaagctggaggtgaatgttgtttggtgtggagttgttgctcgtgctgaatctccattctggatccaacggccgaaaatctcacaaaggtgataatctttttgctaatgagatgataatccttttttagagagaagttgataatctttttggcttcccaaaacagtacagttgcgttgaactatactctctccgtactcgtaaaaaaagtcgtttaggacaaagtttaagtcaaatctttagaatataaataataaataactaatacaaaaattatattaatagatttgtcttgaaaaatactttcataaaagtatacatatatcacttttcaataaatatttttatagaaacaaaaaatcaaagttatattttgaagaccgtgtggctgttctaaacgatttcctttacgagtgggggagtatgtgcagctaatgtttgaacgcccatttggatcggagctcacagggcagcccgcaccggcaccgtcttgctccggtacgaacccgacccgatagcccgacactctccccgcgtccaaagctgaaattaataaactcgttctcgcgtccgcctccagccaccccactctctcccactccacgagcgctgcaagcgagagcgagagctcgagctccgcggaagctagggtttcccattccatggagttcaccggatcatcagcggcggcggcgcgggggtggcgccgtcaggtgatgtcggggaaggtggcgtgggcacggagggcgctggcggcggcggcggcggcggggagggccctgcccgccgtcaccctcggcgtgggctgggtgaccgccgccgcgggagtcctccccgccatcgccgggcgctgggtcggcggcgaggcggggctcgccatggagcgcggcggcttcgccgtcctcgaggccggccagttcgcgttcgcgctcctcgtgttccccaccgtcgtgccgcagctgttggccatggcgatggagaggctgcgcgatgctgggcctccgaccctgatggaagacagggagatggtatgccgcgaggatcgtttatgcgttctctttcaagtttttcgtgcttttgcgtgtatcctaaaatattctgtttgaactccctccaaatttagtttgcccagagctgatcagtgtttgcgattttggttcgaaattcccaaaattttggacccccggaacaaaactatttcgcccaaaagttacaacaaaaagaacaattttctgttaatttggtcaagttttatccaaattcagccaaaatttgttcaaatttgaaagaaattcgttggcatatctgaaatctcggaaatttgactacccctggcacaaatgttcaaaaggaaattgcaaagcatggagctgaggaatgcatgtgtcgtgtttaatcatccagatatgtcaattgcatttcagaagatgccttgcttgagaatactactgtttcatactttcatagtccatggcagataattcctttgggctgatgtctccaaacttatttgtggctggttcattatagatgtagaggctggggatgtgatcatcttccttattataaaaaaaaaatcaccacgtctttacagagccaattgcagcaagttctggaatttcatacataattgagttttacttgcacatgacatagcagctttacgccttaatgatgtggaatgacgtgcccctgttttttgctgtttactgctgttctcttggaacgatacttggcatcctttgacgtccttcaacgtttgtagtctcaatgatgttttaatgtgtggtggtctgagttcaagatcctagcagtgactggccggtcactgcttctaagccggttggctggttaccattatacaagccgggataattcaaatttaaaatttagttttgacattatgtcaagtcaatcttctcagatgagtttatttgttgttacacacttacattccaataggaaaagaatgaaaaaaagggacatgttccattttgaaactgtatttattcttacagtaatttgtgctggactatatcagattatatttatgatgtgtatcccttcatgtgattgccttatgatcattttgatctattttttttatcttctaatgtattatgtatgtcggatattttgaaaatttgtgctttagtcatgccaaaaaattccggttggtgttgtctggtaacttagcttttttgaataacttttttttgggaatagtggtatttttggtgaaaccaatgttcaaagtcttggttgtgtataaacattagctgattggatgggccaaaacctttccctgtaccgatatataaatgaagtttgaaataattgtttcttattatgtgttacatatgttccagtcttccagagccatatatatatgttaactaattatcgtccattttccctactcgaattatttgcatgtgatggtgatcgtagctggtaagcacaaatgcagcaatggaattgccaccggagcagcatcctgaatgcagagtaaaatggaaccagatcattaaagaaatcgagttcccatgcaaaattggtttcgttcttctagggtttgggatgattggcagtctgatcattggattttcaccagaaaacgaatttagcagacagagtattggctggatacttgctgatgttggattatttggttggcatgctttatcagtattctttctacttccaaaagtgatccgcgcagtttggatacattcctagattggaagtgtggctgctgaggtagcattatattctggtacaaggtacgtttctcttcactgcacatcttaactagtactggtaacgttgttattgtcatgccctatatatgttatcctctgttatgtgactgtacctttttttaatgatatatcgtgcttatactctttgtgcaaagaaaaaaaaactttgatctgcaaaaactttacattgtactaacttgatccttcctttgcctgattgtctgttagcgcaaaatttgtagttcgtaggtgcattttttgcttggagtgggctacaagttatttttgttcatcagtcataattaaagtatcaactttcctgctatttatctacccttgctcaatattatattgttgtacttactttatatctggtacaaaacacagggtccaacattagacttgtgatattagtctttaacgtggaatcttagatcctcagtaataaatgaacatgcatgtttggaaagcttgttatatcactttatttagtcagattacactggatgtgtatttgaaaatcggagtatttgtttggtagatatttagagtagttatggacttatggtccatggtataaatattacctcatttaatttatctgttatcaattgaataaatactgccttctctacttaatattcttttgtcgctgggtcataattggcattggcagaatcaaatttttgacggaattctgatggcacatgcctagaagattacaaatgtaatgaatattcatctgcctcctaatttcctagtagttcttagttatggcccatcgatcaatttaagcaagtatctagatttgaataggatgattgtaatataattttgccttctgatctgactattggaaatttggatgtttggcacacacacttaacttttttttttgacaataccttcaaggaaatgctactgacattacttcgatgattgcagttttggggacctaggagttattggagcatactgtgacaaatccacttcccgggatctgcgagctattggattacatgcatgatatctcgccctttttctttatgattcctatgatactatgaacaatgtttggaattaattaccagatgcgatgcttatttattttaggtgttgctttgagttagcgtttctcctgcggttaaaaacgaaaacattgaatgaatgagtcgcgttcgtattttaaattcaggcatgttttgtattgaactaggtgatctgtttatgtactggcatggttgatacttgatggaccttcggggaagtgatttgtgtctgggtttcttctgctacaatatttctgtgataactgcagtttgtagtatatctgggttttggtccctgttggtaactagaggtgactctagttaatgtatcatactacaaccgcgagttttcagagttaacagacaggtcccatgcatgtgtattaggccacaaccgtcacacaaactttggacttgatactgtagctgcaacaagtgatttgctcctgatattttttttcacctcatgcatggtt

SEQ ID NO: 79584 - DNA, 868 bp, Oryza sativa
cacgttgtcggcggcgtaggcagcggatttgagctccacgatgaggctgcgcagggagtcgttgtggggggcgttgcgccgccgcctgcctcgagcatggcacggaccatgtggagctggttcttgccgctgaggaagtcgccgtgcaggcccgagcgagcagcccactgctcgagcttggagccgtagtacttgtcgaagacgacctgcaagaacccaccaacgacgcccgcggcggccgcaacatccatcgctgccgctgcgaatgactgcaaacaaacagcggaggtgacgaggtcgataggtagcaaattttgcagagttcttccagcttgctagttcagtttgcggtggttagctttaggtgaggtagtgtgtttgttacattttgtagttttattagtccgatttactccctccgttccaaaatataacaaattttatctcttagaatttattctaaaatataacttctctaccaatattttcttctaactaattacaaccctccgtcattcatttttctcacctatctccactacttatccgatcacaaccctacatcattcacttctaactattttcttaataactgtgtccaactttaaaatttttatattctgtaatggagggagtaattaattaattaattgggtccggtttgatcttgattccactaaatgaaggcatttcctctttcttcgcaatataatactggtaatctgtcgtaatctttgaagaaagggagcaacaaaacaaacacaccagtacactactgattgttattctgaagtagtattattggtgcttaagggcccctttgaatcacaggaatgaagaaaacggaggaataggaaaaacataggat

SEQ ID NO: 79585 - DNA, 882 bp, Oryza sativa
tatgttatagatatcgtaaaacatatgataggatttaatcatttgttttgaaagccttcatagaaaatttttctatagaattgaaatccttcgaaaccgctatgttttttctacaaatcaaaagcgaagatacgttttcacaggggaggttatgttggcgtttttctcccttcaattgtagaaacttcaaacaaagttagggcgttaattaaccgtgccaatgccggtcagcgactgctcctactagcagttgcaccaacgtatatactgggtccaggtatatttgagctaagctggcggtataataataacaaacatagttagagaaagctatcgtataaacttacagatatctccacatgggagccgtgcagccagctaggtaattaatctgcagaaagcactaattaatcctagcatatcatctcgcatgatcatcgatgcatgcatagagatatctcaaggcacacgtactccactaatccactctataaatagcgaagcacgtaccacgaatccctcagctcgtaccagtcgtcgtcctaagcaagaagaagctaagctagctagctgtgatcggagaggtatacagtgatcagtttgattgtgaatttgtgatcgccatggctgcagcttcgtctactacgactcgtttttgccttctccttgcgctcgtcctgccgatgatttcctccgccgccgccggcgacgacgcgctgccgctgcccatgacaccgtcgtactaccgcaagtcgtgcccaacactcgaggccatcgtgcgcggcaccatgctcagtgccatcaaagccgagcgccggatgggcgcctccatcctccgcctcttcttccacgactgcttcgtccaggtagatgatcctagct

SEQ ID NO: 79586 - DNA, 1693 bp, Oryza sativa
cgtatgacaggtaggactagatattaatagtgtagtatgtaaatattgtatgaataagctcttaaattggctatagatgaattggaggactatgctattaaacttgctctaatacaaaagcactcagctactgaagaaaaacaattccactcgcttcctcacctagccctctctccacgatacgtccagtccagccatacgattcgatcgatcgccatgggaaagctcaccgacgtgacacgctccaacgacatccagctcaagatcgtgggccactccttgacaatggccatggacgacggcgagttcttcagttccaggcggtattgcgtcggcggacacgactgggagatccgcctgcggccgaaggatccctgggttggcaggcgcgaccggccgctcacgctcaagctcgtcctgcgcggcgcgccccgcacaggcagcggcagtgtgaaggcccagctaagctgctgcttggtagatccgacgcagaagctgaggccgtcggagatgaagaccgtgtcgcataagttccacaagcccggtgactactcgccccgtgccgtgttcatggcaagggacgagctggaggcgtcgggctatctcacagacgattcctacgtcgttcagtgcgccatcaccgtgctccgagaacagccggagatagccgcggcggcggcagcggcgggcgacagcgcgaatgcagccgtggcgccgtcgtccgagttgcacgcgtaccttggcgccctcctggagagcaagaccggcgccgaccgacgttcgtcgtgtccggcgagtcgttcgccgcgcacaaggctatactggcctcgaggtcgccggttttcatggccgagctgttcggggcgatgaaggtgaaggcctcggagcgcgtcgaggtcaaggacatggaggcgccggtcttcaaagccattcttcacttcgtctacactgacaccgttccagagctcgaccaccgtgatggcgaggagacggaggcagcgtcgacggcgacggcgatggcgcagcatctgctcgccggcgccgacaggtacgggctggagaggctcaagctcatctgcgagagcaagctcgccgagcgcatcgacgtcgacacggtgtcgaccacgttggcgttggcggagcagcacgactgctcgcatctgaaggccaagtgcgtcgagttcattgctgccggcacggctgaaaaccttgatgctgtgttggccactgatgggttcaaacatctggaggcgagctgtccctcggtgttgactgaccttgtcaaggttgcccgtggaagaaagaattaaaatgcaggtacgtgcgtatcagagatgtcatagctgaactgttctattgtgaaattttctctaggatttggcaatgcatcatctctgtttgtgctagaagttttgattgattcttcccagtcatgagtagtgcatactttgtacaagcccattatttgtcactactcactagtactagctagtattaccttggtcattcttgtatttttctcacgtgttagtacaatactactactgcactgcagaaatatgcttctgcgtttcaagcctttcaggctatgagaacatgcctgttgccactagtaatcagtacgtttatttttcagaaacatttctttaagcaggagaaccccttttttttttttcagaatcatcactagctt

SEQ ID NO: 79587 - DNA, 9384 bp, Oryza sativa
ccccgtccccatggccgccgccgtcatcgtggaggtccttgcgggcgggcgcctcgtcgcggctctcccgccgccgccgccggaatctgagttgctgccgacgcgagacgtcatcgcttcgtttcccccaccgccgccgctgcagtctcccgtgcggaaggccgtcgcggccgtcctggcgcgcagccgtctcgccgcggcggccgccgacgcgctcatgtacctgtggatcgcgggcctgtggcctgtgggtcgccagtgcggccatggccgcctcgcacgtcgcggtccgcgtccaaggcgagggctcccgcgcgaacgccgtggcgttgcaggtctccctcgccgccagtctcgtcgtcctgccggtcgtccccgtcgcgttgtcgctgcacgccatccgcatcgccgtctccggcaccggcgaagacaccgagccagacaaggtactacgactttcctcaaaaagaaaaaaaaatgcttctacctttgggtccattttcgtgtgtgcactggtgcggattaattactgcatttgcatcaattacctctactcctgtgaacgaggttctatatctagggtaccaatagaagcgaaattgctggaaatttcttgccaaaaaaagttcagattcaaacaaaatttggttaaatttaaaatctgaataaaatttgttttgttcaagacaaagaacgaaaaatttcggtaatttgattccgaattatggaaccctgcatataagctgcacctgttatcatgcacttcttgccgcgctgttctaaattttgatttttgttgtgtatgtcgtgggtgcccacgttgccaatttcaagcctgctccggagagctttgcagcatcagtgagggcatcgttcagtcaccccatcctagctgcatccgccgctataacgcctttcgccgtgctggtgcctgttggcaatctggtgaaggggatctcagctgccagtggatcacgcggggagagaatcggttctgcgatcgaggttgtggggctcgtcggcttttacccgatgttcctcttcttctttcttcccactgctgcgtggatggtgtggaggagggtcaagctacctgcaggccatggccagcgtgttgctccggtgtagccaagctgccgaggttatataattaacctcccttctcgtttgattcatcgcgtgtgtctctaatttctgtgaataattttcctttttactcatgtttattaagtgttctctgtattcatagtccactgctgacagcaatagcatttaattgactcctcaagtttcatggtcattctttaattttttttaactctaggatgacttgatgagcatattggcatggttaacatgaacagatttttgaactaggaaatccagtgtcgatcctacctgctgaattaggcaaaacccattatcatcataaaaagatatatatagctagtttcaatgtatttgtgactgtgagtttgaagaattatgctgtttactctcaaatctgaatgtctagctgtctggtatgctccatcatgtcttgaggttcattgaaatacatcctcttgtcaagtcaggtgaaattgatactgtaggttagttactgttgtctatatagaaggatgtttcattgataatctgcacccgtatatctgtaactgggcaggttattggtctacttgctgaaattccttcaagtttacaaattttctactttggttgccaaacatttattatccatcaatcttattaaatttgagctattctattaacaaacaggcttcaagagaagtgctgtgaagatggacaaggacctagaagatgactcttgctgatggttaattacgagcttacggctgattccaacagataaaagttttgagaactatggctcatatttgctgatttctagtacactgcacctacgaactttattttgtcactatatatgagtttaattctagtaatacagtaggatatgtgccacgagctctgcctctgacaatttcgtagtggtagtacagattaattggaatcagattttacatttgtgctgttcaatataatctggtcttgctttctcgattaaaagtcaagctgtgtgtgttgttctctcatgatagagtgagattttgctatctatgagcacgcatgcatccttctagttccaaaaagtatgattcatgttttagggattacctagtgaattcgatatatagtcacttcgtggatttcacattgttgtagtacgttttcttagttacataatcccccccctttttattttttgaatcgctacatgtagtggctaatggcaggaatgtctgttccattatttagaaaatgtttcctcctgttgatcagaacattgctatgaaattatttgcattttattggtgaatcatcatcttttatcagtgcatcgatcaagacgcctacgctagagatacctcaccagagcaccattagagtgatgatgttgccctttttttacatgacaaagtaatgcttggatggctcttctgcatgcctttcatttttctcatgcttgtgggggttctgatggagggatctcggagtgaaaggattggctctatatttccggatgttggatccttgggcaactctgtgctgtattgcttcctcatctcacctgctttaatcctgcagacctggaggatgaaataggtagtggtggcatagttgaggtatctgtcctttactttggctttctcattgtttatcttccatataatctctttattttacgagcattatatatatattgttatcctactgattatggttactagctctgttgagtaacaatgtgcagagaattcctccacttttgcaatcctttgtccttctactggtaatcaggaaataagaactcatcgcggttccttaaaattgcaaataatggttctacttggtaaaatgtgctcagttgtagtcttgagctatttatatgctggccctattatgaatatacaaaaatttgggcagtgctattccattgcattgaagcccaaccaaacaaggccgaaaggacatttcgttcatagatatcctgatatccactagtgctcactcaagtgatatgttatacaggttatctaacaagttggctattttactaacgaagaggagagaagtgctacaagaagctatgtgtagtccattcacatttctgaaggttaatcactcatccggccatcccaacacatatcgaacttgcgacagaagatgtttctttttacagagtcgctgcttcttcgatgcctagtaatacatcttaattctcttaagggccctattctgtgaactgttactatatatatatgccccatcactaattgttctagtgattatacttagtactcacgaatcacgatgcatattatcttttgatattctgctgtatggtgtacatactgtgcttggaggggggctaatgactcataattacatgactgtatatatgtcaatatgcttattattatccttttctaggaaggcatatctcttgagctgaaatggatttggcattatgatttatgaacatgtagcagtccatctcacatctatttatcttcagtgaagctttggtgtgatctctaaggttatttattatgtctgctgaatgcttgcttctctttcttttcccgttggttgggctgctgctacatacttgatcaacattgcttgctattcgactagtactgggccagactgcattgggcctccacatggtgatagtagaaaggaggaagatagaagaaagaagagtggtgatgtagaagaggacggagtaagtcactgacaggtgggacccacatatgactcagcaagtcaatgagggtcaaaaccgacatgtcagccgaaaccgcctcccaaaccattatactcaggttttaaagatgggggaaggcattatacccggttttgccgttgagggatgcgattcaactagacgtaagagttgagggatgcaaaatagacctattcctttctgtggaccgctcatagtttacaggctagcccggtccaggtgattttgccacccatctagtctagattgattcatcaaagtagggtagttatcttccactagtagctaataagctaattacgcgagctccacccaacataagtacggattcggattcagtgacattgctatggcatggcacggtgtgacattggagtgatctggagcgttcaaaacaaatccaacggtccgctacgtcggcccacctgcagcctccgttttcacccaaatctctgtttcctctgccgcccgacgcccaaatctcgcggctcgccccaatcctgcgcgcacgcccggtaccgcggaggtcccaatcccgcaccggagtagagctgctggcggagttccaatcccgcggaggtcccaatcccgcttggagtagggctgccggcgccgggaagtgcagcacgccaaccgccgaggccggggccggggcgcctgccctgccgtcgccaccagataggcgggaggtaggggggcccctcgccgtgattggggaggcaggccggccgccgcgaggccgggggccgaggcccctgccctgccaccggagcaccaagattttggggaggagggctgccagagcgagccgagcatctgcagaggtggattgcaagtgagtgtttctaagttttattctttaggataacttggagagcaactgaattgcacaatttggtttaatggatcttagtcttaaatggagcaaatattgaatgctaaattccagttattggatgtttgtgtttaggcaaatgttactatctgtatgtgttgaaaaatgttgagcagacctactatcagataattgtcccccctaagtgtgaatcatttttatatcagaatgttgtggttgagataatgaaagagcataatagtgccgccataatgaaatatatgttccgattattatagtttggaatttttttttcagaaatttgagtacagggctattcattgttgtggaaggcaatggcagaagttgatacaaagttacttgaagttggtttgaggttcaaaaatccatataagggttggttattttgggtggcatatggcggccgtactggctttgatgtgaggaaaagatgcacaaatgtaagcaaaatggatggtaagggacttcatgcagatatgtttgtttcaatgagggtcatcgaacaaaaaggcaaacggaacatgtgacaaggtgttttagagctgatacaagaactgattgcaaagctcagatggttatttcattggatcgaggtgcaggaaattatgaagtcattgatgtgcttgaacacaaccacccactccacttgccagagaccttccacttgatgaaatcacaacgcaaaatttcaaaactccaagcttttgaaatagaaacagctgatgattctagtattaggccaaaagctgcccatgagttggccactcgtcaagttggtggaccacttaaccttagctacagttgccgtgaccgccaaaattatttgcaaagcagacgtcaaagggaattggcttttggacaggtaggaagtatgttgaagtattttcatgataaaattgttgagaacccatctttccaatatgctttgcagctggattgtgaggagcacattaccaacatattctgggctaacgcaaagatgatccttgactatgcacactttggtgatgttgtcacatttgacacaacttttgggacaaacaaagaatataggccatttggtgtttttcttgggctcaatcagtttagagaaaccactatttttggtgctgcacttctatttgatgaaacagaagcatcatttacatggttgtttgagacttttctagctgcacataatgggaagcaacctaaaactatttgcatagattaagatgcagctatgggaaaagccataaagatagtattcacagaatcatatcatggtctctgcacctttcacataatgcagaatgctgtgaagcatttatctccagtgaaaggtaaagaggatgatgaaggtgaagaggaagacgaaggtgaagaggaatcgcatgttcgcttgtatgtttggccacgaagatgaggcatcatttgaagaggcatttgagattatgagatccaaagttcataagcaaacatagttagatagcatttacaaggtgaaagagaaatgggctgaatgttatatgagagatgtcttcagtttaggagtgcgaagtacacagctaagtgagagcttcaacaatgcattgaagaaccatttgaaatcagattttgatatcattcgatttcttaagcattttgagaggtcagttcaagacaaaagagataaggaactacaatctgaatttgaggcaaggaagaagctacctagaagactaatgtgcacaccgatgttggttcgagctaaccaagtgtacactccagtgatttttgaagctttccaaagcgaatatgaaagatccatggctgcgtgcgctagagttttggatggagaacacagatatgctgttgtagttgggaatttgcttggtgaggtaagttcagaggtggaggagtacacagtgatcggtgatcctctaaaccaaaaaacttcatgtagttgtagaatgtttgaaaggataggaattttatgtgcacatggtctgaaagttcttgatctaatgaatataaaaaaattgccaccacattacatcataaagagatggactagagaggcatgtaatgaaaatatacaagataggcaaggaaggaatgtggtagcaaatccaaaattggaagctcaactacggtacaagattatgtctcataagtttcacactttggcacataaagtagctcactctccagaatgttgtgtagtgttagaaaatgcacttgattgcctttgtacacagctagaggagaaactcaatttactatctgctggtggtacacatgagccctacgaggacaaagaaaatattgacccaaacgcgcaacatggagatgatttgcttagtgctacacaactaaacaagaaggaggttcagtcaaacaagtcaaggagaattagaacttggattgataagctacgcaaggggaagcgcaacaatcctaaatctgcaaaaccaacaaaaaagggagtaaaggtatatcatatgcaagctgctcatctttgtatgttgatgtaaaaaattgcttaactaattaattgacttttcattggcaaaaacaaaagaaaaatgatgctttacagccacaggtacaagttaaggatgatggcagccacaaagaaagagacgtggagcttcaacaatacaatatcattagcgattttacccaccttgtgacagcaccaagttgtgatgatgatattctctgtgatcaagatctgttctaatctttgcaagatggttagatggcttgtggacagcatggttatatggcttttgtacaggatagtttgatgtttttggacaggaatggttagatgccttctcgacaggactaactatagtattttgtggtctctgtttagtattttggacagggccaacgatagtattttgtggccaaattgtacaagtgaatatggcctacccttggaatagttttctatatgctccacatactagtttgaatgacatgtacgatccaaaaacttatctcacaacattatcaacttctatatggctgtttccaactatctgtgatgtctgaatgctccaagtttcaagtttatcaacttctatatggttgtttatgtctttctgtgttgtctcaatccatccaccaattatggggacatgctgtcaattttttcagagaaacatcacagaacagcatacatgaagttactgatttattcattcattcattcaaattacagcatacatgagtcaaatcaattgtttcaggacagtgcacagctaagcctaaggcaattttggagatagagaacaaacagctaaacttcaaaacagcaattttggagaacaaacagctaaacaactgtaaaagaatctttgcatttctctaatggaaatggagggctttgccctttgctaaaaaaaaccagctaaacagctgcgaagaccattgcctccattggcaccccgacggccggccgcctccatcgccaagggtcacggtgttcgcttcgatgccactgacattagcctgattgtaagcagctagaaactggcaactcctgtcctggatttcccttcagttcaagctaaacctgaaaatgattttgtctcacaaagttcagttcagtcacttgaagcaattgcatagcccaattttcacatggtttaatctgtttgaaatgccatggatacaagataagcaagatatatttctcatttcacaaaatcaagacacaatgtacaaaaaagagatgaattatttggaatacaaattcagagatgaattatttggtactgtgttcatcagtattttcaacatatttcagacaagggcaccgtcgccccatgggcaccccgtcggccggccgcctccattgccaagggccacggtggcagggcaggcccccagcctgtcagccccggcatcgcgcggccgccgcccggtcccctccccacttgcggtggtggcggctcctagctagctccggcctggcgcggcggcggcggcctggcgcgggcgagggaggcgaagctgcgaggcagccgcccagtcccctccccactcacggcggcctagcgcctctctggcctggcgtggcggcggcggcggcctggcatgggcgagggaggcgcaactgcgaggcggccgctcggtcccctctccactcgcggcggcctggcgcctctccggcctggcgtggcggcggcctggcgcgggcgaggaaggcaggcgaagcggcgaggcggcgatgcgaccacgggggattggggcgagggaaacggagcgcttgggggggaaaacgaaccctgcaggtgggccggcgcagcggaccgttcgattagatttcaacgttccagatcgctccaatgtcacaccgtgctatgctataacgatgtcaccgaatccgaatcccagaagtactacatgtttatcgcttcattcttctccccttgtttgaggtcaaaccaaagacatccatgtcagcctctagtagttgtatcaaccatgaggcgtccaagtccaccctatggacatgcgcctaacagttcaaccgcatcaacaatgattctaatggtacaataagtggcattaaggcacattcggacccatgcataccacactggctcagattgtttgatgtacggttgataggccgacaaaaaattaaaggaagcaaccaaaactaatttatcggaaaaagtttaatatattacta

SEQ ID NO: 79588 - DNA, 8613 bp, Oryza sativa
aatatgcccctaagggcagtcccaacccatagtgtctataagcagtgtctatggtgacatgtcaattagacatcacaatagaaactacactctacaacccatggtttcttaaagtgggccattaataaatacatcatctctcttctctaccaatcatatttattctccatctattatgaagacactattctctcccaatgcaaaacttgatggtgtctagtgcataggttctagtgttgaagctgtgtcttgtatgagacccggtttcttcctctcttcactctctctcttaattaatatagtgccacgtaagctaaaagtcttacatgacaatgtagttaataccatagacactatcctagatggagggttgggactgccctaatgtaagagaaagcatggacacaagaaacacaagagatatttgcatgcaagagcatgtaaatattgctctatactttattcaatgaatggcaagctttgccgtcgttaaaaaaaaaacttgcatacaagagggggcggatcccaaaaaaatacttcctctaatcataaatatttatatttagaacataatttggttttttttaaacaaaaactgaagttactatatattttcttatagatatatacttagttcagaaaatgatgtatttgtttcttgaaaatgacaatcattatatcgtaaacctatatagattttatgaacttgtttttctaataaaacatttatgcttaatgtttggcactactaattaggaacaaagtgcatgcgcacctgatttatcctctctagttgcaactgcaataggctcggttctggcttgcggtctttcagaatatgtgtaatcttcatctccgttagaccaactgcaatcagatacatcgttagcacagtatttactaacgatattgttgtttattgtttgcagtaattagcttaaatttgtaataacaataatgaacaacacaagtggtatgtgtttctagaatatacttgataggtgttgctataacatcaacatatttaccttgatatgtaattaacaatattatgatcatagattataatttactatgctttcacgcgatcacttgtgtctttgttaaatttttaaatgtgtcatttactaatctgaattaaacaatattatcgatacagcaaataattaaccatgattatatcgaccttgtaaaatgtattatgaagcttatatacttatgtgttgaggcaaattaatttacttatagaagatatatatactacatacacgcatatcatcgccatatgaaatttataatgcatgtgttatattaaattcaaatttactactccccgtttcaattgtcattttagcaaatctcatactaaactaagaggtgtgacaaattatattgatacactcattagttacgttcaagtcatctttcccaaagcatacattaaaattgcttgtgaggactactactgtggttgtattgataaaaagtacaaaagaaaagacatctctagaacacaaaattcctaacgatttttgagtaaatatgtactccatccgtcccatcgaaaaccaacctagtatcagatgtgacacatcctaatactatgaatctgtacatatctctgtctatattcgtagtacttgctaaaataattctaagttgattttttatgtgacggaaggagtatagtgtaataaatagaccaaaatcgaagtgcgtacctcaatcccaaaatataataacttaaattttagctatatacctagacaagcatgtgtctacatatatatagacaaaaaattatattgttatatttttgaaacggtgagagtattttttttcttgtttagaggaccctagaataaaagatatatgtaggtgtgaatgtgtaaaagtggcatgataatttgtcagctctagaagacaaaacgcgtgttgggatttttatatagctataggggaatgtgtacgaactcgtcattttggtattttcaattattcataatggttgacttcaagtcttcgacgacgtatccaaaaaaataaaaagtgctagataatgatgcgatcgactgaccgtgatgctcgtgccgaacgattggacggggagctccgcaaattctgaacatatgatataccatcatatagtacatacatgtgtgagaaaataatgagagagagagagagagagtatggtatagtaaattgggggtaatggtatatcgatcgatcgtatctacgtacctgcgtgtgaggtgctgagtcaagacgccgggagaagacgctggtggtgtagatgcaggtgatgacggggaagagctggagcctggaggtagaagtcgatcttctccttgatgcgctggaactgctcggcgatcttggcgccgcggaagaagcggcggaagtagctgctggcctcgcaggaggagacgagcacgacggcctcccggagcgtcccctccagcttctccagcggggcggcgatccgcgggtcgtccctctccacgtgatgcaggagccccccgaccgtttccacgtgctccgccagctgccggcactcgtacttgttgcgccgcaccttctccgcccgctccgtcaccatgctgatcagaccgtaggcgtccacgccggcgatctgggccacagtcgccaccgggtccacactgctccatatcggcatcgtctaggtaagctagtagctctccctcaccggacaccaccctctcaagctctcatctgcatctgcctagctgcctgcagactgcgcctgtctcctggctgctctctgcttatatatatatgtaggtctgcttacacggaaccacaatggaagcatcgtccatgaaagaaactgcaggttgtgttaattgcgaattctgcggggtgacgaccaataaaatagtcagacgcggggtgacgacctgctgctgctgaaggatggaatgctcgctacgtatatcgttttattttccacatttataatttagttatttctgagatttttgtttacttcaattagccgatcgatctatgtacgtataaatgaatcgtaggattaggttgattagattaattagcgcctaaggaacgagtctagaagaattggtgtgtgattaattagggtcaactactataactgttagacgacgtacgacacttcaacggatctcggtcgatcggtgtcgcccatatggcggaagcggtcaatttctacttcatgtattattgaggcaacaactagacgtccggcgttgggcgtaacataagacactagtgcagaatagattatccatgttgggggtaggaacccttatatatatcggcgggggtcttatcacggattagtggttactgatgtgaaaactcatagctgttgaacaagcagtcatcaccgataggataatctttaaataaaatccaatcaccgatatataacgtttaacccagcacacgaggcatcctacaacccgtcaattaggttcttttctttagacttatagccaacttataacccaaaaagtttaagtctaaataaacaagtaccacctctattttttaatatatgacgctgttgactttttttcacatatttgaccattcgtcttattcaaaaaatttacgtaattataatttattttgttatgagttgttttatcactcataatactttaagtgtgatttatatcttatacatttacataaaattttttaataagacaaatggtcaaacatgtgagaaaaagtcaacggtgtcaactattaaaaaacggagggagtatttttttttcgtttcaaagccaaaagctattacaatgttaaatcaaaagcaggttagagaagattttttggcttatttgaagtggggatgtaactccacattaaactttatgtttaaaaccgttggcttataaaacatatatataagttaaaatgtaagcttaaaatctaaaccaataagtctaacccaaaataaagaagcctgttatgaatgacttatcagtgatggcttctcgtttagaatcgacgaccatgttgctcatccgtgacatttctttttctaaagaaatcgttttattggccagcctaaggtattcactacaagaaaaaacagaatatccttggcggccagaatatggagtccccccccacccaacatacttttctcctttgtcttataatacatttccttttcttgtcaaagcctctatgtatgtccttcaccatgtcgaccaccttttctctagttacatccgatggaattgggagaagttctctcttattgttaaaatttttgttcattcttctatacgagtgacgtagcgggagccgacttctatggcctatttaaactatctttcgcgacttatttagccacttactgtgtgtattttccaaatagtccgagcaagctttattttctttcacagggcctcatcttttctcttatacatatgcttatccgtcaaaatttgaattttcaactttaaatttagagttgattttgaggttttttcatcgaagtttatttttcagcatttgcttttagatcactaagaacacgtatataaaagtcttattcacaaattactttgcatttgcaaatatgtcatttcgcttattctacgatgggtctgatagtttgtcccgaaaggttaccaagtgtcaggtagtcgttaatggagcaaaataatagggtacgtagattgaagttctccctactaattaaatacatcccaagtatgtacacagtctcaccatagcgtttctaggtcatcgattacaagctccagtaatacatcaatatcattactagattgtttcagtacttggattagcaagcaaaatataatgcgcttccttttgaaacacaactatggtggtaggttataatttgctataagaactagctaagtgctttgacaactgcataaatctccgaaaggattcatgcaaatccgtatataaacatagctttcaatctgtggcataagcttaccattggtccttcaatccgtggcatgcaaatatactaactctactttcttggaattggcaaagatatcttggaacgatcgatgataggtagatacctcacaaccttcgccggaccacccactttaactttttcccccttcgtcagaacttgtctatcacttgtatcaagaagtcttgcacacaagacaagactctaagtcggcgtattccttatagtacaatatgcagttgtttgggcaagcataaattctatgaacctctatccctaagagacacaaaagctattttgcttcatttttcgtcttaggtaatgtgttctcctctggaagtaggtccttcaacaaacttccatccactactcatgtgttttgccttgcatctagcgtatagaggtgtttgtcaatcactgaccaacctggcgaacttcatgaaatctttcttgtcgtaatctggctcctcaccatcacgcaacattgcttccagagaagttattgacatcaaccattctgtcgcccaatggagttcagcttcatcttcctgattttgtccaccgctcgtttcatctgcaatattgattgattcttgctctccatgcttggtccaacatgtgcagccctttataaatcctcgacatattagatgaaaagtatatctactcttctggcaagcatctcctcatttttgcaatctacacatggacaagtcatataatcattgttccttcttttcttccccttttccgcgacatttataaaatttgcaacgttctttgatatgtcgatcaattccatacatccaacttctacccatctctgcaaatgcgaacaaatattagatatatttttttatgatatatactacaaaatttatagagatggtttacttattaattggatccatgccactacaaatgtggcactacaaatgtggatccacataaatgaagtgttaggctgtgttcggcagcctgggttgggaacccatgtcccatgcacggaaaacggagtggtccattagcacgtaattaattaagtattagctaatctttgtttcaaaaatgaatcagtatgatttttttaaagtaactttcgtatataaacattttaaaaaactcaccgtttagcagtttgaaaagcatgtgcgcggagaacgagagggggagttgggaacaggggcaacgaacacagccttagaccctatttggatcagggactaaagttttactccctgtcatgtttggacactaattagaagtattaaactgttgatgtaaaaacacgaggcctgggagatctgcttaactccagtgcaggtccaaaacttgcctttgggtatgtgagcgtgccagttgatttgatcttgcaattaacaagaaacaaagacaaagaaaccgcggttaaatccataaacgatagccgatcggctaggtgccgatgacatatcatttatcgttgagccgatgtcatatatgcattgatcggtagtcattaataagtaagacagaactaaatatactcgaccggctgtagatattaacagtatgtaatccttatgtcgatatacacttaaatcaagtgattgggatagatcggtcgccatgccgagacagtataaatcacttagatcgaaatatatactaacaacaagatagatctagcatgtatcggctaatactccaataccactctatattaagatattaaagcaagtaaaatatatcaaacaaaaaacctaatatatctaaatgtgacaagatcttaacataaagggcacatttaatatatcagtaaagcatacaagataaatgtatttaaataaggtaagatcggctgaaaccccgatgctaccctaatcggcaaccaaagacaggctagagattgagattctaatcacgactaataagatcaaactcaactgatgcagctataagtatgaaaagaaagacaatatctagacaatcaagccgttggatgtttcatagagtggtagatatcttatataatctaagtcaacgtcggtatttaacttaatcggctgccttctactaacagacattagccgattaagggttaaatagcgatattgccggagattatataagatatatgataactcgacgaattatataaacaagattagagtatcataaaaatggaagcactaatcccgagaacgcaagcggccataacaagttttacctcttgttgaagatcgaaaccgatgcagctcaacccgaaagcaagaactcgtcttgacaaaacgaaagtaaaaagggtggtgatgcgccgagattgtattgagcgtgtgttagtttgattacatggggctcgggtctatttatactcgagaattacaaaatatgtccatatcggacacgactcttatctctaacaaactctaagaaactataagtctttgcggcagacttttgcccaaacatatctctaaagaaattacataaaatatcctaattaatagatataattgccttctcaggactctatccatgcgtagcaatcatcatgaagcacatcaacctaacccgacaacatacgcaatgttatactatcggattcggctcgatcagctaaccccatccgactcaaactctgccgatcttagttgtagccgattcggactccagccgatcttcactctgttttcaggacgatctccatctcgaactccatctcgatttcttcttcatctccgattcttggattaccaaatttggttgttaacataaacgtagactgatgacaaaacccattccataaccctggactaattcgcgagacgaatctattaagcctaattaatccatgattagtctatgtgatgctacagtaaatatgtgctaattatggattaattaggcttaaaaattttgtctcgcgaattagctctcatttatgcaattagtctatgtttaattaatacttcgaattagcgtcaaacattcgatgtgacaagactaaatttttatccctggtccaaacaccaccttacgctagacaggccattatatgcaccgacatgcaacacttacgacgggcccacatatatatgcctttcgtccatcgcgcaaatgcaatgacgcggatttagagcaagtattacaacaggctgtaagcatactaatctctacgtggaggagggagaaacgaagagagagatctggacgggcgactcgcgacgcgcctgcttgaggccggcggatacgcgctacggccgctgctattggcttaggctcgtttatgtgcattaaatactagcgggtccgtcaccaccgcgtggtgatctggcgcgtgttacagccatagttattgggaccggaccggtggtccgaccggagaaaaccggaaccagccggtcaggtccagctaaaggaccaggcgtgcaatcaaacctgagaaaaccaattaaaccgtcggttttttttgaagaagtcggtggaaaaccgggaaccgggggcgctggtggggacctgaggagaaggggcgctggtgggatggagagaagaaagtacatagtaaaatgttgtggggtgggattcgaaccctcaacctcatccttccctaccaggaaccccaccaatgagctatgttggacgtagtg

SEQ ID NO: 79589 - DNA, 2145 bp, Oryza sativa
ccaaactcccgcgtccgtctcgctgttgggtttcgtgcatgccgtgtgtacgcgctcgagcctcgagagaagtggagagccccatgtgctcccgcggcccacgcatacctggccggcctccaagccaactcacgcgtatgcgcacgcgtccctgcaatctccatgacatgttttgactccgtctagcacgtccccgtttacgttacgactgcgagattgcggtcggcttatgctcacgagatagaagtgaatcgggcttcattcagctggagattttggatgggaaaaatcgatcggtagttcagatttgaggccgtacgtcattttgaaacaggtcaaagaagatggaaaacactggcgagtgattaaccacatgctggcaatttggttgggtcgggatagttcgaacagttaatttgcacacaggtcgtgttagttggctcgtttgggctggttatgttgtttagacacaatcctgtatttcatggtcttgctatatggaggactctgtctgagtctaccattgctctgtgtaaaaaagaataaaaaatattctctgctatgcatttccatggtctactactgagcttattcaatcaagactcagcagcaatatcactgcaccaaataccacaatgctaaaaaaatggaaaacaaaagtcattggctatatgcatgttttggatataatactccgagcaaaataatattaagttttaagtggcatttctcacttgattctgaccacggatatttttcgtccaagtggcagcaatccaaaatctatcagtataagataacatgcaaaggaaaatcgacaataatcaacaaaatctttcttccacataaaaccttaagcaagtattttctatagatcttgccatcaggttaggtttgctgagatggtatacacatgttatgtttcactaggaaggaatcctacgcatatacgcaagtaaattatttataaaagattgctaaaagaagttatattttaccatattagtatccgcatatttattatttataaaaaaatactaaagaaattctatcgcaccatattcgctataaagacggtagattaccttataattatataaaaaatatatgtgctatagattttgatataccaaatgataataatatctgtcatactcaaacagaaattactttatcctggttatatgtaaacccacctaacaccgctatgtgttatcgttgttttgaaagctggtgcatttttaatagatggaattgcatccataccaaaacaaacctaatacatcattaatacaatgaaaatttaataataacaatatagattttatcatcgcacataacttaataataattaaattagatctacaatcataaaagtaaaatgaacttaatgttcccaaaatatattacttagaaagcaaaatttatgctaaaaaatgagatcatacaactaatatttgatacatttatgtctttggattattttatgtttaaagatccatattcactacaattctgtcgagggtgtagatcctgaccacggtatttgtagagcatggggattcttggtgccaaggtatacgcgagattgaggtaaaagaaaagggagacatggattttatataggttcgatactgttaactgataggtaacagcgctactcctgttggccgaagccagcgttgcctttatatatcaacatcacattagtacaatagttaggatgatctaatatagtctttatcgacttggaggcatggagctctcacacgtagttgacggctggaatagtattcattattgacgagattggaggtagcgctaggcccttcatatcggctttatggctctagattgggtttgtctaggcttgcctttctgttcatctagatttgtattggtttgtattctaacttggcatgtctagatctatttagatgtgttggcatattacctctctaattaactaggcttgtccctcctcctactaggggttcttgtatttataccctcgggtgcccccttgtccaagtagaactagggaggtaagtatggatacgatccgaatagtccttgttgtacccgagtagaactttgtttatcctttcatatcggaacaccttccatatatgaggcatgtgttgg

SEQ ID NO: 79590 - DNA, 963 bp, Oryza sativa
aatactgtatttttagactgattacagtgagcgatgatttcacagagtaatgttttgagtgatcttttatttatcttgcgattttactaccagaatgtggcatttgttacttaattgtgttgttattatgtatatctaattttgatacaaatacctattaatggtttccatcaatgcccaacacttgcttgcaagaggcacaattcccttttacaaaatcactgtaatgcaccacggtttctttaaactttggttctcctatgttgtgtaagtcaaatgcaaaatccacctctgtaacattttggttatagaaagagccacatgtttaaagtgcagtagtcctcaaaaatccccatgccatataattgggttatgttaaaatggcaaatgaaactgaaattgtatgttcaaaaaagggcagcagctaaccgtgtttctatgcttgggataatgttctttcgcccccctttttgttttctcttgtcctctgttgtaatgcaatcaattttgtcttttcagggtcgcccaaaaggtgtaaccccgaagtacagcttgaagcctcttgttccgcgcttgtctgagcttcttggtgttgatgtatgctataaaaggataaatcatatttattattctgcaattctgcttactacaaactggtagaccatcttatatttccatgttttgatgatgtccttgtcgtaggttgtgatggccaatgactgcatcggtgaggaagtccagaaattggctgccactttaccagatggtggtgttctgcttctagaaaatgttcggttctacaaggaggaagagaaaaatgaccctgaattcgccaataagctggcatctgttgctgacctttatgtaaatgatgcctttggcacagcacacagagctcatgcttcaacagagggagttacgaagtatttgagaccttctgttgctggtttcctcatgcagaag

SEQ ID NO: 79591 - DNA, 2022 bp, Oryza sativa
acattcggacccatgcataccacactggctcagattgtttgatgtacggttgataggccgacaaaaaattaaaggaagcaaccaaaactaatttatcggaaaaagtttaatatattactaggaaaaatacccgtgcgttgcaacaggtgaaatctattttaaccttattattgttatatgatttaggccctgtttgtttcagcttaagattattgtaatttagattattaaatcggattactctaagctggattataataagctaatctaaaataagctgcgagttatttgtttctctggattattgaagacatctaagggtagtgggtctttagccacccaataatctggaaaaagctcctccagagaagattattagattataataatctggcttacagattataataatctatttgtttgtttcagcttactcttaataatccagattataataatcctaagttgaatcaaacagggccttatttaagataaaattcactgtggaagttcgtttggatatatattttttcagaaaattatgagatgtagttaagagtccgatcatctcaagttagcatgcgagtttttttaaacagatttcttatatgattccttctgtattaccaaaagtgaacgatcgtaaaaaccgactcaaatacggatatatatttccaaaagcaaacgaacttaaaaaccgactcatacatggatggcataccaaaataccggcaaaaacatctttaatttttataatagtagacatatgttttaagttcattaaaagcaaatgcagaaaaagaaagaatgataaaaagaccttaacattaagttttaaaattcagattttgtctgggactaaatggacaaaagtaaacgatgagaaggttaccactaattagaattttctttttaacatttttcatttccttatctagtttgcctttgctaaataaatattatcccttatgccattcataatctaagccacacctagaattatctctagagagggaatgccccatgtagactgagaccacacctcctatcccacagtgcaaagttgtttcaggagcgttttcaatttttcatgtcaagccttaccatcttctattttagtcatcatgtgttttcattttacataacgtctaaaatttagcactacacaccctaaaatctctcccctcccctcaatctctccgttcctcaaccaaccagagaccgacgacggccggcggcacaacgagcttcaacctacggaggccgacagctccccaacctccgcccaaccacaagtcgcaggaggccaatgacaattccactgataacggccggcagctcaagctaccccgtcatcgtgtcattgcttcaccatggcctcctctcccctctccccgtgccatggcggcaatcaaggaggctggggacgcagcggtgatcgaggaggccgaggtggtggcgaggcgacgacaagctcaacagcgcgtgactggtgccactcactcgtggcgacgcaatagctcattgggccccctcctatcccggccgatggcgagtagacagcacattgaggactcggagggcgatgacctcgacaatagtggcgtggatccggagtgacacgagagctcggccgccaccatcatcgcctctctcctcttaggtgtcagatctgacttggagctcagtaatatcgcctagatctagcccgcgggacagtgagctcggggcggatttggcagcgtcagtaccctaccctccccccgggcttatgagctttttcagtagagacggtttcggcagtagatcgggtcatctttgagcaggagaacggacataggatgatgttatcgggcgacgagcagatcaggtcgatgatctccaagtcggccagtgttcttccccatgtctctctcctgttttctagactcacttcccctttttctaacatcttctgtgaggccctgaggccctcgttaccgacagagggcatgcgaactcgacaagaacatggtccctggg

SEQ ID NO: 79592 - DNA, 27569 bp, Oryza sativa
atactagaataggaagagagtagagtagaaggagtcggaagaattccggagttgtcggtaatcttcttctatttcttttattgtgtttattactctgtattcaatataatattcttcttgagtaatttagatttatcttgtgagaattatctcttggttagttcctaaatagcatacgggattattgttcactataatcaactaaaatatagtaattgctttggtgagttataaacactaaagtagatattaattgcttagacgtggtgtttaggtaattattatccagtaattgctacgtatcccacagtacgtttgaggtgggcgcagaggtggtgacagccctcgagatcactgaagtcctccttgtccgggtatgtagttgagcgacatctgggaatagcaggttgccagtgcctgaagtattgcgttaggattaaaattaagctttccctagacattgtttctcactagtaaatcctctctatcctggcctatcttttgcttggtgtccttggatgaaccggaggaagatctgaccacacacgttcccttggattcgatacccatggaatactccgtaggggaagtgctactttggtatatccgtgtgtttgcggattttatctgtaactgtatcaaataccaacaagtatttctggcgccgttgccggggaacggttgctgatcatttccgaacccagttcatcctcatatcctttttcatattttattctaccttcacccctgctatcctagagaagtattcctgtcaaacccttctcaaccatggagcaacctcgttttgaactatctgctcctcgggacgaattctacgagccacctccttcatcggaacccatttatacaactggttatgaaattcgtcccgaactaatcagtatggttagggaaaattccttttctagctttgatctagaaaatccctaccatcatctgtgagactttgaacaagtctgctcatgccttaagattcgtggcatgagacaagaacctgtgcggtggaaattgtttccgttctctcttcaagggagagcaaagcaatggtacacctctaccgttggatgtgtaaacagtagctgggaaaagttgcgagacagattctatcttgccttcttcccagttactcgtattactacccttcgagttgaaattctcagtttcaagcagatcgaaaacgaatcaattggtgcagcttggtccagattcactaatttagtgcagttcggaccaaccctgtccttacctgtgtatgtgcttctccaacatttccatacgggtttggataaggaatctgcattctatctggacataaccgctggaggatcgttcatgcataaaacgccgtcagaaggaaaaacgatcttggatcgtattctagaaaggcaaaatttgctacaggacactcaaaaaacgtgtaattggctgggagacaccgtaaaaacgtgacacggctgatggacaccacaaaaattgtgtaattagctataggacactggtcgcattattttattatttccggatcaaaatagttgagaaatttttcaaaatggcgagattgcgcctggcgccattgttgtgctccggcggcagtggagtcctatctgtaagccttcaactagctaaggtggctattaatgagtgagagcttaacgctgctttattagtttaattaataatcatcgtgttcacgtagattaattaactgactgattaaggaacttgaagaggcacgcgatgggcaggctgcgcgggaaggtgttcccggcgtgcttcgcgttcaacgcggcgtgcacggcggcgttcgtgtggctccaccgcccaccgtggccgccggccgagcgccagcagctcgcggtcctcctcatcgccgccgggttcgacctcaccaacctgctcgtcttcagtcttcacccctaggacactcgaggtacatatggctccattcttttcagatcgagacatgaatgaaggccaccgaggacactcgaggtaagatcaccgccacgtatacccagcacattccgcacggcaacgtccttggcgaacgcgctcagtagctcgctgagccgcatgacgccaccgctcgccgccacctccactagctggaggagctcccctacctcctcctcccgcacggcgcggtagccccggaccctggccgggccgagcaggtggagcacgctcgccctgcgtgcggcgcgccagtacgcaccatgtggcgcaaaggcaatgtcggtgcagccgtacaggaggcggcgaggcacggtgagccgggggcggctagcgaaggcgctgtcctggtcgcgcatcacctcgcgcgccgcgtcggcagtggagatgacgacggtgttcactcggccgagccggagcatcaccatgggccggctggcggcgagcgcacgcagggagctgtgcgggagcgtgcgggaaagctgttgcagattgccaaggaagggaagggcaatccagacatgtggcaaaatatctcacctcttttgacctagaaataataaaataatgtgaccggtgtcctacggccaattacacattttttgtagtgtccatcagccgtgtcacgtttttgcgatgtctcccagccaattacacgttttttgcgtgtcctgtggcaaattttgccttctagaaaatacttccttcatgacgcagtccaatgaaccccagccggaggcatccgtgtccaagatagagaaacctctaacgatcgagccacttgctgaaccatccacttccgctagctcgattgatgagaaggttcctgagcagccgtccgtcgagaatgaagaaattcagactccggattgtgccgcaattatgttcagggaaggttttgacgaagattactgcaataccctcaactattttagcaagaggaaaccatccgttcctttgtcacctcccaatcctatggaacttgggttcctacgagaaattgtccgggaattgacatccataatgagcgacgaatggctaagggaggcagagctttcatccgaagtaattcggataaataccgcaccccgaatcattccttgccatctggaagggaacgatgtcggtattccctacagtccaactgtcggggccaacctcgtctctgagtcttttgcattcgcttatttaagcgataaggcagtgaccccgacaaacaaattcttcaagcatccgaacgaaaatatcatcgaaggatttgggtttgtgcaagatgtgcatgtctgctttgaagacaaggaggcgatcttggatttccacgtctttgaaatccaagactttgatatcctaatcggtctgcccattgagcaacttctcattaacacaccccgattaggtagcctcaaaataacactgggagagaatgaatctcaattccattctcgcgggcaaggatcaccttgaccgaccctctcctagaaattgagtcagcgaaagaggttaccgcagttcctcctcatgagtctcccgaggcccttctggaagatgaggtccccgacttcatcaaggaagaagcagatcccggtgagactctcgacttgccaatcatggaaccaccacctcaacctccgctagagcttaaacctctacctccaggcctacgatatgccatcctacacaataacagagaggctcctatcataatcagtgacaagctctctgaagacgagactcaacgtcttctcaccgtgttagaaaagcatcgttctgttcttagctactcgcttcaggatcttagggggattaatcccgcgctttgcactcatcgtattcctattgaccccgagagtactccctctagggaacctcaacgacggctcaataatgcaatgtgagaggttgtaaagaaagaggtcttgaaactcctgcatgccgggattatctatccgtaccatacagtgagtgggttagcccagtccaggttgtgccgaagaagggaggaatgacggtcgttgcaaatgctcaaaatgaactaattctcaacgaactgtaaccggatgaaggatgtgtatcgattacatgaatcttaacaaggctacaaaaaaggatcatttcccgctacccttcattgatgaattgttggaacagctggcgaatcattccttcttctatttccttgatgggtattccggatatcatcaaattcccatccatccggaggaccagagtaagactacgttcacatgtccgtatggcacctatgcataccgtaggatgtccttcggactgtgcaacgctcctgcaacttttcagagatgtatgatgtctattttctcggacatgatcgaagatatcatggaagtcttcatggatgatttctcagtttatggaaagactttcggtcattgtctgcagaatctagacaaagtcttacaacgatgccaagagaaggacctggtgctcaactgggaaaagtgccattttatggcccgtgaagggatagttcttgggcatcaagtgtccgaacgaggaatcgaagttgatcgtgctaaaatcgatgttatagatcaacttcctcctcctgtgaacatcaaaggaatccgcagcttcttgggacatgccggcttttatagaaggttcatcaaggacttttctacaatcgccagatccctgaccaatctgctagccaaggatgtgccctttgagttcgatgatgcatgcctaaaatcttttgaagttctcaaaaaggcactcgtctctgctccaatcattcaacctcctgattggactctgcccttcgagatcatgtgtgatgcaagtgactttgttgttggtgcggtcttgggccaaaccaaagataaaaagcatcatgcaatctgttacgctagcaaaactctaaccagagcccagttgaattacgcaactactgaaaaagaactgctcacggttgtttttgctatcgacaagtttagatcttacttagtaggagccaaggtaataatttatactgatcatgctgctttgaaatacctgctcactaagaaagatgctaaacctcgtctctcaagatggattttgctgctccaagaatttgacttagaaattaaagataaaaagggaatagaaaattccgtagcagatcatttgtccaggctgcagatcactaacatgcaggaacagccgatcaatgatttcttaagggatgacatgctgatgatggttagcgactccaacccgtggtatgccaacatcgtaaactacatggtatccaagtacgtaccacctggggaaaatcaacgaaaactgaagtatgaaagtcgccgtcacatatgggatgagccatacctgtatcgagtctactccgatggcttactacgaagatgtgtgccaactgaagaaggatttaagatcatagaacgatgccatgcctcaccctatggtggccattacggtgcattccgcacccaggctaagatttggcaaagcggcttcttctagccaacaatgtatgaagactcaaaagaatttgtcagaagatgcaccagctgccagaggcaaggaggaattactgcacgcgatgcaatgcccctcacatacaatttgcaagtcgagatatttgatgtttggggtatagacttcatgggacttttccctaagtctcacaactgtgagtacattctggtggcagtcgactatgtctccaagtgggttgaggctatgccgtgcagcgctgtggatgcgaggcatgccaagaagatgttcacagaaatcatcttcccaagatttggtacccccagaatggtcataagtgatggaggttctcactttattgacaaaaccttccgagacctcctacgagaaatgagagccaaacacaatgtggccactccttaccatccacagaccagtggacaagcagaaacatcaaacaaacaaatcaagaatattctgcaaaagatggtcaacaaaatgggaacaggatggaaggacagattgccggacgcactgtgggcataccgaacagcatacaagacacccattggaatgtccccatatccgatagtccacgagaagccatgccgactacccgtagaaattgagcacagagcatactgggccatcaggaattggaacatggattttgagggagcaggagaatggagaaaaatgcagatcgctgaacttgaggaatggagagaataggcttaccacaatgcaaagatatacaaagaaatgacgaagcgctggcatgacaaaagaataaagatcaagaaattcaagccaggagacaaagtactgatgttcaactccagagttaatcttttcggccacggaaaactgcgcagcaaataggaaggaccgttcgacgtcatcgacacctcttcgcacggggcaatcacactccgcgacgaatcaggtaacatatttaaggtaaacggtcaacgcctaaagattttccttgagccaaacaaaactttagatgaagaagtggacattattgattgattgattatgaacaatgatgatctcagctaatgcgtgcttaaaaccctgtatagttgtcatttttgtgcttagaataggttttagtgggccttggaagaaaattggcggccagccaatggttcggccgaaccagggcggcgcccgatcggccccaaattcgaatgatagtctcccccgctcgtccttagtccgtttagatgcgcgtttgaaggtagaacgttcggatcacaccagaacacttcgtcttcctcctttcctccacctttgcacactctcctctccaattcaacccaattcctcaaatttccactcatacccaccaatggctggcaaatccctaatcccattcatcggctcctcctccaattccacatgcaacctcgacggagagccgacaccagcaaatcaattgataccggtggaggattacacgatggaaggggtgaacgcactatgggcgcagcccctcgcagcagtgacgggctcccctgcgaatccggagcccatcggcgaactcccttgttcggccgaaccaggggttcggccgaacccttctcggccccccattcggcagcgcgatccctctcccctcgccatgttacaagaacaaaaatccgggggagggggggattcgcctgcacgacggccgacaacgggagagctcggtctcttgaaggcacgacgcctttttcaagatgacgggaaggccgcgccgccgagcgctatgtggacaccctcttcaccaaggcaagggatgaggtgctccacaagtacaccacacccaccgctactccatctactccgaaggaggagcgattccgtattcagggagtgcgaactcccggcggtgggtatggtaagggtttactccggcctttaacagcatcggagaaggagggggcagcggagtcccgtaggtgaagcgtcatttgacaccccctccaatttgagggctcccggccaattccaaaaggatgaggtgaaatcgccggagccctcgatccacaagctcgccgctaaagtgaagaaacttcgcaaggagaacatagagcttacggatcgcaatgcggagctaggggtagaacttgctgaaattagaaataattttgatacccttagtcgcggtttgtgcgctaagatcaagcgtgcattcatagagatggggaagaaaaataagtattatgctaactagatgtttcctttcccatgaataaaatagtagtaggtgcttggttttatttttcaatcatgtaagcacttgctataaataatgtggctcattggtgttaaccccaatgtttgccaaagtttgtttttgttttaagttcaataaagttcagcttttgaataagtgtgggggagacatcccagcttctgacgtgcatatactctaaaaattaatgaaatctctgaacacctagaagcactgaactctgcagaaagttgcaaagggatcaggcgccagagtggttcggccgaaccagtgttggccccaatccctctcaactttcacaggtaagcaggtgagcacgtcttttatctgtatatctccaccatggtatagtactagagctgaaaattcagaaaacaattgcttcaagcataagtaagagataaaatttccaactaatgaaattcttcatgtgattgatcttgtatattcattattctcagctgaatttgtgcttgtgaacaaccatccatgattagggaaccttatgcatctaagtaattgctttatgtgagatgattaagacgaaaggaatccttgcaacttggttatgactcttgggaatttgttttcaaaataaaaattgttttaagaaggctcaatcctctaattgactttaccttatacctaccaaggccatatgcaagtatatcattgatgaaccttatcatgcatatgactgcttgacattatattgagctttgtcaaatttgtgtgacttgtgttagatatctttcatacaacatatttcacttttccccttgtcaaatttgtgcaaagaaaatatagccatgccccttccataatcatgccaagagaaccaattggagagaaagtataggaaaaagggagaatcatttctttattccaccattccacaacatatttcacttttccacttttcaccataaataaagacccttgatctaggagtatgattgatgatcttcttgagtccatatttttggcttggaaatatatatgatgcaggtatgtcccagttatccctaccaagctccacatatcagccgtagaatagggatcagttctggcacattttgccttggtgacgatccaaagaaaatatacatccttgagagaccagagagaaagtcaatatgaggaaaagagctagtttgcgaaaattcataaaaaatcccatgagtctggtagagaagcaagaaggactggaatcaagatcgttccatttatcaattactcaagatggtaagatagccactgaaaaagttcacaggtgcaggtatggttgtgaatgatttatatgcttgattcatcttttgaagaaattcattctacactaacctttactcagggacgagcaaagggctaagtgtggggggttttgttggcggctgttaaatgccgattctataccgccaacatctgcataaagattagataataaaacatctaacatagtgataggtgcttatctcacgtattccacaagtgttgatatatatttgtatgcaggtaataaaccccggtgcgggaggaaatctagactaaagtgaggagaattctgtatccatacaaggatgggttgtgaacttcatcgaaacatcagtaaatcagcccaaaataccaagaaatggatagaggaggaccaggggaggacttgggccaaaggccaagccagatgggtccagcccaggttcggccgaaccccctggttcggccgaaccacaatcttagccatctaggctggggtttggcgtggacgtcccagatgcatccctgatggcggttggagggcacttcggacatttccccttcgcctaccgtcatacctacccctatataagaacatcatctcattcacttctacacacacttccaagcttgagctgaattataagaggctctattgtactatattgtatactagaataggaagagagtagagtagaaggagtcggaagaattccggagttgtcggtaatcttctcctatttcttttattctgtttattactctgaattcaatataatattcttcttgagtaatttagatttatcttgtgagaattatctcttggttagtacctaaatagcatacgggattattgttcactataatcaattaaaatatagtgattgctttggtgagttataaacactaaagtagatattaattgcctagatgtggtgtttaggtaattattatccagtaattgttgcgtatcccacagtacgtttgaggtgggtgtagaggtggtgacagccctcgagatcactaaagtcctccttgtccgggtacgtagtagagtgacatctgggaacagtgggttgccagtgcctgaagtattgcgttaggattaaaattaagctttccctagacactgtttctcactagtaaatcctctctatcctggcctatctttttcttggtgtccttggataaaccggaggatgatctgaccacacacgttcccttggattcgatacccttggaatactccgtaggggaggtgctacttcggtatatccatgcgcttgcggattttatctgtaactgtatcaaataccaacagcatgattccatagaagacttggtatatggtggcacttaagaccatcaacaacacccccacacttattatttactcgtccatgagtaaagctcatgaatccgctagagtaatgactttgtgcttaatgcttaatgatatgacataccaaatatcctgagacatacttgagtctgtgaatcttgatgtgtctaccatgtcatattgagcgatcgaaaaacggaaccgtcctcgaagtcacctttattccttctgatgaattaccttggggttttctttgatgcccaataaaacatactcccttcgtcccaaaatataacaacttttagcactcaggatttgttctaaaatatattaacttctccaccaaacattcccttccctaccaatcacaatcctccatcattcacttttctcacatacctccacttctcaaagtgtttattcctcaccaaggcattgatgttgcattgtctaatcctacctttctaataaagcttatgtggagcttatggtagggaataagaaatgatcatatacttgcatcagatatattgtaaagtcaaatagaggattcaagaagatatccaatcatataactatgactaatcttgtgcacctatatatatatggccatatgggtggaaatggaaaggtggaaaagaatttaaaaaatgggatggtgactcacttttttttgtatgattctcctccatgctcttttattttagagaacatggctatactttttctttccatcatgttcgagaacattttgcatcattcacttttgacgtagtatttatttggtggatgctgactctcgacgtagaagcttagcatatggaaatggatgaaatgtttttgataatcctccattgtagagaaagagtaatatttttttgtggctaagtgcacaagattttggtcatcagaatatgaaaagaatctagcaagggttgcaaccatttagcaaaactcaaaatggtagcaagcagcatatgtaaaaggttttatcattaaaatcaacatatggctttggtaggaagggaacatcaataaggagtatgtaaagttatttattttccttttataaaattcccaagggttcaacatcaagagcaaggttcatatcattgggctatttctcattaataaataacatagataacatatggtcctatgaatatgattcacaagcaacaggtgtgtgtgttgactttttttgtggtcaacacagaatcacctaacgatatgcagtgtaaacaaagtcgccaaaatcgatatatcaaaaccgtctagcggaaccggttcaaaattaattcacttttgcggaatcaaatgactaatttacaagcaaattaattagcaaagaagataaatatcatacttacgtgacgacgaacgactagtttccgagcaaactagcaaaggataaccttctcgttttcgtggagaagcacaaccatttttcagcgcaaaagagcaaagatgaactaaattctagggtcgctagaactcagccatgaaaacaaaatagaaaagaacttaaaaagtaaaagagatgaatagtagattgaaattgttcgggtgtctctaacctgatcgaccatcaccagtatatatactgggcaaggtagacgatcctttagcaagtctgatgatatcggtcccacacaaaataaaagaaagattaaccgaaaaggaaacaaactaatcctaacaaagaagtttatctatcttctagtccggcacgcgttaaccaatctgcctcattgcatgcaaaccgacaccaaatctccatgcctcatgcgacgcacgcataaaccagttgcatattcatctcggtcaccagtgcaaacccaacgtgaaatcctcatgtgcgcttggctcatgcttctcctctctgacctccatccaaagccgtacgtcaagcaaatatcagctcaaatcagccatcaagcaacaactgaagataaagcatcatcgattctccatctgcatgcatccagtcccagtccaggactccaaatacagagctactcctttctcgattgcagcactgtagcccaactgacatgcacacatatctccacacgacacatgcatgatcaaatgatcgaataaccctgcaatttacatggatagccacccaatgtatcacaaattcctgcacatgtaaactgagctgatcttccaagcaaatcatcagtccattacaccaattattctaaaataatctggcttgcacaaataaactaactataagccaaattatgccacaaacagtgtgtagggaattagaagttgttggcggttattaaatgccaattctatacagccaacatatgcataaagtccatataataaaacatccaacatagtgttggtgtatatttgtgtgcagatgataaaccctgaagttgggagggtaatcagactaaagtgagggaaaacatgtatccatacaaggataggttgtgaactttatcaaaataccagagaatcagcccaagactccgataaatgaataaagcaaagcagagggagtccacaggccgaaggccaggccgggagggcccagcccaagttcggccaaccctggtgatcaccgttgatcctggggtttggcgtggatcctccagatcactccctgatggcggttgcggggcagttcggacatttccccttctcacagcctataaaaggagcttcactgcttcactctcacacacacttccaagcttgagctgaattataagaagctctattgtactatattgtatactagaataggaggagagtagagtagaagaagtcggaattctggagttgtcggtaatcttctcccatttcttttattctgtttattactctaatttcaatataattatcttcctgagtcatttagatttatcttgtgagaattatcttttggttagttcctaaatagcatacaggattattgttcactataatcaactaaaatatagtgattactttggtgagttataagcactaaagtaaatattaattgcttagacatggtgtttaggtagttgttatccagtaattgctgtgtatcccacagtacgtttgaggtaggtgtagaggtggtgacagccctcaagatcacttatgtcctccctgtccgggtacgtagtagagcgacaactaggaacagcgggttgccagtgcctgaagtattgtattaggattaaacttaagctttccctagacactgtttctcactagcaaatcctctctatcctagcctattctttgcttagtgtccttggatgaaccgggggaagatctgaccacacacgttcccttggattcgataccctttggaatactccgtaggggaagtgctacatcggtatatccgtgcgcttgcggattttatctgtgaccgtaagaattaccaacagaaggtatgtaagttattttaacaggcaagtcagaaactctagttgatcatgtcaatactccttgaccttgattcgcctataatgtcatactttggtttgtttcttgcacattctgttattgtgatagaatgtgtctctccattcctccagttctgacaggtgcatatgttggtgccgtccgacttgtcccaaatccatattctaagtccggatggcccagtgcgccctatgttccagctcaacaggcaggtggcaagtcttttcatagacaagctagtatggtgacattccgatggacgtcttgtatgcggttctacatgcccaaagagcatcaggtagcttatgcttccatgttttcccctctcattgacggctttctgcggaatattcttgatttgcttattgtatgtttctactttaccacctgtttgggggcggtatggagttgcaatgttgtgttgtgctccaagctcttgtaagaagttcttggaggtcttatcgataaaatgagaccctcagttagtaatcaccatccacggtgttccaaaccgagggaagatgaccttgtggaacatcttgcgggcgtgtttgacgtcgacatgaaattgcttccacccacttggacacatagtcgacggccaccaggatgtgctcgcagtcatgggactttgggaaggggcatttaactttttgccacttttaaaatgttgcaattaaggatttgccactcatagtctatgacatgtgggccctcatgtgtctatggcatataggtccagtgacaaatccttaattgtcatttgtaagagtggcaaatagttaaacatgtcctttgggaagggtttcatgtagttgataccccatacattaaagagttccacttgaatattgtatgttaggggcatcgcatcgcgagcggtgatacctacatgcttctggcaccttgcacatctttgaatgaattcttttgtatcttcatacattgtaggccaaaaggatccattctgccagatctttgattggctgaagagacaaaaaaaaggaggagaaaatgccagccgtccaaataaggaatgggaagcaaaagggcctatagcctagtggctacaagagcctcagtagcatcataggtcatgtgttcgactctctatgagagtgaatttttcagaatttgatggctatgtgctttcagtggtaggcgacgtacccgtcaataacaggggtagggtttgcgtgcgttttatagggtgagtgtgtgtgcgttgtgacttcgtctatctccaggatggatttgccggcccagtcttcgaagatgctcataggggtagggtttacgtgcgtgcgttcatagggtgagagtgcgtgcgttgtgagtgtctgcattgtactgtctaattctcaaaagaaaaaggaatgagaaaaaaatatataaatacgacgtctaagctcatctgctcatggagtggccggattggtcctccctcaatctctaaattttgaggaaagtctaaaattcattcactaactttggaaatatcttatatccccgaaccatatatctatgaagttcacttttcatcctttgactggagcgaaaagtctgaattacacccctaaattttaggtgagtacgaattacccccttaaacccgaaaaccagacatctttcactctcaattattaataccggatgaaaaaccccctcgaacagctttgcaagcggttttgatcctatgtggcagttcagtcaacaattattttattaaaaaattgatgggccgacttgtcagatctctcctctgtctctctctctcgtcaaaatgccatggaggaggcgcgccagcggctgcatgcgtctcgcagcggaggccgaggacgagttgcctccaccccccgcccccattggccactgccctcggctccccctccgccaccccgcccccgttggtcgccgacgtcgactcccccttcgatgctgtgagctgcctccgcccccgcatctgccctccgccatccttggctcctcctccgtcgccccgactgcctccgccctcgcccccttcggccaccgttgtaggctccccctccggcgctcccctcctcggtgataagagagagatggaggtgaggggagggaaaagagagagatgattagggagagagagagaggggggaggggaaagagatacagatggtgagagactgacaggtgggaccaccgatttaaaaaaagtgctaactggactgccttataggaccaaaaccactctggtttgagttaaggggataattcgttcggtattcgtagttgaggatgaaagatatctaattttcgggttagggggtaattcgtattcaccaatagttcaggggtgtaattcggacttttcccttaggctgtgtttgatttggcggggtggccgagcttttcaatgatcataacatgagaaaagttatggctaattaagttacaaacataaaaaatatatttatttatttttaaaatgaattttctatatacatatttttaaaaagcatataatgtttaacaattcaaaaaacttatgtaaaaagaggtactagcctaatggagaagctgattgaaactcaacctcaaattaggttgatgacatagcactaatgtgacaatgtggcgtaatgttgaaaatatatattaattaaaaatcactaaatgatcttgaaaattctaaaaaagattatccccttatccatgaaacatttttaaaagaaatatttttacaagcaagatacatataacttgcttgtcgaaagtagtgctaaaacatgacaaaaaatataataaaattaagctttatttcattttggacaaaatttatgtaagttctaatccgtccaatttgtaagcgtatttccttttcaaaagatcttttcaattcagctactaatttaaaatttaaaataccaaccgatggatggtattatattacatttaaaattttaaaattgataatttactttaaagagtatagaaaatgtgggttacacatttgtgcatattaaacctatataaatcggacttgttacaaaacaaaggattattccaagaaacaaaatgattttgtacggatcatagaactattttctgcaggcaaactattatatacacaactcaagaaaaaacaatctaggtcagtacataatcgtatataacaagtgatggtttttaaataaaatttgcatttatgtacattttttaaatttaaaagcattttcagccttaaaatgaactgttgatgtcatccaatatctctttgaatcattgaaaggatgagatgtgactgtatagaaagttaagggtgtagcaaatgttcaattttttggacattgataaaagttccttttttcttgaaaagtcaaattgggcgtttgttgcgcacctgaggccctacatcctgtttttctgagacgagatcacgagaggcagagtccacgaggccacgaaagcgctccaccgaccaggcgcccaccacctgttcgatcgaatgccgccgccggccaccgcgcgcggcgcccgctccgccgcctcctccaccccgttaggcgccgccggtggcggccgacgagggcccctccccgaccccttggcgcatccgctcccgacgcccttaccaacctctccggctacgccttccgccccgacctccgggctcctccatcctctcgcaccagcgcgccgccctcgcgccgcctcgggcgcccccgttccaggaccgcgtcgtccatgcgctcctcctcctgctcctcgagcccgcaggccccaaacctttcgctcccaccgccacccgttccgtccgctcccacttcgccgctctaccctttggttcatctctgccgacctcaccggcggtggccgacgcgctctcgccggatactttctactttcctgttgtccagaagaccgtctctgaccgcaatgcccatgtctgggctgtgtttgtgccaccatgataggagcttgatggtctagctaagagaagaggctgaaaaggaaggtgctcaggaagaacagaatgtgcccccctgagttcctgacccatattgattgaggttaatacttcggaagttcggatttaccctggaacaggcgtgtcatgtgccgaattgtgggcattatggtatacttagccattttgcctgccaatgtgtgccttaacaaactcaattggtggatggagggaaagatgcatgagtacttctggccaggcatgattcgattgggaaggaggtgggtgactacggatgcgagaaacgcccagggtcttctggcttagctccacaaggtggtgggctagacgacctaggttcgaagcctcaccccttctaattatttgatattaggtccttccctaatattcgcatttttggtgaccagggatgtccgcctggcctgagtttgtcccatgaagtgggaaggagtaaaacaagtaagatggattacctaagatgtggtggttcccatgctcttattgggatcaggggtccaagggaggacacagttgaggtaaaggatgatggagttctgcaagagcacttttggtttgaggcctgagaaagtgagatatcaatggttgggattgagcacatgaatcaatcaagttcttggatcacgtgatcacccgctgggttatctaccaaccttacaatatactgctaatggaggaaacattgtgagtgacaagggtgttggaacactcttatagcaaagccttcagaggtgggaggtgcataaggcatttaaggagtcttgaagttgttgccacgttcaccaatgctgtactctgggcaggcacgcacaatcctcagatgacaaatttctcgagaccatgtctgattagtacatgtacacagacaaccggaagaagattgtaggttctgttgttatgaaactagtagcactaacagtacaaacaatttttaaatgtttattaaactatagaattttaacacgcattatattgcttttaggcttaaggatattaactgaaagtcatgatgcttatttacccattgcaataggactatacatttattccgcatgtactctactgtctttccctaagctaccagaagtaggagtatgtgattactgttttgttctttttgctcttgtagaattccactaggtgtgatactgaattatctattgctgctctttttttgtttcttgcatttcaaacagaacaaccttgaataaaatctatagtaaacgaactagcaaacaagaacaagagaatttcacatttattgatcaaatctaaattgatgtgagttctgtagtccttgatggacatgcaagttgcttatcctcacttttcagaacaaataatctcatatatgatatagttcctgcattttctaaagattcactaatctttcttctcttttttctttaggaacagttctattggagcaatgttccttgactcaatgatagcagttggaattatttgcatgtactgcttggaggtggcagaccactggctatcagatgcttcctgcagaggtaatgtctgggtatcaaggctccaccaccgttaggaccagccaggtttgatcttgagctggtgctgactgggagatttgatagatattcttgttgtgaggctgattgttttcaattctcttataagttacaatcgatgcattgagtgattaagaacttaatctactgccaactacagtttaagatttacccagtcactgggcttcagatgaaatatagagctatctcccattaaaattaaaatagaaaaatatttccaggataactattcaggttatgcttggaagttaggtttctctgtctgtttaacctaccatttctgcatggatggagaaaatcattgatgttgtttagtatgacttaatatgtatactatcatgggcatgattagatgactgatgactctaggggcctaactcccaagcggtacaaccacaatgataactgttgcccatgccacaagtggcatggaagatagactaggaacttttcttactcctaccaatggtagcatatgcgactccttttcctacaaaatctagtttctgtaagctcaacctaattgcttttaacaaataaagataacattgaggcagctaagatcctatcctaaaataacttgatagttaagaaatcataggtgtacctagctagtgtggctgttgctgcttgcctcttttatgctgcagcatctcattatggtaaccatgaaaagagtaatggaccttaatggtctggagtctggacatatgcagcagaaaaatatgaatagggaagggcagaagagggagggaggtagattacgcttgatttgttcctctgtacaagtctctttaaataaagagagggctcagcacggcaataatcaaatcttaaacatggggaacaatctgtagtttgatggaaacaattaatgaagtaattgcttatttcatagccttatttcctaacacatgatcccacctgccaaacagttccctctcgtgcacccacaggacagattagaaattactctttgccataattacggatttagttcaactcttctgtatttagtaatgttgtagtggcaatggaacgagtgaatttatgcttaacaatgtataactctgtttccagcaacatgggcataagactatgatcagtgatcaccgccatcttaaaggtgattctttcctgctgctggttgtagttacctgttctgttctattattatggatagcaattttttacatgttccagtttatgcatagaacaacctaatatgtgaccaaaaagtatgtcatcctcattagtttctgactttaataataatagacccagtattctctgcattccacatgaacaaaagtgaacttttgaaaagggcaaaagaaaaagaaatccaaaagttcaattacttagtgttttgttgcataataatgcatgacaatcaagcattagtttgaatcaaccctacatcatcagcattctctgtacgtcacatataataaacaattgggaagggtaaaagcctgatctgtgatgaatctgatgatcaattttcttattttcttaatgaggggtagtgtattgcatattgctcaagagttcactttgagggagatgactggtggactttgtaaaacctgtttgagtggtgatgtaaggagcccctggaaagtgactttaccttgttttgtcatattaaccaattggctgaagttcttagtgacgtcattgatgatttcatgttgatattgatatctggttcccagcttaacttagtaggtactatgtagtacaaaaatattagtgaatagtgagctgcagctgtatgtttgtacaactgtattgctgtaggacatggaattattatttcatggtctaaccttgcttttgatatttgtagttgtacttatgtttgcattttgtatggtgtctatttatcatttattttgttagatgttccatcatgcggatgagcgtatagcatttttattatgttaaatcctggctgccacatttgtgcccaccttactgtacgaggtttcggtgggccccttcatttgaactaagtcaaaggggacgtccttcccccttgatcgaaaaaaagatgttccatcatgtgagcataggctgtaggtgtacatatggtacatatatgtatagctcttcacctggtggaaagtgttaaatcagaatagtataaaattttagtccatgcattctaagatgcttcagtttaaacatatatgtttattaccagatctaggaaattatgtgctcctgcaacttccatttttttgtaattcaaactgatatttccatttttgtttcgtggtgcagtaataattattttattggcaaaaggaaggaaaatttaatttggttttttactagtatggatgtgatgtttctgaaacataattttgccacacattgttggtgtaacatacagattgaggtattgagtggtacaatatatataatatatccaatatgcgaggagccaactgatatcaatccatcaggtttcgcagtgttagaacattggtccgtgattcattaatgccgctatggttaaatgtcatataatttggtttgttttacttgaaacagtaattgttggaatttagtcaccctggttcacccccatggtattttaccatgatgctattttgcacgctagaaaaccagcccttccccctatgagagaatgcatactcttaagttttgttacatcaatcagccctctatctgtacgatccagtacaatttttggctaaagttggctgtcctgcctcctgaggcaaaattatacagcattcgtttgctagttgtcacatgtttggttttggtggatcttttcggttggggaaacccatttgtgaattttacatattcgctgttcagcataggtgcacttgtcaattccgaatgtcagactgataaattttcacttcgattaagctaagtatgaggttatgagtatacaaaggaaccatttattttgttctctttgtattgcccaaaacacaatatccctttatggcttgtatgtggggctttgatttttgtatctattgtaatctacgggacccagcaacaaattcatgttggacctcctttcgtgctttaccagtgcttcattttttcacaaccacataatccctctatggcctacgtcaacttggagtggggttgggttaattatctagtagcactgatggaatgattttttgtggggttcacacctttcccttttgtgggccactgttgtaatgcagaaagtgttatggtgaggacggctcgttggttcacagggtcaccagcctatgataccatgggcaggagggaagtcatacagatgacctaccgtgtttatgatctattaacaccatattcatcagaaaataagtgtatatgttcttgtcattgcttttcttttgcaggatgaccaatcctggagtacattttgttttaaaaatttcacagtatatccttttatcctttctggaggttacagtatcttatggacagttggctttcaggtatgtcatgggtatcctgtgtgcattatcttacaactttataagcacccagaaaactaatctcgatcagtgttgttcatatgcagacttgctagattaaaatttactctcatgacctaaatgcaagttaggaggtcactgatataagattagattaatctgatctttttatctctttcagttacacataacgaacgatttccttccccaatgtgaggcatcatcctgtccctgttgctaaatcgtgtcagattaacttttcatacaggatcacagttagaagttgagaagccattttcacatgatggaaccctttgtatagtagtgtataatgtctgcattagatatctggcccctttcaattattcgtattggatttctgcactacccaaacccaaacttgcctggataacgactgctctcaacaaaagccttatcattctggtttgtttgttcttccatatcttgcgtgacacaccatgccgtttgttgttcttgttttcttcttttgtgcagctctcctttgcgtcatgggatttgtttctctatcctatcctatgtgctgtacaccatcccgttttgcgcaaatcctttttttgtgtgttgggccgcttcggctgctgcggttcagtccttttcgttgcagcaacaatgagttctgtcaaaaatgaataaagttgtggcatatgttctgaagaatataatatattccctgtgtgtgagagagaaaaaagggcctcatcttttgttttgtccctttgatgacagctctggattcttcagtttggtctactgggatcatgatggtgatgatatcctgcagggcaaccatatcaccgtggggcagcgcagaaagaaagaaacaggtagaaaggtagaaacaacgttcgagcagcttctctctgttatgtttttcagattggagaatggaagaaatgcagaattattctccattctgcgttgctgaactttttttttctctgaaatgaattcaggtcagaggcattgacattgaccaggaagaggattctttgttcctcctatgttgtttgatgtgattcgtgctgtttatcagatgaacttgactgtaattaacagtggagaattctttctggtgaaattttcacaggaggaatcagtctctcgtcttggtggcggttcttgatccgcagaaaattgaccggactgctgaactaacgaactgccattattatacagtaccccgtgtgcttttcccgtttctatcgtctcctaagccattgaccaaaatttattgtactttaactacggatttactcctaattgaatacaggcgtacgcgttgccgagtcccgtgtgtcacctctcctgtcccgttcacgtttcgtcgaattatattattctgaaaattgtagtccgttttattcacgtttcgtcgaattatattattatggaaattatactccgttttttttatataacgccattaacctttatacgtttgatcattcgtcttattaaaaaatatataattttttttcaacttaatttatcatcaaatgtcctttaagtatgatttaatttttcttatatttacataaaaattaaataagataaatggctaaacgtttataaaaaaatcaacaatatgatacattaaaaacgaaggttgtataaataaaaagggtactgcctttttgcccaagaaaaaaaataaaggagaagagaagattaggtagagtatactcggggttttttttttaatcttttgtcgacgtgcgaaattcacgcatgcccttttctttccctgagctcacgtgcgtcagctctgagccgcccgagacgttgagatcccctgaggctgctggattttataatcctagttgtggcagcgttacacgtgatgatcgcgccaaggcagcatgggacaaagcgaaccggctaagttaaatccttgttgctgcggtgatgatttctgtgcacgagaaacggaatctgtgtgtattattgttttctggatttcgttgtgtacttgtgtaactgtgcacttgtatatactacgtaaactattacttaagttcagttgaaaattcggttcgattaggatatgttttaagttgtgtagaattgtgaaatatttcttatttaccttattattaataattatattattttctataagaagctttgttaattccattgcgcattaattttacttagagaaactataaattatgattagtatatatgatgatgcagaccctcatggtttttaaaaaataatacatccgtcctaaaatattgataactaaatagcaatactctaggtaacaatactttgagacagaggtactatgtttgttctaactagtataagcacttatcgtgaaaataagataccacatatattagctaaacttttaaaaataactcttaaatgaaaattcgatgaaagttctgacatatagaacaaaatatgttaaacttactattatttcgattatcttcgttgagaaactaaatctctctcactattacataaggtagggtttttttttcttgttctttttctatttaactcggtcaagtttatcactgtgatatttaaaaggtttagcatggtatttttaaatcctatattttttcattgctactatgtacgagtactatgttttaattttattttaattttagtttaagtagattgtgttttgttcaaccgcactcccactacaattttggctggatgcaactcaaaccagccacagaagatcggtctagcccgtgccaacgtgctgctcatcccaatgctgccgtgccatgccacgcaactaacaccatttccaattttccacccgcaatctatttaggatttgtttagtttcattttttttctaaaaacatactccctccgtactcgcaaaaaaagttaattagaacaacgacacggtctccaaaacacaactttaatttcttgtttctataaaaatatttattgaaaagtgatatatgtatacttttatgaaagtatttttttaagataaatctattcatataatttttacattttcaaactcaacaacttgatagttattcatgatttatattcctaatgtttgacttaaacattatcctaaacgacttcctttacgagtacggagggagtatatcatatcattcgacacatgcatgaatcattaaatatagataaaataaaaactaattgcacagtttgtatgaaaaatcacgagacgaatcttctgagcctaattaatccatgattagccataactgctacggtacttacatgtgctaatgacggattaattaggcttaataaactgggttaataaattcgtctcgcggtttctatgagttatgaaactagttttttcattcgtatccgaaaacccctttgacatccggtcaaacgttcgattggacacccaaaaattttcttttcacgaattaaacacacctttatcacttctatttcgaaaattcatttttagaaatgcaaacaaaatatatactccaactgtttcattataagtcatgactttttttttcaaaattctttatgtttaaccaaatttataaaaatattagcaacacctacacaaaattagtttcattatatttaacattatatatatatattaatgtattttaattaaaaatattattatattttttataaacttgaagcttgaaaaaaaagtcaaatgacttaaattacgaaacacggatagatgtatacaagaggaaaatatatctcatatttcgaaaatctatttttcgaaatgaatagagagaaaaaaaaaacagaaagaggcttcgctttgggctcctactactacttatagccaacttccccgaaagcgatccctcctgctcgcgtcgcaacctcgccttattatttttccactcctcacctcgaattattccaataataaaaattccacccaaatttcctcgattcgattcttccagcgagctccgttctctcctctcccccctcctcctctcgcgtggttgcgcgtgcgatcggaggcggccgggctcgatcgatccgcgccgagatggttgccgtggcggcggaggccccgatccgcgccgacgccgtgcccgcggcggcggcggcggctgctgcggccgcgccggatgccgccccaggtgagggggcggatgcggccgcggcggtggaggcggaggcggcggggaaggatggcggggaggaggtgagggagtacaagagcgacgcgaggaagctggaggagctgttcaagaagctgaacccgtcggccgaggagttcgtgccgctggcgcgccgccgcggcggcggggacggcgcgcgccggctgtcggcggacgcgcccgtgttcgtgtcccccgcgatcgacttctactcgcaacacccggtgcagcagccgccgccgatccaggtgctccccgtggtggtgggcggtggcgggggcgcgggattggactccagcagcgacggatccaccaacggccagccgaatcgtcgggtaatcgatcgcctaatcgcgctgctgggttcggtgcgattagtttcgctgtggggggtttggcgtagattcattgtggcatgatcgatctctatcgatcgatcgatcgatcgattgggatttggggtttagggtgatgttgttgtcttcattgccggagttttggtctctgacgcgatcattccagaatgttgattcatgggcgaggggggtttagttctagttaggttatgatatttatgtgatcaatttaagacgaattttcctcgaggaccaattgattt

SEQ ID NO: 79593 - DNA, 2027 bp, Oryza sativa
ctggcagatgcatcctccttttacagttttgttttgctgcgagaaacgcaaaattggctccgacatacgtgttgaatggtccgcaaaattggctcctcacccttgcgcagatgcatcctccttttgcagttttgttttgctgcgagaaacgcaaaattggctcctcacccttgcgcagatgcagcctccttttgcagttttgttttgctgtgggaaattcggatttgttttgttttggaaacaatccgaaaaatccgaatacggtgcgtaaaaacggcgtggagtccggataagttacgcgctacttatccggttcggttacgcggagtagagatcgtgcgggcgccctgatcaagcgacctatctctatataaaccgtgccaccgccttcacacaacgcacgcgaaatcaatctaggatttgcctcctactctgtgctgcgccgtcgctcgtatactactccatcccgctcgccgacgtgcaccggcgatcgggagagcaggtctccggaacctctgccttcgacgttctgcaccgggagaaggcggcaataaggtttttgggaagcgcttcgcacgactgctccctgttcgtccgcgaaggcttgccttcctctccgctcgcgtgctgcgcgccttcgtcgtcgcctgcaaccacgagtagttcctgccgagcaaccggtctttttgccacctcggtacgtgttcgacatgttgcgcatatttgatctatttatgttttactgcttagtttacatgtgtagatctaatgatgcgttcatgctagtttacatctgcaatgtcatgatttatttatagaataaattaaattattatgtgcttataatttcaacctcaaataagggagaatggcgctaaaagaaatcaacaaaaaagtagtactcctagtacaatgctagtactcgcacaagacctcggaatggcgctacagtgcctattccttggcatttgcatcgcatggtgagattgtcagcttgtgagacccatcacagggtcacagaatttgacgaggcagcaacaaatactgctctctatcgatgcctttttggctgcggtttgcgctgtgatatccctgacggattcgttcgttttttttttttggggggggggggggggggggcgccggtgaaacggacagcagcaaagaccgaaagttgtcaggcaactccctgtattcattcaacaaagaaaaaaaaaaggcgccgaccggttgctggggtggggagttgagcccaatcatttcacctgccgattcacggtcgtcgtcgtcgtcgccaccgccaccgccaccgccgctgcaaattttggcgtcactcctcacgaaatgcaggagcagcatatcgccgtgtgaggccgagcgccattttgatgtaagaaacaattgcaaggaaatgaaactgcagtaggaggaaagaccttttcgcttcagataactctcacaggacgcggcagctgatcatgtacagtacagccttaccgtgctgcaattagcattttatccttttaaacaactaaattttacgaatagatccctataaatcttactccatctattttaaaatagaaaaaaaaaactatcgcggttgtccgaattacccctaaaccacaaaaccggacattcttcacccccaactatacaaaccggatgaattacccccctcgacccaatccgcggtggttttggtctacgtggcgtacgcgtggcagtccagtcagcattctatatttttaaaaatatgggacccacctgtcatacgctctctctctctctcactcttcatctctctcttctctctctcactcccctcactcttcctctctctctctcacggtcagcggcaggcgggggcagcggctaagggcggcagcctcggggcggcggctgaaggcggcagaggcgctgccggtggtggtgctgccgtcgcgtcgccgctcggcctagacgacaccatcgccaccgatatgaccaacgttggccggaagcggaagcgaggaggaggggatggg

SEQ ID NO: 79594 - DNA, 8583 bp, Oryza sativa
tttcgggatgaatttatcaggacgtgacaaatccaccccccttacaagaatctcgtccccgagattcgaggaggctagcaagaagataggttgggcggtcttctcttcttgtctgacttcttccgtcgcgtcttgacaaacttccagcaaaacttcaccactcggaactgcttggcttgacctcctgttgcagatggaatcttctcttcacctgacttggaccagggtgcaccttttggctgactcagactaggttgcggtagttcagtgatgcttccgttccagaacttctcatgattcctatcttcggagtcaacctcggacaagttaccacttcacgtcatgcgtcaacactagcttgtcattactaggatactatgtttgtcatcataagaatatcatgcttgtcattcacttctaacttgccatcaactgtctcatattagctttcctggtctccagtgctaggtacttctgctattcgatgccagggtcaaccactctaactataagttatgcttcccaagagaaccatcttatcccacttgatatacttttgacgtcttcccaaataggtttactgctggacttcttattgtctgatcgttatccggccaaatttgaagcttcgttgttaggtgtgattttactctgacctctgtagactaccttcgaacatatcacttggttcataactgggaatagctcccacgaacaagcaactccgattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgggtagcatctgataccgagtggaagatttcactctttgccttcatagaaacacttttacctaggtcatcttgctgacttaatgacaaggtgactgttgcgggggggggcaattactatcaggggtcttctttgagcgatgctgagcatgtttctgtttatcaatcacctttcggcctacttctttcatgctagagaacatctttgccaatctcttttatcaatcttctttcggcttatctctaacaggtggtattctttaatgtggattgctgacgcttctggggatgatgaggtcctttggcttgctgcctttcagtgaaaccttgatgtggttcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttaactgttggcaggtatatccgatcttatcaatgtagaggcatggcgggtacccttaggggtttcctccaacactccttatcttgatctgtgaaaggcgtatccaaactcctatcctcaactactgtctcgttggctttttaacccaacacagtttaattgtttttcttttccattcacaggttggttattaactcgaggttagaatatagttcctctgacacgagaccctaggtctcctttgtcagtaaacaattatacacatgatcacatatccgcatctttcaaacgaatcctcatggaacttgtctgtattacacatttctcccttattacatgaatacgaggcactgccttaaccaaaaagggacggtgcttaacatcggtacattgtatcctcaacatgaatcatctctaaacatagcgagctcactgtttacagacatgattatatttatgaattacatgattgctgcaaactttcgattacaccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagttttttggagtaatgcccttctccactgcagttgtgacaaacaataactttcttacactcgggttcttcatcttgtacttgatttctcagctgctgtattggagcttccaaaggtacaacgcagatactggcatctgtcttgtcaactggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacctgaggttgcatctgactcgggttcaaaattggcatccgatgctgctgtagtatctctataagcaatttgttctggttaatcaggtgttggaccactgccgcacaactggtgtcttgtgcttcattcactcgggagcttgaggtaccaatgtcctgactcctgaccttattgcctttctcattgtcagccatctgttgcaaaggtttggagagggagagagggaaaacgaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcctccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgaccatcaaaaataaacagcagcggactagcgggcctacggctccatcttcacaggcgctcaactggggtataagccaggactccacctaagacctctcctccaaagcttctcttactgaagagggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccatcataagccaaccattccatggtgtccaaatgatatgagaatttcccaagtctaaagttataaaaaccacctaatgttgcctaattaatcagcgaagcatctacctaaattcatacttgtggaaccatgaatagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccactcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaattttcaattaaaaaaccggattattgcgtcagccgagggagcggggcgcgcggaccgggtccacgggaagtggggcccacgcgtcagccgctcggtccacggtggaccgggcgcacgcggctggcggcggtcggcgccgtgggtcccgcgcgtcaaccgcacccgcgggcgcgggcggctgacggccgggcccacttggcagccgcgagggcgcgcccgaggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggagcggagcggcggcggcggctaaccgaagcacggcggcgacggcggagagaaggtgctacggcgcgagcacgattccgacggcgagagtgagcggcgagcggcggaaacgaaagagcggagctcggggagggtttaaatagcgccgggggaaggaaagagcggccggagagggaggaatcgcgcgcggaagattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcgggagaggagagagagagagggagtgttgggccgagccggcccaagagaggaaggggggggaaagaagaacttcttttaggatttttctttttataaaccttttcaactttgtttatttcttttcaattattatttgtgctctgaaaattccactaaaatttgagggctccttttagaccaaggagaatttaacaaaaattctccgggtaacatttgaatttttcttgtacgtattttagtgtttgccaatttcttttcgaattttaattaattctattattccttttagaagatgatttttattttcgggatgaatttatcaggacgtgacaaatccaccccccttacaagaatctcgtccccgagattcgaggaggctagcaagaagataggttgggcggtcttctcttcttgtctgacttcttccgtcgcgtcttgacaaacttccagcaaaactttaccactcggaactgcttggcttgacctcctgttgcggatggaatcttctcttcacctgacttggaccaggatgcaccttttggctgactcagactaggttgcggtagttcagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttctgctatgcgatgcgagggtcaaccactctaactacaagttatgcttcccaagagaaccaatttatcccacttgacatactttgacgtctccccaactagtcttactgctggacttcttattgtctgatcgtgatcctgccagatctgaagcttcgttgttagaggtgatcttaatctgacctctgtagactatcttcgaacatatcacttggttcataactgggaatagctcccacaaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacaatcaggggtcttccgtgagcgatgcagagcatgcttctgtttatcaatcacctttcggcctacttctttcatgctagagagcatctttgccaatcccttttatcaatcttctttcggcttatctctaacaggtggtattctttaatg

SEQ ID NO: 79595 - DNA, 4634 bp, Oryza sativa
cgaggccgccgcccccgccgccgcagctccgcgccgaggccgctacctccaccgccctcagccgctgcctcctcatcaccgtctgacgccgtcgcaactccgcgccgaggctgccgtcgtctaggctgagcggcgacgaggcggcagcaccaccaccggtggcaccttcaccgccctcagtcgccacccccgccgccctcagccgccagttccgcgtcaccgtccgacgctgacacagctccgcgccgaggccgccgtcctcagccgccgtctaggccgagcagcgacgcggcggcagcaccaccaccggtggcgcctccactgccctcagccgccgccgaggccgccgccctcagccgctgccccatcctaccgctgaccatgagagagagaggaagaatgaggagagtgagagagatagaagagagagaggaagagtgaaagagagagcgcgtatgacaggtgggtcccatattttttaaatatagaatgctgactggattgccacgtgtacgccacgtagaccaaaaccaccgcggattgggtcgaggaggataattcgtccggtttgtatagtccggtttgtatagtccggttttgtggttcagggggtaattcggacgaccgcgatagttcgggggtaattcgtactttttactttcaaatataagtatttctaagcttcaaaatatgtaccaccatataagtatttttgcactaatttcaatgcatgaaaaaattatatattttttagttaatgagatagttggaaaaatataagtaattcaaaacttgaccactgaagtaactaaaagagatttgttttctttatctttttaaatacctaccagtacttaaattttagaacaaatgaagtatttggcaaagaaaaagaccctcaaaactcgacaccaactacatttgacgtctcagtgagtgtttattgaaacaaatatcatctaataaaattgaaacaaataagagggaatggaggtgcattgctttgtcaattttactgctaataactggcaacttaaccagattttaggagaggagagtctttgaaggtgggtttcaatcaaggttgtcagtatccggatctgtattctattatcttacaatattatgatcctaccaagccgaaacgataccgatcccactattcattatcacatgatcctttaaaatcttagatagcatcccgattctacgatcctaaaaaatattagttaaaataagatggtttaaaaataatgtaaataaatatactcaagtttatacttaaatatatcaaaactaatgtggtttctcttgataaatgtctctttgcatgtcatatattattactatattttttttatatagaatggctatatgtaactaatacaaatattaaacttgaaaaaagaaaaatctcaaatctcatagtatcccatgctacgatacaatactactttaagaaaaacggtactacctagtatcctgatactgataaccttggtttcaacccaatgttaaataaggttggaaacaaacagaaaggaatgaagcagtgtatattattgccaagttcaccactaaataaaatgaatttgaagtaagggatggaggtagggatggcaatttcacccgcggggccgggtgatatttctgccccgcggggatgcggggccggggccccgcatttggctgggtacaggggcgggggaaacattccacccgcgggtgacccatggggccccgggggtatattaaacctctcaaaatataatccattgcaggcccaaaaagcccatcctaatgaaatactctggaatccggggtatataagaaaaaaatcctaaccctaccttatcctccccccaccccgcactgcttcccgactctagatctcacggagtcgcggtttctctcgacgctctccctcctcagtcacagccgccgccactcgccagtctcacctctcccctccggtcgacctctccccggtgccctcccctcctctgctctccccttcggtcgacctctccccggtgccctcccctcctctgctctccccttcggtcgacctctcctctcctctcccctccggtcaacctctccccagtgccctcccctcctcttccctccggtatccacccggcacaggtgcggcggcgatggtgcaaaggaggcggtggggtggcgcagaggccgcgatgtagaggaggcgatggcgcagaggagcgagcagcgcgcaggcttgggttcacggtgatcggagctgtgtaggcgccgggcgagcagaggattcacatagagaaatatttgtgttcttgctgtgttcttactgaattttgatggtcctatccaagtattcgtgcttttttgatgatgtgtgaagtatgtacaatatttgttctcgctgaatagcgattatcttgtatctttttttttgctgattggatggagtggctacacattgcggggccccggtcgggttgtaggtccccgcagcgggcgggggatggtttggccccgcatcttcactcgggggcgggggcggccccgttgccatccctagatggaggagatagaggggagttggtcccctcttggaggtcaatgccaatgctgaccctaggcaccaaggaacctagcagcgtcctatgccgcatcggtgtccactgtaatttcactgctgtatcctttctgataaagttaccccccactaactccttaagcttaacatgcaaagatgccacatcatcatccactaacaagatgccacatcatcatccactaacaatcatcacatttaaacatcatgcaaacatgctatattttatagtttttataattaaagagcttttcaaatacaaacatgttaaattatcatccaacagaattcacataatatttcaatgtatatctttattatgttttatgatatcctatatataatagttatataattcatcctcacttagttagagtgcttaaatgattaatttatggtccaaattatctttctcattttttcctctaattaagtcataccacatcaattgtttttagcctttagataattaatctacggtccaaactatcttcctacttttcttcttccataaagtcataccaccttactttttacgtttgaatcaccattctacatactatttaaatttaaattatcataaaccacattaatttacttaaactgatattatctagctatcttacacgttatttttttacacgttatttttttattgttatcatactaaattcccgcagcaatgcgcggggtttcacatagtgttttagggttctagtgccaaagatctttggtatcgagatgttaaactttaaggctagtgttattgttgcacatttttacaataagttttataggggtgttgtttatatatttttttaaaaaagaatcggatcacaaaagtaagctaattacttagtgcacttgggagtgaatttctttctccatctcaaaattatgttacgttaatacttacttcttccgtttcataatgtaagactttttagcattgtccatattcatctagatgttaataaatccagatcactatatatgtctagattcattaacatatttgtgaatgcgggcaatgctagaaagtcctatattatgaaacggagagagtaggtcttaagagcttaagagtcgaggaatcgtcgcgctgtctggtgctaattgttcgggaaaaaaaaagagagccgaggaatgctggaagctaaatgactttaggctcatttggtacatctcctatttgagggtttggtataggtgtagctccacgtggacaagaatctcgtagtaggacgacttgtatcaaacgggtcagtttttccttgagaataacgaaatgagcatatcttagctagttcgttttttttaatctggctagttagttttttttttaatctgtttatctaggttcaaattctaaacgtaatatgagtgttcgtatttacggctaactatactttcaatgtcaggtactatatgtgtcaacaatgataagcttatgataactttatcaatctcaagttatactgacttggtcttcgaatgtgctcatagggatagtatgtgtgtgctcacgtttatagggtgttcaccaatcttaagctatgccgaccagtctttgaaagtgtttatagaaatagagtccacctgtgtgtgagcacgtagtgcgtttttagggcaagagcaatacagctattgcacttgagaagccaaagccgctagctataccaagaacggtgtagatagggtcctccatagtacatagtattacatattatagtgggtcgtctcaccagtttttctcttctcacttcgcccctctctattctcttgtgtttccccaccgacaaacggagcgaggcgtcaggcactggtggagaaggggtttttactcccggttcgtaaccccctatgtagtcccggttttccaaccaggactacgaatccgggactaaagatcgctatctttagtcccgggtgaaaaatccgggagtaaaaatctatttttagttccagttaatgttaccaactaggactaaagaacaccaaccgggactaaaaagactagatccggtagcacttt

SEQ ID NO: 79596 - DNA, 4799 bp, Oryza sativa
caggcctccgcgcccgaccgccctcggcctgttagagaggagaaggagaggaggagaggaagataaggttgaggagagaagttaaaaggagaggaggagataaggttgaggagaggagagaggagttaaaggagagaaggagatacctcgatccgatcacgcatgcctctccgatctccacgtcgatctttttatggcgatcttttttcccggttggtgttaccaaccggaactataaatagatctttagtcccggttggtaacggttaccaaccagtactaaagattgaaaagtactctggagctttcaaaacacaaccgagactattgtgaaatctggtcgaccgactaaagatggtttctccaccattgaggcggcaccacatctccagacgacggctgccgagcacacgccgcctagctcatcagatatgaagtcgggtggcgacggcggtttgtcgtatgatcgagcgcatatgtcgtatgatcgagcgcatactccgtactagaaaaaaaatatcatcaatggtgaattcgttcgggaacaaaacgttgacgacgcagtctatttaagtctatacagataagatcatctggattaccttaccctggggcacgcgtgtcagcaccggtatgctgaaagacacggcagtagatagcacacaaagcagcggcctttgagacaaatacatacggacacaggaaatttaaggaagcatcagttttctggaccaaaggcaggaacagcagaatgttggagtcctctgtacatggatgaggatgcactgcagcaacgtcgacctacgtgagaatcaacgagacagatgccctgctcgatctgctgcccttcgatcacgagagcaacgaccctcttgacgtcaacggcgccaatgtgcaggtttcaacgggggaccatgggagcatgcaaaaccatatcttggcttcaccttgtttggatatcaccaaatcgcagggcagggtgttcttgctattaatttatggcttgcactcatttgcaacattgggattaattccacaattaatcatctttcattctaaatgacagtttatttaatactatggacacattcttagtcattgggttgggaatagccttatccataattttttaaagaattcctatgcatggggtttgagcaaatactctctccgtactcgtaaaggaagtcgttttggacagcgatacaatctccaaaacacaactttgacttcttatttctataattattgaaaagtgatatatgtatacttttatgaaagtatttttcaagacaaatatattcatataatttttacattttcaaactcaacaacttaatagttactccctctggttccattttaattgatgttttggacaataacacggtcaacaagatacatctttgatcttatttttctattataatatatattataaataaatgcatgtttatttttattataatacttcaaaaagacaaatctatatatgttgttctagttccttttaactaaatatttttaaagttattgatggtcaaagttataaaagtttaacttgagagagtattcatcatttatattcccaaggtttgacttcaaaattgtcctaaatgattttctttacgagtacagagggagtattgaccagactattagatcatttagtgtgatcgaggaatatagtacataattatcggcaaatccccggatccctccgtgacctcccagcctttcgcaaattttaacaacattagctccaccgtctctccgactcatcttgccccttttctcctgtggctcgtcatcaaagaggggtaggagagggcttgggtctctctactcccctagcagtggccgttgttgttctcaaagccagtttctcctacgagctaggttcttcatgttctttgttctcttttggttctcgaggtggtcatcgatgttggctaccctcgtcccaataatgtggactagggttcccgatcttccgaaaggttctgataaacagttgatttgggcggagtcgcgacacaaatagatctggcttctgaacgaacacgctcttgagccctgcaatcgcagcaccacgtctcctctggttatcaactgtgtcgaaacgcggttgacctcgccgatcctaatccctgtttgtgaatcgaagaacacaaacaagaacaaggaagaatacaaccaaatttgcatatgagtgattaagctcacaagttggggtcttacaaaccgaactagcggcgaaactgttcttgaaagaataatctaagcaaaacccaaaccctaaaggtgatagcgggtacttatatatagagtcttgggtcgtacaaacaccccttgatgcaaccctaatgggttccaacacgatacacggcccaaaggcccacatacggtgatgcagcaccgggacagattctggacattaacttgttcggttgattcccaatgactcggaaagaattcggacatggaaccagaaccattgaaaatgttatcttcttagatttctatccatataaagaacaccccaatccgagcacgtatgtgacccgggcgcccgttttagtgcagactggtcctggactccgaaatatactcgaagtcgacttgatttgggcctccatcttgacttggacacccttgctgattctctatggctctaagtccctccctaagtgtctccttgtcctctccattgtttctaatcattaggtagcaatctattcttaaaatcatataaacaagaacataggagcgagctcacctctaaattcaattggcgcgcgcgagctcttgtaattggtccttgaataactggtggaggattgttgtgtgtatccgaaggagtgatgtcctcatcgcccaacctctcggtgagtgttgtcaaactcttttcaagtgacaatccattgcgtctttaggctactgcttctagccatcagctagctagggcacctttagctatgtaaagaaaggttgcaccagcctacaacaatttctccgacgagtacttttgtcatgggcattgggccagaaggcagaggcccataggcaatccatattaattatattagagataagattagattatgtccttacttaggggtcaagttggtaccacgtatataaggatgggattgtgtttattatgaataaaggaatgaatatcaattagtctaatctctcccttccaacaatgttcttctccctagcctggctatcttggtatttatcccgtcatggcctcgggtcatggcaacttggtatcagagccactcaccatggctttcgatgccgagcgagttcttcatgtcaccatgatcaatctgctctatccagtgatggaggatctactccatcaggtgttctatgtgtacgggagcgaagaagatctacatgctccagatgggaacacatgtggaggcttcaattaaattccaatcccatgcggatgcagagaatgcacgaaaagccttccatggctgttgtaggatggatctccagttcgagcagacccccacaaccagcaacaactcgtcgtcacctgtctccctagtcatgaaggacttgaaagcagacattgaggagttaaggattgttctaaaggaattggcaaccataattcaggagaaattggcgaatgaagaggagtggcatagcaagcaagaggtggcagaggagatgcatgcggagatggacgtggcagtgggcatggtgatgccgtcgccaatcactgtgcctccaactcagccagtgggtctggagatatgcgtaaaacgtccgtttttttgacaaattgacccttttggaaaacttatttcgaaactaacccctgccaaaaacttcaaccaaaactaggccgtcggctcagcgccaagcgcattggcgctgaggttggccgtgtcagcgccaatgggactggcgctgacattgtgccaccgtggcggccgggccgatcccctagctgacgtggcagctacctcagcgccaaccgcttcggcgctgaggtgcccaacctcagcgccaagtaagttggcactgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccctaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaaggggtgcagga

SEQ ID NO: 79597 - DNA, 2176 bp, Oryza sativa
ttctctttttttttttgtttcttaatcctggatagttctctatagaaataaagttccttgtctctaattttaggccactcactatttatagagttattatattcatctgctatatctcttaatttatcttcataatattttatttcactttcatgatctaatttttccatcaattcagaaatactatgtcttctgttatctataatatttctgtcagatgattctgcatccaaatcatccgaagctctggttttataatttgtaaatctaatactaacattccctttgctatcttggtaacttatgaagttttcaggctgactcaaggttttattttttataaattcactaattggccatttttctcctgctctttcttcagagtctattgttaaagggctcatgaattttattcctttagaatgcattttttctatcaaatcatttacattgattttgtatttggaggcacttctattagtcaatcttcctataaattctatacttattaataaatttgttcctttaaactcttcgtatccttttgtttgaaaaccaaaactcattttatctatgaattcatttacaggcatcattaaatcaggcactatataggttatcaacatattttcattcatatctccttctagatagcctaaagatgctttgtttattgtgtcccatcttttatctaataaggttattaacactttagctcctaatttctttcttgtcattcctttgattcctattatgtacataccttggtgaatatatttatatcctgaatattttaaactattttcaaattctttagctactatttttaattctactggttttgttagaacacttaattctacatctctagatattctatatagcccattcttattctcaaaaaatcccatgcagtatacttgttgaggtcttattgcccttaaagtatctcgttgatatctttcgagctgcttatctacttgtgcaacatctttcagctcatctatgtcatcatatttgcctttttgtttatcaaaacagttatcgtctctgcttgctattcttctaaagagactcctagatatgtccatttttcagaattaatggcttgtgaagatgagactatgccggatgaagccaaaactatttccttacctttactagagttgattttgtctggtaattctttaatataatcactattctatgaaattttattttgccttatcttataatcttctaataattctaatgtagtatttagcttattattaagaaaagaatattgttctacaaattgcttttgttctttatatatatcttctaacttttgctctaaatcttcctgtctcttaccccaatttatatagaaattatatattaaatctacaattaaatttagttggctattattagagtgccaactatgttcttcagtatggcttaatctacaccttatattgatattatctttgatatttattaactttccaatattagcttctaaatttagcttctctatgattactaggctctgataccactttactaggactaacactattcactactattcttagtgctgaattcactattatgagtagcagaattactgttcacagtcgttactgttcacttgaaaattttctttaaatttttaggatctttgcagggtggcggatccaaaaacagccggcgcttgatttagaaattttaaagtcctactcggtactagccgtatgcctcacttatctgcctatttaagcaaccatcttcaagtatccctagtcatatttgaactagctaagtgtttaccgtctccccaggcagttttacccgaggggaacacttctctacggatactggttctccagacgcctatacaagatgcaggttaaaaacgagaacaaccgagaggtttctcctatagggtccctagcataaacgcttgtctagagtattttagattttatatatatatatacacacacacacacacacacatacatatatatatacatacatacatacacatatatatatatatatatatatatatgtacatctagtacatatatatgtatatgtatgtatgttgtcgcgtgaataatccaattattttaggtaaagcaagcatcggtaaggttgtcatcgttgaggttggggctgcaggaat

SEQ ID NO: 79598 - DNA, 3406 bp, Oryza sativa
atttttgctggttgtattttgatcgagttattttttcttctggttttttatgttgacgtttttgttagagaaattgcttgccacgatctgtacagttctatagtcactctagtgggctttacgttttttctttgttgataattataagatgtattttgttacagagaaggagtagcttcaaccaagggaggaggaggatgggaggccgaccaaggcgaactgatagggaggatagtgtgcggcgaactgtctatgtatctgacattgatcagcatgtgagaatatagtagagaatgagctgttacatttgctttgacatttattttcctgactgactgacctgaagcttgatccattcgtttacaggtgactgaacagaagcttgctgaagttttctcaaattgcggacaagtatgtttctgatattttaatattaattacatttgtgagaaaacggactttctcttttcttatatcttgaaaacaaacaagcaaagttggttgtcttgtctgacttaataatttgcaagtgaagagaatattactgttatcatcatcaacaccaacaatagccattagtttcaatcaagttgaagtaggctagagatgaaaaccaagtcaaaccgcatgaaccaaaaggtatatttgtactaaaaatataatagagattctgacagatattctgtagtaaaatactttgatgacttatgcatatttcaagctagaaaactaacatatatgtatagtattttgcagagtagatttaaattcattttggttaatactttataacaccagagtgacaaagagtgattttgcattgtaagtatggagcacaacttttctctatggtaaatgactaaatgcagttgggtgcaaccctaaagttatgattcagttgaatgccactctagaacaagtacagcagttactttcgacagctgcttgttttagattgtgaccttgcccggcctgaatggattgtgacttagcacctagacaagaccaacttgtcagaagaatttattattggcaggaggtaatagtttcggaaaaaaagggagatcacaagatgagaaatggaagaaacttgcaggaaagcaacagttaatattttagttgactagcatttgatagagccaatattctgtagttccattttcctgaaatgtttacttcagtatgctggtaatggtgttcgcttttttgtaatgtaaactgaatgcaattgctaggccaaaaaccgagttgtattgttttgtttgattaacatcatgtaaggtaattgcattagatgtttatgcttatgaaatagtaacatgatgtaaggtatctccaagttaattatggttgattgttaatggaagtcaaaatatgagtaaattgcgctcgtggtacatgaacttgcttggtgggtgcaaataggtacaacaacttgtaaattgctcgttttggtacaataacttgcctagtttgtgcgaacctagtacaaaacaacacacacatgcaaaattgatctaatgtgtagtaccagataaccagagtgagacatatgcacgctagcaattgtttgtagttgtgcagtcccaatcacactagcttaattttgaacatatcagtcaacaacaataattactatattgcaatctcttgtaggctgcttgcactactagagtacggattttatttttcaaaacaaaacaactactagcgcgcaaagatcaattttacttgtgtggattattttggcccatgttcgcacaaactagtcaagttattgtaccaacatgagcaatttacaagttgttgtacctatttgcacccacatcacaagttcatgtaccacgagcgcaatttactctcaaaatattgtgtgctcagattagtaaacatgagttgtataccctatttggcccatctacaataaaatgcaggaacttgacatcatgcgtactgagtgatgagctgagcaaagttcagtcacaaaacagtattgtttctgtactttttatagactttttcttaaatgaaattgatgcctcaaagttaaagttgtgctccgttgaactttcaagttctatttctttctaggaaatccagtaaactgatccttttgacggtagcactagtactacttttgtgggataactgctcactttcacttcctttttttttttttttgcatgtttcagtttctaaagtgtcaaccaagtccaattactggttatgacgtatagatatttggtagtaaggctttaataacacgcaactaataagactatatttcttcatccctgcatgcaaatggtgtgcctaatgtttgattcttagcagactggacttaatttcacaccatcctaattgacacacccattaatgaccgtcagtaggtgcctttcaagaaacataaggatgatgtttgaagccatatggtgtaaataggtagtttggcataaatatttcgcgtgccagttcatccacctaaaaattcctgaatctgcccctcttatgtgatgtttctgcatgggtaacacttcatgctaccttttgcctcatttgtcaatactacatctgttttcttacaaccatcttctgcacttataggtggtagattgccgtatatgtggtgacccaaattcagtgctgcgttttgcctttatcgagtttgccgatgatggtaattcaacgcaaaattcatctcgcatgctcatttgttgcaagaagcaatcctgaatgaagttccctttttcctgcagttggtgcaagagcagctttaacacttggtggaaccgtgcttggttattaccctgtgagagttctgccatctaagaccgcgattttgccggtgaaccctaaatttttacctcgagtaagtaaacagattcgggtattttgatattatactaattgatttactctgtagtgtaataattattgtactagttgatttccgagatctgtagtgtaataattaattggcataatttcgtttctctctcgcagacagaggacgagaaagaaatggtgtcaaggactgtgtattgtactaacatcgataagaatgtaagctgatctctctatcatttctgttatgcttataattgcacgtatgtattaaaccacatctaaaagtttggcctacaagatttagttcaattccctttgaatgaatgaactagctgaaggctcacaatatgtcattgttgtccaaatcacttcctaagtaacctgacatgctacaagcacttggcaactgaatgaatgtgataccagtgcattaagaaaatatcatatgtcagaaatacatattgttttgtttgcactgagaaatagtaattgtaaaccttttctgcagtcatttatgagctcatctttctttgaaaatgcaaattcttgatccatgatt

SEQ ID NO: 79599 - DNA, 24064 bp, Oryza sativa
actcatttatgctcaatcttttccctcttcagtaagagaagctttggaggagaggtcttaggtggagtcctggcttataccccaattgagcgcctgtgaagatggagccgtaggcccgctagtccgctgctgtttatttttgatggtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacacacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccatcataatccaacaattccacagtgtccaaatgatatgagaatttcccaagtctaaagttgtaaaaaccacctaatgttgcctaattaaccagcgaagcatctacctaagttcatactagtggaaccatgagtagagtgtccactagttgaggttttgtttaatctagggtgaacaaggtaataacaataacaataacaataataatatggtcgtaacaaaggtaaataggcatggctaaataaaacagtgacaacgcgggaatttaaataaagcgataatgcaataatttaaatcaacataattttataaaatgggattcaatatgatcaagatgatgtgtcttgccttgctcgctttcccaaacgacggcttcaacttccacgaagagcggatcttccgaagctgcggcgtctacacgaccaacggaaaaagaaaaagacttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaaaaacggattattgcgtcagccgagggagggggcgcgcggaccgggtccacgggaagtggggcccacgcgtcagccgctcggtccacggtggaccgggcgcacgcggctggcggcggtcggcgccgtgggtcccgcgcgtcagccgcacccacgggcgcgggcggctgacggccgggcccacttggcagccgcgagggcgcgcccgagggcggcctcgccggcgcggccgacgggagcggcgcgcacccgtgccccgatggtcgccgccggcgaccaacggcgcggcggagtggcacccgagagagaggagggaagggggaaacgaaggggacggtccacggctcaccccgggacaacgacgacgacgagaatggcggacggagcggaagaagacggcggcgcggctcgggatgacgatggcgacggcgctccgacggtctgcgggcgaagcggagcggcggacggggtcggcggcaacacggcgaagcggatggaggggtcgccgagtcaggaggaagtccggagcggcggcggcggcgggacggagctcggcggcgacggcggagagagcggagcacggcgcgagcacgattccgacggcgagagcgagcggtgaacggcggaaacggaagagcggagctcgggcaacgattttatagcgtcggaagggagagaaggcggccggggaggaaggaaaccggccgcggagatctcggccgccattgattgcgccggcgacgaatgcgggcacgattcgaacgaatccgagggagagagagagggggaatcgggggaaacgggagagggaatcacggggagtgattcccctctctttaatgcgcgcggggacggcgggatgcggcgcaatccgcggcggcggcggcgctagggcacgggcgcggcggcggcgcggcgggaggagggcgatgacaggtgggtcccacccgtcagcgagagcggcgggcgggcccgcctgtaagcgacgcgcgcgcgcggggaggccgatgggccgggggaaagagagagagagagggagggaatgggccgtgccggcccaagagggaaaaaggggggggaaaagaacttcttttaggattttctttttataaaacctttttactttgtttatttcttttcacttattatttgtgctctgaaaattccactaaaatttatttaagcattttaggcttttaggaaatatacaaaaatcctccaagcctcatttgacttttatctttgcacattttaattgttggaggctttcacattgaattttacttattcttttgcacaatttcgaggatgaattttagagtcgatttgggacgcgacaaacctaccccccttaaacggaatctcgaccccgagattcggaagaactggcgaagagatcgggatgggctgccttcagttcgtcttcgcgctcccaagtagcttcttcttcggcgtggttgctccactggaccttgcaaaaacggattacccggttcctggtcctgcgctccatggtgtccaggattttcactggcttctccacatacgtcaagtcttcgcgaacttcgatttgctctgagtcggcctgctcggatggcactcgaagacatttcttgagttgcgacacatggaacacatcatgcacgttgcccaaggaggcgggcaactccagctggtaggcgacttctccgcgtcgagcaacgatacggaagggacccacataccgaggtgcaagcttccctttcgtttgaaacctgtgcacacctcgcaatggcgtgacccgaagatacacaaagtcatccactgcgaattccagatcacggcgacggttatctgcataacttttctgccgagactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttgatagctgttattgtaggagaactcggcataggggagactcttatcccaagtcttcccgaaatctaggacacatgcgcggagcatatcttctaggatctgatttagacgctcggtctgtccatcggtctgcgggtgataggcggtgctgaaattcaatcgagtacccagctcttcttggagcttcttccaaaagtgagaggtgaattggcttcccctatcagatacgattttcttgggaacgccatggagactcacgatcctagcgaagtagagctccgctagtttattccctccataggtggtcttcacaggaatgaatcgagctaccttggttaatcgatccactattacccatatagaatcatatccaccttgggtttttggaaggccggtgatgaaatccatcccaatttcatcccatttccattccggcacttggagaggttggagaagtccggccggtcgttggtgttctgccttgacacgctggcacacatcacatagagccacaaactctgcaatttcccgcttcatgctgacccaccagtatttctccttcaagtctaagtacatcttggtactgcctgggtgaatggaataaggactctcgtgagcttcctgaagtatcagctgtttaagttctcggttatctggaacgcatacccgctttccgttccatagggttccgtgttcatcctctgtgaaacctgcggctttaccctgtttcatattcttgaggagtccatgcatgtccggatcattcttctgagcctcgcggatttgatcgagcaaggtaggcttggcttccaacgcagccaagaatccgcgaccaactaggcttaggttcagggcttccatctgttggttaagttcgggtggaatgcctcggacgttgagagtgttgcagtggctctttcggcttagagcgtcggcaaccacgttggccttaccaggatgatagtgtattcccacatcataatccttgatgagttctaaccatctcctttgccgaagattcagatccgactgggtgaagatgtatttcaaactcttatgatcagtatatatttcacagcggttcccaatgagatagtgccgccagatttttagagcatgaaccaccgctgctaactccaagtcatgtgtagggtagttgccttcatgaggtcgtagctgacgtgaagcataggctaccacatgaccgtcctgcatgagcacgcaccccaatccttggcgcgaagcatcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgatgaatctccggtagtatcctgccaaacctaagaaactgcgaatctgagtgactgtcttgggttgcttccaatcggtgacggcggtcactgtttcggggtccacagcaactcctttagcagatatcacgtgccctaagaatttgacttcggacaaccagaactcacacttgctgagcttggcatacaattgatgttcccgcaactttcccagtaccagacggagatggtgctgatggtcttcctctgattgtgagtatatcagaatgtcatcaatgaaaaccacaacaaacttgtccaagtattccatgaacactttattcattaagttcatgaagaaggcaggagcattggttaagccgaacgacatcaccgtgaattcatacagtccatatcgcgtggtgaatgcggtcttcggaatatcttcttcccgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttaacttcggccagttcatttgctgccatacggtagggtcgcttgtacagaggagtggttcctggagcaagatatatccggaactcaatctctcgcttgggcggcataccaggtagttcttccggaaacacgtctccgaactctctgactatggggatttctgacagacctatctgatgaagttctgaacttctgacagaggttggaggtgcaaagaaaacaaccggctgttccggtcctcggtacagagtgacagtgcgcctcgcgcaatccactactccttggaattgagccaaccaattcatcccaagaatcacatccaagttctttgtgtctaacagaatcagatccgagggaaaaggaatcccctgaatttctatagggacggcagggctataatactttgctgtcataacccctccaggggtggtgatgagcagagggtttctaagcctttctacccccaactgatttttccccacgaatggcacagatataaacgagtgggaagctccagagtcgaacaaaatggtagcagggatggaatgaacgaggaacgtaccaacgatgacgtctggagttgtcagcacgtcctcggccgtcacatgattcacacggccccgaatgacatccttcccgccgttgttggagcggggaggcacttggccttgctgacgccttggcttcgggcatttatccgcaaagtgcccgggctcgaagcagttgaagcacagccgctgcggaccttgagcgtccctgcgaccttgaacaggctgcacagttggcgtaggaggacggggtgcacgagtcccttgctgattctgctgctgctgcggctgtggaatgcgcaccacgaattgaggtcgaggcgcggagcgaggttgctgctgctgctgctgctgctgctgcgaggaggatccccctgggtagggattggtgtagcggaccctctggttagcaccctgctgattgcggaaattcgccaagcggcgcttgtgcgattccagctccttgtgcttggcttccaagcggatgctcttgtccaccagtcgttgaaaatcaggatagtccccagagactagacgaacggacagctcagggtccattcctgccaagaacttctcttgcttctcctcatcttcccgcacatcctccggggcataacgggctagattgttgaactcatgcaaatactccatcacggagcggctgccttgcttcaactctcggaattcccttttcttaagagccacgactccggcgggcacatgggttttccggaaagcggcggtgaagcgagtccaagtaataggttgcccttctggctgcgtagcctggaagtggtcccaccagagagatgcgggcccctgcagctgatgggcggcgaagacgactttctcctcatcgctgcactgcaccgtgtctagctttttccccacggcatgcaaccaatccaacgcatctacgggattgttggagctagagaaggtgggtgggcggatgcggaggaattcggcgagtttggagtgttggggagggggtggtggagcattctgttgtggcggattttggaggtggtggaggaaagcattcatcatgttggcttgctgggcgaggatttgggtgagaatggcgttggtgtctggtggtggtggtggaggtgggttgccttgggggttggggttgctgccctcgggttggttgccttcaccggtgttaacatttctcctggtcgtcaccatctgaaaaccccacacagaaccagcaaacagagaaggagagctgacgattaaaactaaccacccacgactactataaatcttgaatttatcactgctattaaattggttcattaatgttcaagttgcttaggcaaacaaataaagacaggccccgacatagttacaccacacaccggcgtaaccatgccccacacgactcaaaaagacaaacgaggaaaaacacacgcgcaagcctactaactgctcgtctaccgctgcgacgggccaggacggaaggtgagcaacagcgcaccctccgagctaccaacgccggaggcttccccctcctgaggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcaaattctcttggcgcagctccaggatcttcatgttgttctccaccatgccacggcgcaccatctgatggaagtcaatacgagctgcgtcgtatgcctccaccatgcgtgccagatgcacgacggtagcgtcatgctccgagctggcgtctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgtccaaaccacgacgggtaacgctgccggccatctacaaacaaaaagaaaagcaacatttgaaagatcagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaataacccaacgggcattccttacgtgcgtgcattaatccttgtcccaggaggcaaggtacaccaaaagttgatacaattcagagtttaacaagcggaagcgtatataaaattattacacgggcagcgaaggcccagcacacaaagacaacgaataacagcggaagactagggcgaagaccacaggcgcttgacggcaggcacgagatatacaccgaagccttcatcttcaagaagctcctcatctgggtttgggaaaaattgagcaagactgagaacaaccaccgtacccaacaagtcacacccacaaatgcagaataaatgcaagggagtacaagggaattataatataaggggttagagttgcagtaaacagcatttgaagacgtttagttgctcaagctattttgtaaacacgatcctagagctatacactgttattaatcaaggccgtgaaccctcacgaacctgccttaacccaaggcctacgatgattcagaccgaactggcaacccgacctgggtcccagctcgtcccaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttgtaaaacctcctaatgttacctattaatcagcgaagcatctacctaaattcatactagtggaaccataaatagagtgtccactagttggggttttgtttattctagggtgaacaaggtagtaataacaatgacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttccccaatcgacggcttcgacttccacgaagagcggatcttccgaagctgcagcgtctacacgaccaacggaaaagaaaaggcttttactctaataaactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaaattttaattaaaaaacctatttattgcgtcagccgagggaggggacgcgcggaccgggtccacgggggtggggccccacgcgtcagccgctcggtccacggtggaccgggcgcacgcggctggcggcggtcggcgccgtgggtcccacgcgtcagccgcacccgcgggcgcgggcggctgacagccgggccccacatggcagccgcgagggcgcgcccgaaggcggcctcgccggcacggccgacgggagggaacgcgcccgcgccccgatggtcaccgccggcgaccatcggcgcggcggagcagcgcccgagagagcggagaggagggggaaacggaagggacggtccacggctcaccccgggacaacgacgacgacgagaacggcggccggagcggaagaaggcggcggcgcggctcgggatgacgatgacggcggcgctccgacggtcggcgagcgaaacgaaggcgcggacgaggtcgacggcgatgcggcgatgccgagggaggtggcgccgagccgggaggaagaccggagcgacggcggcggcgaaccggagcggaggaaggcgacggcgcggttcgggatgccgagggcgacggtgctccggcagtcggcgggcgaagcggagcggcggacggggtcggcaaccactcggcgaagccgaaggaggtggcgccgagtcgggcggaggaccggagcgacgtcggcggcgaaccgaaggtcggcggcgacggcggagagagaggagcacggcgcgggcacgaaaccgacggcgagagcgagcggcgagcggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaaacgggagagggaaacgcggggagtaattcccccctcattaaggcgcgcggggaaggcgggatgcggcggattcagcggcggcggcggcgctagggcacgggcgggcggcgggcgcggcgggaggaaggcgatgacaggtgggtcccacccgtcagcgagagtggcgggcgggcccgcctgtcagcggcgcgcgcgcgcgggggagccgatgggccgcgggggaagagagagagagggagggactgggccgagccggcccaagaaggaaggggggaaaagaggacttcttttagggtttttctttttataaaccttttcaactttgtttatttcttttcaattattatttgtgctctgaaaattccactaaaatttgagggctctttttagaccaaggagaatttaacaaaaattctccgggccatatttgaatttttcttgtacgtattttagtgtttgccaatttcttttcgaattttaattaattctattattccttttagaagatgatttttatttcgggatgaatttatcaggacgtgacaaatccaccccccttacaagaatctcgtccccgagattcgaggaggctagcaagaagataggttgggcggtcttctcttcttgtctgacttcttccgctccgctttctataacaaacttgcctaacaaagcttctccactctggactgcttggctcgatctcctattgcagatggaatcttctctgcacctgacttatccctggttgaacctttagctgacttcgactgggttgcggcacttgaagatggggattcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagggaaccaacttatcccacttgatatactttgacgtcttcccaaatagttttactgctggacttcttattgtctgatcgttatccggccaaatttgaagcttcgttgttagatgtgattttactctgacctctgtagactatcttcgatcatatcacttggttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctcccaagacatggcgtcgcctggtaacctgggcttgcacttttcactccgtgtagcatctgataccgagttgaagatttcactccttgccttcatagaaacacttttacctaggtcatcttgcttacttaatgacaaggtgactgttgtgggggaggcaattactatcaggggtcttccttgagcgatgcagagcatgtttctgtttatcaatcacctttcggcctacttctttcatgctagagaacatctttgccaatctcttttatcaatcatctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcttgctatctgtatctatgccactagggtttagtgcttccttgggatggggagcatccatattgttcttctgccatatcacctttgacccttttctgatacctgatcgactaattaccaaccatcgactattatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctattccccaactactgtctcattggctttttaacccaacacagtttaattggttttcttttccatcaacaggttggttattaactcgaggttagaacatagttcctttgaaatgagaccctaggtctcctttatcagtaagcaattatacacataatcacatatccgcatcttccaaaagaatcctcatggaacttgtctgtattacacatttctccctcattacatgaatacgaggcactgccttaaacaaaaagggacggtgcttaacatcggtacattgtatcctcaacatgaatcatccataagcatagcaagctcactgtttatagacatgaatatatttatgtattgcattattgctgcaaactttcgattaccccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttctgcttggtatcgccctccggatattgattgcccttggctcggcctggagtaggtcggggagagacacaacttcttccatctacgacaattctttgctgaggctgtcgatgcagagagtggttgctatgatttattgccgagtcaggtgcagctggaggagcattggtgcattgtttctgctatgggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaatttccaaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacacgagctggcgacatgaccgatttctccacaacgagagcatgccttacgttccatttcatcttcatcatctgaggagacttgatctgaatcttcactatcagatactctacctccattagctaaaagatgctctgtcaactgtggtgcacctcggaaggtatttcttctctgacgtcttgtcattcctggtggaggccattctgtgctggtaatgatcatcttacggacttcatcttcggttcgcattggtgtttttcttttctgctgaggacgctcccttgcatagtgcacttgctcatcacacgtaaagcaaatgttacttgcttcttttgggtcaacaggtggcacgtcatcatgggtccttcgggatgctggcggcatgctgacttgtggggtgagtgcttggactgcctccaactgcacttgaggttgtatttgattcaggttcagcattggcgtctgatgctgctgtagtatctctataagcaatcggttctggttaatcaggtgttggaccagtgtcacacgactggtgtctggtgcttcattcactcgggagcttgaggtaccaatatcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggaaaagattgagcaagaatgagtacaaccacagtactcagcaagtcacaccggcagatgcatggttaatgcaagggggtacaaggagataacaataggggttaggtttttgcagtaaacagcatttaaaagtcacttagttgcccaaagccgttttgtaaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccatattttagtcgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgacgcccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaacataagccaaccattccatggtgtccaaatgatatgagaatttcccaagtctaaagttatgaaatccaactaatgttgtcctattaaattgcgaagcatctacctaaatttaaactagggataccacgagtagagtgtccactagttgaggttttgtttactctagggtgaacaaggtaataatcataacaataacaataataaggtcataacaaaggtaaataggcatggctaaataaaacagtgataacgcgggaatttaaataaagcggtaatgcaataatttaaatcaacataattttacaaactgggattcaatatgttcaaggatgatgtgacttgccttgctcgctttcccaaacgacggcttcgacttccacgaagagcggatcttccgaaactgcagcgtctacacgaccaacggaaaagaaaaaggcttttactctaataaactccaaataacaagcaggaacaaagcacaaaaatgggttctttacttcttaaggaaaaattagagacttgaacggtccaattccgagttcaaatggccaagatatggccatttgaagtttatatgctctttaaatggatacttgcgaattcttcatttaaattttaattaaaaaaaaacggattattgcgtcagccgagggaggggacgcgcggaccgggtccacggggagtggggcccacgcgtcagccccacggtccacggtggaccgggcgcacgcggctggcggcggtcgacgccgtgggtcccgcgcgtcagccgcacccgcgggcgcgggcggctgacggccgggcccacttggcagccgcgagggcgcgcccgagggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggaccggagcgacgtcggcggcgaaccggagcggagggagacgacggcgcggttcgggatgacgacgacgacggtgctccggcggtcggcgggcgaaacggagacgcggacgaggtcgacggcgatgcggcgatgccgagggaggtggcgccgagccgggaggaagaccggagcgacggcggcggcgaaccggagctcgtcggcgacggcggagagaagatgcgacggcgcgagcgcgattccgacggcgagagcaagcggcgaacggcggaaacggaagagaagggcacgggggacgattttatagcgccgagagggagagagggcggccggggaggaaggaaaccgcgcgcggaggtctcgggcgccattgaagacgccggcgaacttcgcgggatgaatccggacgaatccgagggagagagagagggaaaagagggggaatcgggagagggaaacgcggggaataattcccccctcattaaggcgcgcggggaaggcgggatgcggcggattcggcggcggcggcggcgctagggcacgggcggcgacggacgcggcgggaggaggaagatgacaggtgggccccacccgtcagcgagagtggcgggcgggcccgcctgtcagcggcgcgcgcgcgcggggaggccgatgggccgcgggggaggagagagagggagggagaagtgggccgagccggcccaagagggaaggagggggagaaaaagaacttcttttaggatttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttagtgtttgccaatttcttttcgaattttaattaattctattattccttttagaagatgatttttattttcgggatgaatttatcaggacgtgacagcggcctgggccgagcaggccgggagggaagaggggggggaaaggcagcccgggagagagagggaggagggagtgggccgagggaaaggggagcccaagagaaggagggagagaaggagagggagagaaaaagagggaggaaagggagacttttgggctgggcttggcccaaaggaggaagagagattatttttaggttttctttttttaaataaactttgataattgtttttgttgcttaataattatttccggtgctctgaaaattcaagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacagacacagattctttcacccaaccatacagttccgtgctcatcttccaagaaaccaatagcttttcctcttctcatattcttcttgatctcttgaatatcaggatcattaatttgggcttctctaacttgatcaattagagtgggcttcgcttctaaagctgcaacgaaacctctaccgacaattcccaaatttaatctttcaaattccttgcataattccaatggcaactgtcgtccttctgtagcattgcaataaccttttctgctaagagcgtctgctacaacattagcctttcccggatgataatgaattcccatgtcataatccttaattaattccaaccatctccgttgtctcatattcagatccggctgagtaaagatatactttaaactcttgtgatcggtgtacacttctgtacgagtaccgaaaagataatgacgccaaatctttaatgcatgaacgactgcagctaactcaatatcatgagtagggtagttcttctcatgcggacgtaactgacgagatgcataggcaaccaccttcccatcttgcatcagaacacaacctaacccaagtttggatgcatcgcaatatacttggaaacccttctttggatcaggcaaaatcaaaataggagctgatattaagcgacttttcaactcttgaaaactccgctcacattcttccgaccatttgtacttcacatctttctgaagcagtcgtgtcatgggcttagcaatcttagaaaaattctctataaacctccgataatatcctgcaaggcctaggaaactgcgaatctctgaaactgtctttggttgcttccaattggttacggattccacgttactaggatcaacggcaactcctccggctgagatgacgtgaccaaggaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattctaacaacccatacctagtggtaaaagctgtctaaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaattaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcatacccggtaaatcatctgggaacacatcaggatactcccggactataggaatctcttccaaagttatttgattcagtcttgaccttaaagactcagaagacaatgcatgaacggttacaactcgaccatcatagctgttgagagttacttttctgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcaccttgagcttctgcagcagcaatatgattgacacgggcctttgatgctggtacagcagagttactctgggcagggacaaccttcacgcgttggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatggactggggtcctaaagtaagacgcggcttctgattatttccctgttgtgtcttgaattgagcaatccgacgtttcttctgctccatgcgattgtacttgtcttcctgacgaatagccttatccactaatttctggaaatcagggtaatctccaaccataagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactacccccgatggtatatgcgtcttccggaaagcagcggtgaattcaagccaagtgataggttcagcagtagtcctgttaagacggaagtgatcccaccattcagaggcagggccatgcaactgatgtgatgcaaatgagaccttctcctgatcagtacactgaagtaaatccaacttcttctctatggcatgtagccaatcactagcttcaacaggattagtggtactagagaaaacaggcggcctcacacgaagaaattctgctaacttgttctgtggaggtgcatgattattcccttggttttgctgattctgaaattgttgcatcatcatgttcataagctgtgtctgctgagcaagaacttgggccagagtgggattctctccattgatgttattattggggttgttgggaccattcccattgctacgagtgttcaccatctggtatggataggataagaagagaaaacgggggaaactacttaggacagagaattactttaacttttattgatcttaactgagtttcattattacaaactgaagactcccacaccactaaactctccaacttcctaacactcaaaagcaaacaaacacatgcaattacatcccaccactgatgtaaatcacatgcgagacccacacacacaaacaaacttaaaacaagcaaactaacacaacgatctaagacaacgacttaacaagtcactctagttcttccgagcataggaggtcgattgaaggctcatcttcatcatcttgagttgctacccactcaatcttggaattgatgcgcttggattcttcttcttcatcactacttatgatgatgaccggaggatccgcttgagctggggcaacttctttctccaccacacgaacctttggcgccagttgatagcgagggacaaataaagctctcttccttgcggtaagacgaatcctggccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctggggttggcgaggatgatagcgatactcagtgtcgaccaactgatcactgtagcgatcacggagctctcctatggcgatccttgccacctcctgacatgcatggatgtagtttcttcctccagcttcaaacattactgaggggatatcttcactattgctgttcaaggtgactttgactcggcacttttcttcatgacgatcatgacgaatctgggcataaaaaggagcattcccaaatccaatgacaaaggacatcgtacgcaactcctggacaaaaccctcaacgccaaacaggtactcaggcttgtaacacggcatctaaagacaagtgaaaggagggagttaagacatctatccaattaatagcacaagtttttggattaatttgaataaaggtagaaaatcagaataaaaaggtaagtaaataaagtaaac

SEQ ID NO: 79600 - DNA, 13966 bp, Oryza sativa
ctatagattgactgcatcgacaatatagcaataggaaagggtcttaagcccttatggcatacttatatattatgagagtggttcttaattatagtagtcctttggatgagctaccgtatgcctaaggactaaccaccaggggtggataacgagctagcttggctcgttaagtctcggttcatttgagttcgttatctttaacgagttagcttgtcttggttcggttcgttaaggttaacgagctaaaagcctagccctgctcggaagctagcttgttaatcatcaggcttgtttaagtatttatatcatctttataatttttaatatactactttaccaactaatcgattcattaaacataaatagtttggatggaattaaaggacagatcactagttaattaagaaacactaagtatgtgaacataatgttgatcttttgaactaacgagctaaacgagtagctgtgagttgactcgttaagctcctgagctaaatgcttagcttggcttgacttattaagactacgagttcgagtcgatctgagccgagctcgctacagccgattcaagccacgagatttgagctttttgtccactataactaaccataaggaatacattaaggttatctctctctcccctttgccacccccctcgctttcttgtgtctttacttactgttacttttttatgtcttaataggtctcatgtctaaagtgcatctagagctcaccattatagcaacaaaaataactgaagaccattattatggggcctacccataaggacaatatccatacacattacccttagtgcccttaaattccatataggaaactaagcaatgagttcaaacctcgttttacttttcctttgaaaagcccaaccggcaaccatcttctctctctgtttcctcttatcccacttggaggattaacaaaatccccatgttaaatgatctctgaagaatatatgcataaggagagattatgtgtcgcgagtttcttactagtgataacttgcgactttgtgataacaacgaacctgacgttggaggaaagttttgaattcaacgaattatatcatgtttgtttatggctttatttgagaatcaagatagcttatacggtcgagtacggtactagttgactttagcaaaccgccaaacgtcgtaggtatggtgagcagaatgtcaacgaagcttgcttccgtaggttacatggaagttaaaagggagctaattaattaatcttcaccgccaaacgaaaaaaaagatctaattaattttgttgttattggagaaaaaagaactataatttcacgcaatgtcaaatctgtatgccaatggaccacatttcagatgataaacaacagttaaactaaatgtctgcctgtttcaagcagaaaaaactgcatgaccccatagaactaattcatgccatttgctcttggatcgattcatgatccattttgtagaaatcagaggacgcgcaaagaagactgcagtcggagtgacgctgctaagaagttgtaacaagactctgttagaatctactgtctttcgttaatgaaatgggagagggctagctccctctctttctaaaaagaaaatcttggaaattctataacatattttactggaatctttaatttctcagtgttctttaattacaaagctgtaccaaagtatacttgccaatctagattaaggttcaaatcaagaaatgacatgcaagtggccccatcgtatatgaactaatactaaccatgatatatactcctatatgtgatgtgatgatgatggagatctagttagctagcacagagctagctacaccggtggcagcgcctccgtcggcgacgactcatctgccgccggcgcaggtcggccgccgccgtcccccggcggcggctcgacctccgtccggcagagcgggcacgtggcgtgcgaggccagccacatgtcgatgcactccacgtggtacaggtgcttgcacgccggcagccgccgcaccgcctcgccgccctgcaccgcgccgaggcacaccgagcactcgccgccgccgccgtgcctcgccgaccccgcgtacgcgaactccgggatcttggccgccacgtcagcgacgccacgcagtacgtcgtcctctcgcccgccggcgccgccggcgccctcggcggctacgactggcgcacgcctccggacgtggcggttgcagtagaagacgacgacggcgacgagcgcgacgcccgtgaggccgacgcaggtgtagctgaagatggccgtccctttgccaacggactggttctcctgcggcaccggcggcggcatactcatcgtcgtcgagccggaacgcgaacccatggcgatggcgatggcgatggcaatggcggtgatttgagctttgtccgtggaggaatgagccgcggcatcgggtgatcggggagagataaggactgtggtgttgactaagtggagaacattattttttaaccagcgttgagaattgagattgcacaggtgtgtttgcagtgaacttcctccgttaaaaaaaaaaaaacctgagtttccatgtccaatgtatgactgtccgtcttatatgaattttttataattaatattttcattgttgttagatgataaaacataattaatattttatgcgtgacttatctttttaatttttttcataattttttcaaataagacggacggttaaacgttggatacggaaacccagtgtttgtcttttttaggacggagggagtacctctcctgaatgctgatcagattcagagaatcagagtggtatattatcttcgccccaaaacacttgtcattttgagttttttttaacgtttgactattcatcttatttaaaaggtaatagaattattatttattttgtttgtcaaaatacttttaagtatgacttatcattttctatatttacactaactttttaaataaaaacgaacggttaaacattaaaaaaacaaaacaacatctaatttggaatacagggagtacttatcacggacgagaagcgcttaattactagcgcgaaagtgacgcgttattaataaacttgttttgcaagtaactaatagttctccggtcaaaatagaaataacatattactttgactctatgaaatggttagttagggagggaggactatagcaaaatacacatattactaccgagattgctaatgggtgattgatcgcccctagtgatcagctcgtgccctctcccctccatccacctggtttttttttttggcaccgtattacttttctaatttagtaaatttatgcacagtttgtacacctcaagtttacatatctaaagtttagggacccaaagtttataagtcaaatttatatatccgattcaaatttaaatttgaattcaaatattttttatatatagtattttctatacatctaaagtttatacacctaaagtttatagacacaaagtttataagtcaaaagtttacatacccgttcaaatttgaatttgaattcaaatattagtttatagaccaaaagtttataagtcaaaagtttacatacccgttcaaatttgaatttgaattcaaatattagtttatagacccaaagtttataagtcaaaagtttacatatccgtttcaaatttgaatttgaattcaaatattttttatatatagtatttctatacataattttttccaactttgtttttttatttttttaaatttttatggtgtactatagtaggaagagaagaatgggaggaggaagggggagagaagggagcgtatagggaggggcggacgatcacccgcccattagccttaccctattactaccaacaatatgtgtaccgtgattcatttattgatggttgtttgaccattcatcttattattttaaaacagtgtaattattatttattttgttatgacttataccattaaaggtatttgaaccatgacttatatttctgatatttacaataaattttcatgacttatattttttatatttacacaatttttaattaggacaacacataaaagaaaaactacatgtactactagtagtaaggtaaataagggaatacaaataaataatggtaggaattatttttcttatattctcctatctccatgccttattaagacactctttggtattttctttctattttaggagctacagagataattctaaaaatacaaagattattttagcaattattctaaatacataagcaaatccttccgttggagttgggttgatttcagcctactttcttccccgtccaccgttgagagagaaggaaattggcaaaaatcagtagactgtacactgctacggaaatttatctagacgagactccctttagttagtttgccgatggaccataactacttccacctacaaaatttgatctctagagcacgttttaaggaccgcatacgaaaatcaattttcgcagacgccccccttaacatgcccgcatgcaagacctcttaagaagccacatacaaaaataccccactctttttactcccgttccctctctctcccactaaggcctcgtttagttcccaaattttttttcctaaaaacatcacattgaatctttggacacatgcatggagtattaaatatagattaaaaaaactaattgcacagttagggaggaaatcgtgagacgaatcttctgagcctaattagtccattattagccataagtgctacagtaacccacatgtgctaatgacggattaattaggctcaaaagattcgtcttgcggtttccaggcgagttatgaaattagttttctcatttgtgtctgaaaaccccttccgacttccggtcaaacatccgatgtgatacccaaaaattttcttttcacgaattaaacaggccttaagtctctccactccacttctatgttttttctctcccgtccaccactcctgtcccttctctctctccctttggactccctcgccttcccccccaccccctcctctcctgtctcctcccacttcctctcctctcgacgaggcagcaacgggctcaggctttggcggcggcggtcttgagctcgagcttgggcgtcagtagtgggcaaggatgagagcggcaggctcagggggaggaatcccactaccggcggcgacgggaagggcagaacctgtgcccctccccctcttgcacggatcccgcagcctctctgcccccacgagcgcagatctgccgcggggcgatgacgatgatggtggcggcggcgatggcttctggtttctagggttagagttccgaggctaggtttctattttcagaatttttttttgcgatttttcattttcgtagtcggacggcttaagcgcccacatgagaaaatcagattttcacgtggggttgctctattcccatgcaaaaatatgatttttgcagacacctggtgcatgtggataacacactctcgtgcgaatatcgattttgaccgcatggaaaaaaatgattctgtagtggtggtagacacacataggccgaccagttgtaattttgtctttttttagcaaaatacatcgtattatctaaaagaaaaccatcaatagatgtgtagacttcatgaaaggtttgtacaacagtttcactatatcacaaaccgtagctcgaagttgttaaaaacatttcacattttgagtaaatgatgtaaaaccgtactcgattttcttacaaaaccatatatatactagtactgtctatattggtggcttcacattaaaaaaagtcaaattgtttttataatgtgaactcctaatagagactcgcacaagtacttagaaaaacggaacaaatgatatgagcttaccaagttcctttaaactagcttattaagtcgcgttttcgtgcgactatatataacctatctcgctgttaaatatgtttacatgttatttatggttgtggatttatcttgatttatccttatgtgtgaataagtgtttgtagagcattaacgggattaataatattcatccaaaaagggagtaacaatattatcatatatcaaatatttaccgtaggtacatacaaaattagtatttgaacaataggcttgtagtttgaaacagctaacacatattttgacggaataaaatgatgagtgtaagaatcaaggttagggtttttattggtcttatctgctggtatttctccttcctatctttgcatctataaccgtcttctcttctatgtttcttgagttgtgtccttcccttatatatatcctcctttatatctccgcttatggtacatatatttttgtaaattcatttttgtttgagatgctaaataggtgttcaaagaggaattttagttataaataaatagatatatcttctaataagtaaatcttaccacgaaccaaaatcagagaattttgcttactgtctcatgaaatttcctaaattatgtgcccgcctgccaagaaatggaatgatctagtataagataattacgtagccgcttgccatgctctagtattcattgtaggtttcgaaaaaaggtgccaagcaaaatcacatatgtaaagtgcaatacacaatggagtaaattcaaaatttataaggtccttgatgtaaaaaggtgagtaataatatgggagcatttgctaaagtacttttaattttcaggggagcataggataaaatatactaaagatgaaaatgaaagaaaagttccaagagtcagatgtcacgaacaggtggcattaggacttgagagctagctgtgagctgcacaaccctctttctatctctctccctctctcattttctccgtttgccttgttaccgacgaggtttctctagttctctctgactctctctcattctctagctgctggtctccaatggacgagctaggcccgacggaaggtggacatggaagccaagaagacttcactcatctttcccttgttgtgctcccacagtccctctacgtctcatcgcttcctctcctgttaattgctgtcgtgagccgacaatgtcaatgatgcagcagtgagttagcgacgttgcaggtgaccacttgagcactggcggagcggctggatggtggcggcgatgatagcacaacagtggggactggtcctctctctctctctctctttttttttttgattttactaaacttttccagattcttctttgccccaagattattttcagaccatttatcttatcctatggctatgatatatactttctccctatattatcgttgtttgaatcagacggtcctatattatcgttgtttgaatcagacggtcattattttgttgcttgcgtggctcatcctcgtttcatattgagatttacccgttcatttgtttagttttggtccctatgccctttttccatagaaaaccaagcaatgagctagctcaaacattacttttatttcccttttaaaagccaaatacttctccctttggttctcttttcactcttagcttggagcatcaataaaattcctatgttaattgatcaatagagaagatatctctatctctactacttcaaaaatccatagtggtggtcttgattcctaacagagcagacgcatctgatagacacacgtaatctcaaccatccgaatgccatatccaacagcgtcaatctcctcccccatcacgcgatcgctcatctcctctctcggattgatctcctccccacgccgctgcgtcgcctcctcgccccgccgccgcgtcgcctcctcgccccgccgccgcgtcgcctcctccacgcccgtcggcctcctctccagacccgcgatcgccgccgccctctccaatctcctccgcgcctccacctcgcatcggattgatcctacaccttcgccctcctccctgtgtcgcctcctcacctcgtagccgcatcgcctcatcagcagccacggctgccggcctcctctccagacgctccctcgccgccgccctcgcaaatctcctctgccactacatgataattgagctattgccaccaaattattacaacaaaaaataatacgtagcaatatattatactattacaatgataatttttctgtggcaaataattattttttattgcaacgatctacaatcgttgttttatttagtacttttgttgcaatataaaatgagatatcgccataaaaaatcgtactgttgtaaaaaacatgttctatcgccacaattttaatttttgtggcaatttatatagtacatggtacttttcactattttttgttgccacgatcaacaaattcattgcaataaaaaaattgtcgtctcataatttaacttaattttttcatatggacacggattgagacaaattttatatggaaattatagctctcgacgagatctacaattttgtaggtgataactttttcatttgaaatcttttagatattcaaatctatgattcaaatcttagttagctaggctcaaatggaacgatatgcattttccaacagaattgatgcgtaggtgagttggtaaaggagagcacgcgtgaaggataggtcttaggttcgaatcctagccaagacacaaaatcaaaaaaataagtagataaatagataggatgatagattaatatttgaacttttaatttggtacgtaacactaatgccacatatggagtggtggcaataatttttattacaacgatgtaaagtgttgcaatatgactttttgccacatccattccgtggcaacatctaaatttattaccacaaaataaaaatcattgcaataacctattaccacgctgtctattaacacggctagcaacgattttacaattgtggtaacatgtatgtattgccacaatttaagtattgatgccacgatttttttcgtggcaacaaatgatttttctagtagtgtgcgcgctctcatccctcccttaaccatcaccggccgctctcatctctcgccaggtcgtccaccagcccgcggcgatctctcccgccggcgtcactatcgacgccttcctcgccgatctcctccgcgccctcgccgcccccgatctccgcctgggtgcccgcctccacgcctcccccaatccgcgcctccagatcaccgttgcccggagtctcatctagccgtctgcaatgggcaggcacgatggatcagtgtttggttctttttatggggtatcatcctgcatgtgcagaaaagtaaaggtgaaacacatcaatcctaactgctttttcagtttttagctctccttcgtggatttagtgttctgatagatggaagtgctgtttcagtttttagctctgtatttcatgggtttagggttctaatgagtggaattcctcccgttgccacagaacaagcgagcctagatgatggagaaggagaaccggtttggacaggatcaatccaattactaatgggcgtgcaactactactgcgacagcacagggaagtgtatgcatatgtttaggttttcagattaaaattttgattttacaaatgtttcagtacttcgactcaatgccctgcaaccaatcttgtattcaatccaatttaataatttacccaattgagtttaggatagtttaacaaatcaatcgggagttcaactatgaattgtttcgctgtttcaggtcttcagacttaactgaagtttcaatgtcgccgccagatcaccattgttttcggtgttttaggtctgactaataatttcttttgctgatcagacatggattgatgacctccacataaaaatgcatacaagtctaggctttatgtggagggctccatggatactaataactccaatgctaacatatcttctgaagaatgaggatgatggttttttgaaaggtaaggtatatttctgtctccttagctttccgagatatgctgtatggcacagcgaaaaacatctgattctttccgtcaatatttaattgacaaatatatgaatttcccctatttgttggactaatatgtgtggtgcaatatttacaactgttagataaattcccaggtaacatatgagtgtagctttcataaagctcacttcagattgtttattttcaagatagctgaacgtctgaaccgtcaacttgtctcaagtatgagtctgtagtaggtttcaaatgtgaaggttttactatagactaggaagatctaattcctattttccagtattctgctttgattgctatttgtcttccaatgcaacagaaaagtgcctcaagccacaatgtgttttgtatatatatagctacaactttgatttgagacatcggagagtcatcatagtttgatcatttaccacactttataaatgtaaaatgtaaaagagtaaagtgcacatgcggttcttaaacttgtaggggtgttttatctaagtccctaaactctaaaaatgcagatccaaatctcagaatttgtcaaagtgtgttgcttaggtcccaatttgtcatagcccctctaagatcctatgtggtgttgacgtggtatgccacaaacacggacgtgacatggcatcatcttgactgacaaatgggaccgacttaaaattcattttccttttttcttctttccttctcatttttctctctctttttttctttttttctcctttctctgtgacccgagcaccccgtgcggcggtggcctacagttgtagatagagaaaggagtataaagggaaaaaaagagaagaatgagaatgagaaggagaaggaaaagaaaaagaagaaggaaaaggaaaatttttaagtgagtcctatttatcagtcaatattatgtcacgtcacattcgcgtggcatatgccacatcagcactttatcttcaagtaagaaatggacaatattctttttttttgtctaaatacaaataataactagagtgacaatatacattttggttgttttgtagccctgtccagataatcaggaccacatgaagcgaaatggatggtttaagtcaagctaattttagatatttattattttgtgtatttgataggagcaatacatgtactttatagcaaagcttgttcctagatgatgttgtggatacatgttgattgatatttttctaatatctctttatcgtttttttagcttagctatatgttttatgtaccattgtcaaagcatattgtatcgctgtcatttggttgtttcatttgcaatattaattgtcaccgtttcagtaaaaaaaaatattaattgtcaccgtagcgttagcacgggcacactactagtatatgagatattgtgtttgcgagttttctgttctctctcttgtgatagcaacgaacgagaagaaagttttgaattcaacgaaatatcatgcatgtttgtttatggctttatgtgagaatcaaggtagcttatacggctgagtacggcactattgttttttttcttctgaaaactagtacggtactagttgactaaagaaaataaaaaaagggctaattttgttgctattggaaaaaaataaataaaattaaccacacgcaatttcaaatctgtacggcaaattaaggaccaatttttttagataataaacaacaattaaacccaggtaaaaacagaaaaaatgttgccctgaaatcctgtgatttcaaaaccaagaacgtatatattttacagcaatctttctcagtgttctttaattacaaatacaaagctgaaccaaagcacatacatgccaagctagattaaggttcaaatcaagaaatgatatgcccaaaacgtatgaattaactaatcatgatgtgatgtgatgtgatgactatggacggacctagctagctagctacagtgctacaccggtggcagcgcctccgtcggcgacgactcacccgccgccggcgcaggtcggccgccgtcgtcccccggcggcggctcgacctccgtccggcagagcgggcacgtggcgtgcgaggccagccacatgtcgatgcactccacgtggtacaggtgcttgcacgccggcagccgccgcaccatctcgccgccccgcaccgctccgaggcacaccgagcactgcgccgccccctcgccgccgctcgccgacccggtgtacgcgaactccgggatcttggccgccacgccagcgacgctgcgcacgtcgtcgtcctctcgcccgccgccgccggcgacgacgacatgcgcgcgcctccggacgtggcggttgcagtagaagacgacgacggcgacgagcgcgacgcccgtgacgaggccagcgcaggtgtagctgaagatcgccggccctttgaccaccggcggccggttctcatccggcgccactggcggcgtactcgtcgtcgtcgacgagccggaacgcgaacccatggtgtggtggcggtgatggtggcctagcttgagctggcccttaattatccggtgatcggtgagagagaaggattatggtgttgatgactaatttctagcgcggaagtgattgacgttattaatactaatagacttgtattgcaagtaactatagttctccggtcaaaatactatattactttgactcgatgaaatgagggtgtagttgccgataggactatagcgcaatacacataaattattataaatcagcctacagactccaatttcctcggggctgcctgcgagtaccgctttaaccaaatgatttggaataattaaatttaaaaatatactgttcattcaattttgtctcataaatattcgggatgaaaaaacctgtgcagaaatataccatcggtgttgcacttccgttgcacgaaaatgacgtggggatgacatcgcgcgcggacagtatcacgcggcgaaagaccatgcggtctcacgcggtaacggagtgagaccgtgcggtctcgcggaatggaagagcgagaccgaacggtctcgcagaagccatcagcgacactgtctaatgggtccatttgattagtgattaagtacctaattaataattaactaatactaattagtgattaattatcctaattagcgattaattaattattaactaatcgctaatgaggataattaaccgctaattaaatcggcaaggcatggtatcgctctttgcttaagcgatagcgttgattgcttgagcggtatcgctgtttgcttgagcgagaccgcgtggtctcgcgcaggaaccacgcaaggtcgttcggtctcgcattttcactgcgcgataccggtcgcaacgtcattttcacgtcattttcacgcaatcgttatgagaccgatggtatatttgtgcaaaagattttgcatcccgaatatttctaacaaaaaaattgaataaactgtatattttcaaatttaattctgatttggaagtcatgggcgtctctcaagtgtaaattcactgctacacaaagcgtttccccaggcgatcaatcgaatttttgcgtgcggagctttggcccgtctggaacaaatcgtctgggaaaatcacgattttcacgtgcgggtggcgcgccagcacacgaaaatcagattttcgcgtgcggtgcttatgccgcccgcacgaaaaaacaaaaaaccgaaaaaaaaattcaaaaaaaaagagaaaaccctagatcgggtcgtcgccaccgccctcgcctcgtcggcggcggcggcatcgccggtcccgcctcgtcatcatcagcgccgcctcctgccggcctcccgcgccggatccgtgatagggggagagcggccagtcgccggatctgggcagggacggccactgccaccggatccgtgcgcggacggccgcgggccgcccgtcgtcgcccgcccacgcgctcccgtcgccgcctgggaggggaggggaggagccgtggcagctcgtcgtccgcgcgctcccgtctgccggggaggggaggggagggcagccggttcccgcgccggatccggggcggggggagggcgg

SEQ ID NO: 79601 - DNA, 1885 bp, Oryza sativa
catatatatatacatacatacatacacatatatatatatatatatatatatatatatatatatatatatatatatatatatatatatatatatatatatatatatatatatatatatgtacatctagtacatatatatgtatatgtatgtatgttgtcgcgtgaataatccaattattttaggtaaagcaagcatcggtaaggttgtcatcgttgaggttgggccattacattaaagatgttccaattttcacccgttgcaacgcacgggtattttgctagtataattaaaagattgtaccagttaggctattactacctctatccatattgataatactattatactattgagagacgtctatgagatgggataggaactcagactacaactctaaacgataattttcttattttccataaacacgtttcccgatccgttaaatatcactccatttattccaaaatgtaacgattttaaccttttaaaggttgtctcaaaatataacaattttcccatcaacactctttccaaccaattacaacatttcaccatttaattttcacacaatactttcaattcttatccaatcacaatctttctctattaattctagccaattttagtaaccgttatattccgtagcagaggtagtatgttttttctaaaaaatatcgaaaagtctcttttaaaaaattaaataaatcaatttttaaaatttataatagttaatattaataaatcatgcatcaacgaatcattatgttgtcgtgttgctaaactagcaatagacacgcgctacgctgcgtgtagacatggatagaatcgaaatgagctcatgacatgcaacacataaattatgttcaatatatattagtagttttaatgtacaatatatacgctgtaaaaaattgttacaatccaaaatacgcatgacaagcatttagattataaacgaacgcccaaacgtctgcttgtttttgtttgtttactaatacattgacaattttgaaagagaataataagatcttgatggggcacacaacccagtttttttttttttatcaaatgcacaaacagggcctatttacatgctttacctgcaaacacaaaatagcaatcaatacatagcatatattattttgtctgtattattcttaaagttaaatattatcttgactccatcacacatatatataacactgaatgataccccgcgcgttgctgcgggatatttgtattgaaatagaatttaaaaatctaggtacactttgtgagataaaaacaatagtatgtaaagaagggaaattgccgcaatacaaactgcggtctgaaattctggatgatagtggggcaactttttgcacaatgcttcactttcagtgcattgagagttgagacctcatgtaaaacagcacgatagtacctgacagaaaataggagtatatttatttacgatgaaccaataggataaggttaatggtaaagtcagtggcaagagctgaatggttgtatatgttttttttctcatctgctgtaggctagctattcccgaactcagtttattatttatcaaacgctagcttccaaacctatgggggcaagaagaacaatactgaaaatactcgatatatatatgtagtacagatggaagtttgaagatgataatcatatctaaaaaaacaaacaggattcacctaagatacaaagacatgatggtacctcatatgaggaaatgggattcatgaaaagttgataaattatgcagtttctcagtacatgaggaagataaacttgatatatgaatcaatgtaagtttgagataaaatagacagtaacttatttttaagttaattagagaattttgagatcatactattatgac

SEQ ID NO: 79602 - DNA, 5180 bp, Oryza sativa
agcatcgactccttccaccggaggtactcctcggcgccgttcagcggcttgacggtgactgccgccgccatcgcctcgatcaaatccgcacctgacgagacaacaagagcaaaccaagcgtcgcgtcagcgtgagcgaaccgtggaactcgaaacggaagcgtttcttgttcctcttgagcattttcacgaacaggtggtgatcatacgagctgtactccgatgcggatcgacggcgatgttgatcgggaacctgtgtgttcgtacttcgtagttgttggcgaggaaggggataaataggctgttcttctgaaaagaggtaactgccgatttttctgccagactgatcgagtgccgatttttattttagatttaaattgattcaaaacgccgccgatttcggtctttcaaaatagtgacagtttttgtttgaaatatttagtttggaaaacataaaaagatggtatgtgccgatttgtttgtaaaaagcacttttatagtctcattaagttatttatcaaaattataaacttgttgtaatgaataattatgagcaaagttgtatgattatgttggaaacagagcggctggtttcaggaaatttcaattggtctgagagagctgtgaaagttctgaaaatgtttgaagcaaaagtgtcacacaatttcataatattttggacggaaagttccaatagaattgccgggttttatgttatatacgaatgagttctaaaaaagaaaaagttacacaaatgaggaaccggcccaacgatggcgggaatgacattacgtttccgggccaaaattgaagttaaatgttttacagttttccgggccaacattttacggtggataagttcacactatgtcccacaatttgtcacccagtttgatttttgtccttgaactgaaaatccaaacacaattcgtccccaaacttataaaaccagtgcaaacgagatctctcgatagtaagttgatgggctagtcggtacaggctcaagcatcaccatctcttaataaataaacatcgatataacgtcgagagcccctactctcatatccagcttaataattttcctacttggcccctgaaactgctagctggcacacatgggatctgtttggagggaggttctggcagctgcagcttctcctaaaatcttcagctgtaagaatctctctcaaataatctaaatttttacccagattttaagaatatatagttgtagaatctaaaaaatgaactagaagtcagaagctagaaaacttagctttttcatattcttatcagctatttctcgtaatcttcaactccctaaagccttgtttggttacgccgggatttaatctgggccgggaatgaaaagtatagtaagaaatttatgatagatacaatgagagatcgatatttattccggacctggaaccaatttactcatgatagggacaataagagaccgagaatcaatccactagttaagaggtgtggaaacaatccggatattttgttgtcttgtctctattatgagtaaattggtttccgacccgaaataaatcccggtccctcattgtatctgagttgaggctccccgcattctatacatctgttcatttcactcattctagatttctgcatatatactccctttctgcacccgtgctgccaagtgccagccactactgcaaactgcacccaccaaacacgtccactacgtacgtaccactacccccgccgtcttctccttctccactgcgactaacaaccataccccagcttctctcactctctcttcccctacaccaattcaagataagagagccaccgatcgatcgacgtccggccaggcgtcgacggtggtgccggccccggcctcatgggggcgccggcgaccgccgccagcggcggcggcgacgacgacgacagagacgtcgtgttcgagtacctcctttgcacggaggaggacgccgcctcggccgggtccttcttccagcagctacagggcccggcgcccgccgtgtcgtcgtcgccatcaacgacgacggcgacggcgccggctgctgctggtagctgcgatgatggcggagaggaggaggaggaggaggtggggacggtcgacgtcgtcgcggagctcatcggcggcgaggccgagcgctcgcactcgccgcgggcggactaccccggccgcctccggtccggccgccccgccgacctcgccgcccgcgccgactccgtcgcgtggatcctgaaggtgattttaaacctgattaggagtactaataatcctaattaaattaaacctcagtaactactccctttctgcttacattcacatagatacgagtgaatatgagaaatgctagaatgacttatagtgtgaaacagagcaaataatggacaaagtgtatgaggattaattaatacaaaacacaaattattagcagtaattaataatacttgtgtgcaggtgagagagttgtacggtatgcttccggtgacggcctacctcgccgtcagctacatggaccgcttcctctccctccaccgtctcccggtacgtatcttatacgtgcgtatatacgtacattttgtacgtgtgagttaatcattatctcaacccatgcatatggttcgttttgggctgtgtatatctttctaagtagaggccgggttaatataatccattatctgctggactgtcgtatatatgtatgtatgtacgtgcgcggtgtgcgtaccctgcatatgtatcgtccatcttaaagtatactccctctatttttttaatatatgacgttgatttttgttatagcctttgatcattcgtcttatttaaaaaatttgtacaaatcttaaaaatatgaataatgcttaaagttcagttagcgataaatcaaaccacaacaaaataatagaaatttactttaaatttgttaataagacgaattgtcaaatattatataaaaagttaacgaagatatacacacacacaattttgcgtggtttattgtctacaagtaattaagttgaatataatgtcatagaagtaggatgttcggcaataaatttagtctaagtttaatggtctaagaactaataaattttactgaaaattctaagtttaattggctttagagcatgttcataggtaaagccttccatttagatactattgtagacgataaaagctctaactaaaataaatttgtattaattacctttctttcattttccctattcccatatagtaaaattttctttcacaaacgttagaagttcatattaagatgttcagcttaatatcgatttttctctctcgttttccctctcctcttcatgtcaacaatttaccttattttccccaaaaaaaaacaaattaccttattaacaactggagtataaaacctgttattatttgttgttgtacatgctcatatatgtgtacgcgccacgcatgtctttttaagtttggagatagttgcttaggtaggtcaattaaacaattctcagttaagataattttggttgagtgagcactcgaaagtcgggacattgaaattggattaattagcttgcggaccgtactttgattaggccaatcatgagttcattttcttttctagtttaggtatacatgggcacttcacgtgcgcacgcacgaatttttttatttgttgaacctttttacttttttattttaaaactaaactcttttgaaatttatttgtaaatctgaaccttttgaccacgccagctcgacaaaacaacactggcaagccacctgcagcgaatatatcagttttgtcctgccacgtcagcgagagtggcgtggctaaataacgatgccatgccgtggacaaataacgctatcacgccagcaggagcagcgtggcggtataattttgccacgccagtttggctggtgtggccaaaaagttcagattttgaaaataaattttagatgggtttatttttaaaactaaaaattcaaatggttgtgttctagcactctgaatatctgattaattagaggtttaggtttacatggcaggcatacactttgatcattgaatgcaccaacatatgtatgtgcttcttctcaggatttaatcccaaggaaaatgtggacattcatatgctgaatcagggacgagatagaacctgtgggatgggctggttccatgcacgacaaccacaaggatgaaggatcctactccctccatttcaaaataaattaatttttaaaatttaaattttatctcaaaataaattaattcctaccaatcatggttcatgaatcgagaaattttgtccctcaattatctctcacatactcactcatgaatattgcttttctattaatgaggggcattatagttttttatcctactaattttaggaccaagagagcaactagctgcactagcaacactcgatttataataataaattattttttatctttaacaaaaatataaccatacgaacatttttatgcttggataaataatattgcattattatgaagttttataaatatattacaatataaatgtcgcaaaaaatgcactttacaggctgtgtgttgatgtccaaaatacatatagtcccatgaatataacttcttagccgagaacctggagtaaccaacaaaaaccatgtagtgcaatattactaatgctagcagacataccattaatcagagatataaaacctaataaaatccttgcactccctgtggtatatgaaatattgcgaagcaacattctttctaatcatcataaaggcctggatcacataacactaatattaactgctcttataggacagaaccataatattaactgatctgcaacaaattaatgtccctcttaatttccttggatagtaccctctcaagctagctctcataacaaaccaattaatccaacaaaaaaaaaaggctctggaagctatcatgcaattctatatgtgctggtgatcatgtggaaatcaattaatatccatgaaattgaatctacatggtacactagtacaaagcccagctataaggtggtccattaattgcacatacttcatttcaagattaaaggtgctcaccaggaccatatatgcaatgattcaattgatgcatgactcatcttgttcagttatatacataggagtgtatatatcatg

SEQ ID NO: 79603 - DNA, 29520 bp, Oryza sativa
agtttcagtgattaatcatcgtgagattctcgcgtggtcatcactagatgggaatgtagtgtcctgataaccttcaaattaaccttttgcctctgtcttgtccgtgtaggaagcaatcatcaggtgctaccggctaatgcagcaattgatatctagtaacaatgttgggagagaatcgacagagataacaatggcgacgacgacgacgacggcgacaactgctgtgagctcagaggaggttgtgtcctcttctcccccatcaaagaggaggaagatgtgaccaggcacatgacagaatttgatgcaacattgttaattttcagtgattattcagcatttgtgtttgtgatatacataggggtcctagtttaattagcagagtttggttttgtgatgttatgttcctgcaatgtttttttttttttttggcccttcctttaaccttcttgtagatagccctactggtacagttgagtcatcatgccagtggctgcaggttctgaactgccagtctgtgaaggaaacaaaatgagatagatttgtgcttgtccagttgtccttgctggattgtagtactagcaatgtgtgcagcaggacatgctctgattcacagaatatttacatggattggtgaatgaggccttgtttagttacaaactttttcttcaaacttccaactttttcatcatatcaaaactttcctacacacataaacttctaacttttccatcacatcgttccaatttcaaccaaacttttaattttggcgtgatctagacacacctggaaagggcactggagtgagctgaaattgagctggtcaggcataaagtcaaggcttggggtcagatactacattgttggctactccctgccaagatctgttcatgttcatcagggaaagtctgtctgctcctgatgagtgatgtgtagtttttttattattatttttttggcttgctcctgtgtgttatcaagtgaatccaaacttgaaaggggaagcataatgcctgtactgcgaaaggcacatgcagccataaggctttgtccatctcctgctggctcattgtgtatttatgtgcaaacaaagatatcagggcatttgggggacttgccataattttttgatatctgtactttctgtattggttatcattacattcatcgataagaatcgtacatctatctatacctatgttaatatggctatttcttatgagctttcacattaacaaaacgaccactgattagaatgatcgaattatcgtgcgtagatcgtgttgggagtccatgtcaaataaatcacacaattgaaaatagcatacactataatttaatagttctgaatttgtaattaataaatacattctatattgtatccatcttggatctcaatttaatgctctattaatttaattctcaaatctgaaattaataattattaagttgtaattgaatggtcacatggactccttttttaatataagcacatataatttcaagagcaattttatagtatttgaggaggtaacatgaggtattactttttctattgtaaatttagtacatcttggtatctatgtactaggaggtacaaaactttacactaaatacctcataatacttactcaagaaccgtaaaattgctctgagtacttgagttttccactcaatgagtcccttaatagggatggcgcctagtcaaaatggtgagatgttgtaaattggtgaaaaacaaagtctcggaattttcaacaaagaaggtaaaactaaaggtcataagggagaaatgtagtatccgtatatccataaagtaacttcaagatgaaacctactcatatttcatagtaaaatataaaaacaggagtaaattgcatattgggctatctatggttaccaagttttcacttcagatcatcctctcaacaacgttttcacttcggactaggaataattacattttgttacaatttggaccaccccatcccactccaactctttcttcttctcatgctctagctagttggtgtccacaactccaaatcgagctttggcagttcactggcgagctggtggtgtccacatcgtggtgtaggcaaaggttgggcatgaacaatttgagcagccaaagtgtgggaagaagaaatggatggagagggtggtccaattctagctagtccaaagagaaaacttggttaaaggattactccaagataaaactttggtaataataggtactctagaccaatgtgcaattcacttaaaaaatgtttgatgaacagaggacaataccattcatgaagtatctttttgttcatgtcttataaaggaggtcaagattaatcttgcactttttgaaaatccttccacatttaccctagtttgacaagtagtcaagtactccaatttacaataccagtttggattgctatcagatttaacataccgattttggtcaagaccaaatcccaattgcaacccaaaccaaacagtggctaaagcatggggtttggtaattttcactaccaaacagtggctaaaccatagggtacgtagtatttgcgcacaaatgcattactgttcaaacatttgcaaatctgaggatgcaaatagtacttctcctggtgatcattggatcgaatagccgaaagcaaagaaacatgtctgcaggtccgtcatacatctctagtagtattgtgtgtcatcttgtgtgcttccaaaacaatggaggaagcatgcagcaaaccaactcacaaggggcgtgtgacatgacatgacccaacaagggccaaaggcagccagccaagcagggaggcggaatgacatgtttcttcccttcaatgacatatctgccgtgagggagatacttaatttaaaattggtttttttttaaactaaaccggtaggagagctgccaattatatttttaataagcaggagtaaaaaccctagacgggttacaagaaaagaaaaaccaaccaccggctggctgatcaacagttacacagcacacgccagaactcactaacagctgaaaccactgacggagcccaacgtaggatgtcgttaccaacgttgaccaaaacaacatagggggttccgactttacaattgtgtcatcgttgccgagcttgccgccaagcgacacaacagctccaacttcaaaccggatgcaccatcagaacctagatgctgcaaatgatcaagtggcttcgacttctcacgatgaacatcagtcaaagccgcctaagcgccacaatctattcacggccaacaacaaaacccttagaaagaaaatgcagtgtgtcattgttgcccagcttcgtcactctgacaaagcagctccgactctatctagcaaaatcaaacaaagagcgaggtcgttcaccgcaaaacaaaaggtggagctagaaagcgaaggcctagtcaaaacctagggctgaaaagcttcgaagcaaatgcatagaccatcaacgacatccttgcacgaagaagtttcttcaaagcggtgcccccaaggaggacgcgacgtggatcgccgccaccgctcgttcagaagccgaagcaaggttttcacctggagaatgttaaggaaaggagaggggtacgctaaaacgacgcctccaaggaggggaacgacgccaaaaggcgtcgccgtcgtcagccggccaaacggctcggcgaggctttcgccagcgattccctgtccaaagccccacaaccaatccgcacaagaaggactgtcgtcggtcgacacattgtcccttcagcgatccggcctaggccactgccacatatcttcccgccgtcgacgttgcgcctacacccggtctccttccccacctccacatgttgccgccgccgccgacacaccgtcagccccttcggttgtgatggcctgccaaccatcaccgcaacaggcgccaccgtcgccagccgccaccgccaccgccaccgtcgccatccgccaccgtcagctgccaccatcgccagacgtcgccgccagccggccagatccggcctgggtggcgcggatctggaggtgcagcgcgccgcgcgggtcgtcggcgtcgtggagggagcgtcgacgagggtgtcgcgccagaggtcatgcggcgaggtccttgacgagcccggccggtgtcgcaacacgcgccgcggcccgccgacgtcgtcgccatatccgccaccagtgccgccgccgccacaaccgccaccagcgccgccaccaccaccgtcagcccccgccacccggccacctccctggcagatctagccggacacagcacggatctggccaccaccgcagccgccacggacagctcccccggcctccgagcgcagcgtgggcgagatgaggccctgccgccgccgtccttgcagccgcgcggctttggcggcggtgaggcggaggaggaggcggggagaggaaggcggtggcgggcgcgtcacctcccgagccgcccgggggagggcgatgtgggggtcgtggattatactaggacttaaaggacaaattggttttcttgtgagttctgttctttttacctgacattctagacaacgacacattatatctgatctcaaatgtaggtatttcattattgctattactaaatatatatctacaaaaactattaaaatataattacatgaaggtatttatattaggaaaacgtaacaacctctatgtgcgcgatccggaggcgaccgcagatccagcgttgcctggcctccttcccaccatctatcctgccgccactggaaaaaccgtgcggtgagcaaggagggtggtgacaggaatgaccattggtgcccttaatctcgtacgcgggtgacgtgtggtcgtggatgaagcccgctggctgttgcagcgcggtacgatggcaaggtgggtagccagcgacagctaggataaggtggaggtgacgtgtggtggcggcggtcgcgggggacagctccatggtggcaccgtgttgccaagcggcggcaacccaacacgacgacgagtgcgccgggagacaatagccgcctatcccttcgatggattttggcatatccgagtttggatctggctatggatattgatctataagctggtgccaaattttaaatcttaaaatttgatttttgaagttttttatttttattgaagtttatttttcagcattgattttttaaatcagtaatagcaatacatatataaaagtttgattttattttattgctaataaaccgtgtggcttataatcagcaatagtcctgataactcaaagttacacaaacactctcttgtcccagaatgatgcacactgatttgtcagccagagctgcagatcaaactggggcacgggcgctccccacgcgcgcagaacagagcaccacgaagctccaaacacattcctccatcatctcatcttttgaccggtcaccggccggccggggacctacgcggcggccaccaccaccaccaccggcagcgccatgacagcctgaacttgtgtttaagtaagccccaaagcgtagcaaagtattgcaggaccaacgaaaaggtgaggctgtgctttgatttgatcttcttttttgtgtgcatgaccacctactatacctctctttgattctgcaactctgaatctgaaacgcattgtgttctgacattgcaggtttctttttttttttttctctttggcctctggggctctttcatgattccaaaagtgcaatgttgcatcactggagtgaactgattgtttgctttgctgaattgtattattggaagagttaaaatcttccttagttactaccaacatcccaccaaagaaagagctatctagtctgttctacacgttaagtacccactattacgtcacttcgaaaccacatgggactaaactacactattactgcagtctatataggtttcaaatggagtgcggtgttacacttccaatcctctatggccacgtagccttgcggccagggttaccgatttcgaggtaaaaaccggttcctgttggccgcaaggctacacaaaaccggaccctactggtttcaagaacaaaaaaaggaatggactcccgcactatctctagttctttacacatgtcatggaggaataactcagtgaaacaacgcactgtctggtgctgtttgttaaaaaaaaaaagaaagaaaaaacttagagtgactgaccaagaaatccatgatctggtctacgttcttggttcgtctaccgattcatcaagaagagattccacaccggcctagctacggtgtcccgtgatgtcggctgtcggcaagatcaacatgtatgtttcgttcagctcctccagtgaaatggccccggacagctatatagcctgaatcccaatcagagatgcagtcatggatgataaccatgcgtcgtatgcttcagtaattcagtttagtaggctcatgtgcctctgaatctctgattgggaagttgcagtaggcagacattccagtttggatgccatgatcagttagttatcaatgccgatcctgtgctgatgcagttgttgggttgggtctgattagtgtgacgagcaggaagagacatttgccagtttttctggatctgctacatcattcagaggctttgctaattgatgctgtatttctgtctccaaaaaaaaaaaaaagtaagtgaaatctttgagaaattatgtgattcttggatgcttgccccgttctttttagcatatcgacttatcgagtcatatagattattcatgccatgcttttaaaagttcgatttctgagctactttcctcgtacttaaatatgtgatactaaatttaaaactttgatcatcaataactctaaaaaaatctaaaaaaatttagtttgaaagcataaaagacatatggatagcatactaaaatcttgttatagatgtggagtagaaaaaatagtggtcaacgacgtacatcaaagatcaaaaaatcaatgatatcatatactcctatttaaatacaacgatagtactccctccttaccaaattgatcattatacaagtttatataccaagatcaagaataatttaaatcacatcaatcaatatactatgcacacattctctcacaatgcatgcatcgattaaaacaccatatcaattacaccttagcatgcatacattctcccatactgtattaattatattctgataaaatccgtgtccatgcggttatatgatgattaatttgagaaattttaaatactctgcaactcttgtcccagcccatatacacgtcattacgtaacccaaaaatgttatagtgggcttggactagcctaggttatgggccagcccagcccaaaatgcatataggtttgatcaatatgggccagtgttgttttgtgccagattcaggcctgcatttttctgccgaaagaggcctcgctgatttgagtgaaacgttaagaacacattgaagagatgatgaactgcacaaacagatgcaaaagaagaaaataaaaaaaattgttgatctcttggcttgatttacacacatcagtttcctgaaaattctcactctgtttggctaggatattatcgttatcgattatggtgatataattactcccatcaaactatcgtcaggctcaaggatggtacgtaattgagtaaggatgcttattccttgtacataacaagagctttcatgacaacagaaaaaatacctgccctaaccacaagtcaaccacacaatcttgcaaattgtcacgttattaaatctctctgtctctggtcttcttgaagcaccaagtgagcaactttttttagtgacacgaactatcactgctttatcattattttttgtttactttgtggtttgtgcaccaccaacaggcagcagttcagggtttactttttgcatgtcgacatccctaactacaaccctgacagtgatcagcaaactttcagaaacagatgtgtcaatccatctcaacctttctcaggtgcatacatgttataatagttattgtttttgtaagtgtaattttatctgaacaatgtgtagaaaaatgactagaaaacctccactttggtgcttagaggttcctttggaattgagaaatttgctgcattcttgcagaaaattggaatagttgtatgaaattttcgtagaatcattgtgttccaaaggatccctgagtttgttcttcttttctctgcctctcaagggaacaagtgcaatacataaaaagtgaggcaaaatggtatttcgacaattaaatactcaaatttccattaaataataaacaggatatatgcaagtatctactcatcagccgcccaagttaagaattaaatattgcccattttcatcatgatcttgaaacgtgccggccaaatcagttgttgtcttgagctgttgggagcatgtaatgctacatcctacatgcaatgtattatcaatgcaagatgccattttatattgcgctctttttttccacagaacattttatattacaatttttaaaaatgccgtctttgcttgaacatacctgtatgcctagtcaaagcactgttggagttgtacccatcatttgaacattattgatttggtgcttcgctacattaagcatgtgtggcaaccgaccagtcactagtactatgaaccattattctccaaaaagaagaataaaaacaaaattttctggtttaacctccatatcaatgaataggcccttcaaacatctgtttgtcaatagtggaaaaacagaacttttttttaaaaaaaaagaggtgaaaatggaacctacttattctccaaaaagaaaaataaaaggagtgaagatgaactatgttcccttgttcagtcttttcctctttccctaattcctgcattatatagattttgctggtcagaaaagttcagcctttccacaaccatgatgcattgctctaactttactttcatcaaaaacacactagctatgaacactgtcttttcaggcttttagccatcccatgattgcttaacatgcacatataggtgtgtttagtttctaaaaaaaagttgaaggtttgaagaaagttgaaagtttgaagaaaaagttaaaagtttatatgtgtaaaaaagtttttgatgtgatataatatgatggaaagttgggaatagagggaaactaaacaccgccatatatgagcaggtaaaattgaccaaagaaccaaactatcaagacattagacatgcgcatcagcagtaattactagctacagcatgcacatactttactgcatacgtaatctcttgctgaaaagaaagaagagaaaagaaaacgaagtgttcagaaatcagaattgtttactctgcccaatgcagagcagcagttcacagttcacaccacatgacatggccctgtttagatgggactaaaacttttaagtccctatcacatcggatgtttgaaaattaattataaatattaaacgtagactattaataaaacccatccataatcttggactaatttgcgagacaaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccgaaatcgcctgccgctctggcctctctgcagctgccacagcctctggatccggatctctctcccgtttcttttgccgtctctatcctgtgcagttacttcatcgcgtcaggatatgcagtgaaaaatccgctggggtgtttagacctgtttagacgggacgatgttttggactgtaattataaatattaaatgtagactattaataaaacccatatataatcttagagagataaatctattgagtctaattaatccatgattagtctatgtgatgttacagtaaacattctctaattatggattaattaggcttaaaaaatttgtctcgcaaattagctttcatttatataattaattttgtaagtagtctatatttagtactctaaattagtgtctaaatataaggactaaagttaaagttcctaaattcaaacaccaccttactgtggtggatgcatcaccaatctaatctccgacgagctcatctcattgagcatgcaggagttgatctaggggtgtgtttagttcgcgccaaaattgaaaatttgattgaaattgaaacgatatgatgtaaaagttgaaagtttgtgtatgtagcaaagttttgatgtgaaagaaaaattgaaagtttgaaaaaaaatttggaactaaactcggcctaggatggcactggaaatgttcaccaattggtttgcaaattgcaatgtacatgtgcctgcgaccttatggatatcgttggggtaaccattggttcgaaacgatccatgaaaccagcagcaaaatcgtaagaactctacataaagtgttgttttttggtgaaaatttacggaaggcattctgattcatgtgttctgaagaagactggtgcgcaatctcggagagggatctcgcatggttacatgccactgtgggctcaactgatgcatggccctgtagcatcttgaaattccattttcattctgagtagataatagattgaccatttttcctttttttttccccaagaccacatggatccaaacaacaaagaagatcacaccatgaacagtcccccccccctgttttttatactcatgtttgaatcagcagctagctgatgaactgatgatcctaccatcctagcagtagcaagcagtaaactacagcagtaattattaattaacaaccctgtgctgttcgttgcaaaactactctgaaaattctgaagctgcgagttcttcactgtgcaagccagcagctacgcttgacctaaccgagaactcttcacctaatttacatttctgatttctaccttcccaatttccaaaccaaaccctcctgtactaatcgtagtttaatcctggccgtacgatgtcagctcgccgactccgagatgctctgcagcgacggccgccaattccgccctctgccgccgccgccgccgccgctgctccggtgccggtctttctccgccggcttccgctcctgagtcaccaagaagaggggaattcagaacacaaattcagctggtcggagaagaagagagagagggagagagcaagaattgggcggagcgagtaatcacctggtgatcggagggtcgcctctgttcttctccggcggcggcggagtcgccggtctgcggttgccggtggtggtggtcggtgacctccttgcaccgccgcatcttctcctgccgcctcgcctgcagcgccttggtcacctctgcgcggacaaggagcagacacggattagattttagcctaagcctccatggatggaaatcgagcaagaagcagagcaatccaagaaagaacataatctctgattgatttgataccttgggaggtgacgaggcggtagaccttgccgaggagcagcgtctccttgggcttgagcagcttgatcttggtgatcttcgccgccgcccctccggactcgtcgccgacggccgctccgacggcggagtgttcggccttgccgccaccgccaccaccggacgaggaggcggagacacggagcaacacgagggcgacgtagtggcctgggttgctgcgcatgacgtccgccgcggtggccggccagtaaagccgctccaccttgccgcccgggtgctggatcaccaccgccgccacctccgccgcctggcaattccccatcgccgccgccgccgcccgtacccacagcccaccacctcgccggcgtcaccaatggctcccttcgacgaagaggaggaggaggaggaggtcgtcgtcgccggcggcgtgggagctgcagctgagcttgtggttgcggcggtcggggaagacggggggtgggtggtttatatcggggcgggaggtaggggagcagagcaagcgagcgagagtgattagggaggtaattaaattaaattagcctttgtttaatcataatggttggctgttagcgacgtgattaacgaaggggtcaacgtgttaattagggtaatacttctccatccacaagtagtagtccccgtcattaaataggtaagtgaatgttctaaatagattggataaatagtggaggtaggtgggaaagtgaatggtggatggttatgattggttcggaagagaatgttgatagaaaagttgttatattttaggacaaattctaagggctaaaagttattatattttgggacggatagagtaattttttttctccttccatgtgtattctataataagtttatttttaaataatcattacgttgaagtttgtagaaatagaaaataattgtattattttggtagataaagtaaagaataattgtatttagatttgatagagcagatgtattttaactattttgattttatgtttatatgtgtgaaatggatgaaaaacgaatttattttgggaaggacaaaggaggagtactccctccgtcccataagagcaagtttgatagtatagccatctactaactacaaatcatctatagccaatttaatagctcattcatataatagttatctataaaccattaatatatggtcccacatctcgcacacacacaacgtattgtagttcgtgctgcagctggctacaaatctgtagcccgcttttcttctctcttctcttctctcctctacatgtgtttgcagctgacttgtagcctactattgtactcattctaaaaaatgaatttaggatcggatgtgacacattctagtacaagataaaatgtatgtctaaattcgtagtactatgatgtgttatatctggtactctctccttcccaaattaatcatcatataatagaatccaaaatttctcaaattgatcatcatataaccgcatggacacggattaatgcagcataggagtatatgtgcatgctagagtataattgacatagtgttttaatcgatgcatgcattgtgataatatgtgcatggtgtcttgattgatgcgatttaaattatccttgatctttgtgcataaatatatatgatgatcaattcaggatggagggaatactaggttagtttttttataggacggagggagcacatgtttaggcatgtgaatgaacaggaaaaaggaattatttctttctgcccggccggattaattgatgtttaacagtgggctgcccagtggatagacttgttcttttgtttctacgtcagggcatgttttgagcatgccatatgtgtgtctcctagatagggttgaaaaatccacatggctgtatacggtgtaaaactctagttattagaagggaaaaaaaggaatgttaacatccacaatatttgtctaaggccctaagagatgtatatctagtttgcaatcgacgacgatatcgatggtggtcatggtcacatagatatcgatgttggtcttgatcatacacgcataatgtataccctacgttcttttagaaaaataatttctagttattaatatttacatgggtcccatcatcaggtttataatttagaagttgatttttttttagaatggagagagagagagagagaccaagtatagtagttaagaacagcatagccatttcatctcaattgactttctatattcttttcccccacttgttttctactaatatcaatatgattaggaatctacctgacatcaatttctaccattacattcttgaatgaaaagagagagaaaaaaatgcaattccacattttacacattgggtttttggatcttggatcacacttccatagttccatgtaccttcctcattggattcccacccttatttttctcccaaacttccaatctcagtgaaacatccacaacaccatattattctctccccacattttcacccttttgctgcctttccagtgcacaaaaaaggcagatcttaagctctccaaatggcatcgcccatcctcgacacgtgtcacgaccccactggtagaaactttaacttgccaacacccaatcaatgcaacgtgggccacgtggcaccagcgaacataccggtgggccccacaggtaagggctcccagctgcttacgtaccctagcctgggaacatacgtgtcgacgtctacgagatggccgtacagcttccatatgctcctaccgtagagagacgctattgttcactgtacaagtgacagaacgctgcacagatcagcgtgtcagtgatgttacctcggagacgtggtacttgtagtataatatacgtatatagatcctgtacactgtataaaatttctttagttaggttgtgtttaattcacaccaaaattaaaagtttggttgaaattagaacgatgtgatgaaaaagttggaaatttgtgtgtagaaaagttttgatgtgatgaaaaagtcggaagtttaaagaaaaactttggaagtaaacacggccttagtacttcctcagtgttttaatacataatgccatttacttttacatacacgtttgcttgatgagtcgtcctataaagcttacttatcatttattttattgtgagttatcttatcattaaaaatgatttaaaatgatttttatcttatatattcatataaaatttttagtaggtcaaataaaagttaacagtatcatttattaaaaagaatggacggttatattttattggaagcttctaaatgggcggtgatcatcccagccgtcggattaagatcggacggtcgtgccatgctttggaaaaatcacctcgtgaatggaatggatgtgactagagattaatctgagccgtcaaatccatcaagggcgcccatgatgtccatgatgtcactcgcagcatggtggcatcagtgatgatgataaaaaggggccaaaatagtggatgggccaaaagagaactcgtgttcatcatctcagggcttttttttttctttattgtgtttgacaatatgtagatgctaatatgcaaataatgaaccatgtagtttctacagaaacaaatgatgcactaataccacttctagtgctcatcttgcttgattcatattataagctagcactatagcatatcatgcctttggtctagaggcatgcagctatgcaaggtttttttagcattccaagtttgggatggtcaacaaaatgtagtttatgtcgtccatatgcagcattttcaatgcatagccatgaaaagagtttatcaatcaccatgtacttagtctaggaaatcattaatttatgttagtgatattactgtatataattgatttagtgggggatccagtaattttcagagctgggtcgaaacctaccatatataatactccatttgtaaataaaaaagaagagattttgggtggatgtaatacatcctgttcaaatttatggatgtcatatctattcaaaatttcttatattttaaaacgaagggagtaggctgctagcattgtctgattcgatattggctaacaatgcgaaacttccacctcttgcaatgcaccaatgagctcgaggacgaacatcctaggttagatctagctacctgtgtgcttcgcaagaatatcatatatgcttaaaatataaatggtttgctcaaaatggagatatgccacacgatattatgcaattattgtacatctatctacatgtgtggatgatgtagctcgccgcttttgcaagatgcggtttcaatttttggaagaaagatcgatagcttaagatcgatctttgtcgtatgatactattttcaaagttcaattgcagattatactaccgtttaaaatgaacctccgaggcaacatcctcattatgtgaagcatgcgggacaatgacaatttagataacaacgcatactttttgaagtgcatatggaacatagttcgattccatccatcaccgaattcaaattccgagagaacaaaatcagcgatgataaccaataaatatatatatactaccaaagaggattgctgatcttaactaattacgctatatatactaaagcaagatctttgtgaataaaaaaatgtaaaatacaacataagtgtgatagaggaagcacctttggtgtgtgcgagagctttcacaagcttcactccatataccagtgttcagagactatatttttttaatgtattaatcacaaatgtgtgtacagtaggggactagggatgtatgtgggtcagccacgaacccacttatagatcaaaataaacgggtttgcggcttatcttagcctataagtgggtttcgcaggttagccacttacacccctagcgtacagtatatatgtacatgtatgatgatatgtgcatcttttgtgttaatagatacctgtatattactattaccgcgggattaattttattgagaaacattaattgacctaattgttgatatttcatcgacactttgatcgaatatggatactccctccggttccattttaattgacgttttggataatgacacggtctacaaaatatatctttaaccttacttttctattgtaatatatacaataaataaatgcatgcttacttttattatagtactttaaaagacaaatctatatatgttgttttagtttctttaaactaaatatttttaaagttattgatgatcaaagttataaaaatttgatctcaactttatccaaaacgtcaattaatataaaactggagggagtagttgttaaacatgaaagctcctttataacaaataatcatattaactttttctctagtcaaattttttcaagtttaacctaatttataaaaaaatagcaaatatttttaacacaaaacaaatataatatcaaaatatattaaatgttggttctaatggaactaatttaacactatagatattgctaaaaaaatatttaaatttaatcaaacttaaagaaattttattagaaaaaagttaaaatgatttataatataaaatgaagtagaatataacatggaaatagataaggaacggggtaagaagagagatatattataggcatgtatgtatctttgttaattctgtcctgatctcttgctttcatccgatcgaggaagctaatctcgtgagaacttaagagtcaaaattagtctgctcgagcatgcagggttacgttttccacgcaccgaatcaaatcaagaaagagatcaagagccgtctccacgaggccatgtgccctgactgctgctgatcttgccttagttaaccgagaagatcctaccactcgtaataattaatcactgccgaggcttaattaacttacagcactgtgtgacagtgacgacatgcccaacttctgcacatcactgtttgatttgatcaattacttgtagaaaagtgagtttatactgacatgggaattgggactttggctgtgtgcattctgaatttaaaagattttcctttatcaccttctctgttttcttggattgcaggctaatgcatgcagttaaggtcaggagtgttcttagtaaaattttatctccttcatggaattggatgagttcaacaaaactttcagatgatttcaataaaactttcattatcttaaagatatacttgtagttatatatggtatcaaaattaaccttttgagttcaggcatgatggaaccactactcccaaactaatcatggccattctagagtgcccaagaggctccaatccacatgctcaaaagggccattagcaatgcgcacacctaattcatttttaataatgacctaattaatcctaccatttgcctaattgccttttgcatcgcacaactttactatgatcattggtctacctagattgtatttaaatcactaggcaccatgtagttagtgtggtgccggatcatcttagcaaaagtgcagctaaccacaagtttgttgctgctgccatcacattcagagacatttaatttcttgccttaacctttctcatttactaattctcttctcttccaattctcttcctcttgcgtgtgccaatcctcttgcttgaaagggatttatactgaacggaataagggattttgcgtcttggccataaatcctttgaggcctatcaatgtcgtctcctcgtgactatgtactagatacaaatctccggagaaatactttgttgtagttgatgggtccaattgcaagagattcttcagctaattattgggtagatagacatggcaatttttgggggtcaggactcaggacaacaatgactcgtaagagtgacattgccactgaacaaccagacctagctaaacatggtaggagaagccaaacaattaatcacaatttagtgaaagtgaccggacccaaatcatagtacaaagacacaatcattgaaacccttgctaactgaactctagagaacaaaggtttttttttttctgaaatcatttggagcttgcaaaaatgaaagaactgagattgaattaagatgttcacgaagctgaaaaaaaaaagggcaaaatatggctccattctaacgcaggaatctataaaggtgtagcttatttctcaaatttaagttctttttgtagttgatttttaaaatcagtcttaaagttcttgattgattaaaactcaattttctagtgacacaatttttcagaattagcttttaaacgctaataacacacatataaatgtgcattaattcgcgaaaaacacacttataaaagtgattgcttcttaatttctttttcgtggcttatcagcatatatagttatcagagccgcacaagaattgcaggccaagcagggttcacattgactcccaaatccatgcctaaccagtaaactaatccccaagtgttagccggttatggcacagccagccgccatgcacagaataccctaggcaaaccaatacaacaacacatactctttctctattaattaacacaccctaacacaattaataaagatttttttcctttaataccatttcttctggttgggtatgtttcctagcttggtgataacactagatggcagtgtaaagggagctggcggcggtaggtcgtcttcctcgttgccggtcggcaccctcgcccttcctggagctcctccccttctttgtggggagtttctaggttggattgaggcggcagctcgtcagcgggggaagctcaggatgccgaagcaatgccatctagtcccaggttctccttcggccaaaaatggcgaggtggccggctggtggtggaacggaggagtcctggaccagctctcaggggtggtggttcgatgaagtcggccaacgaaggggcgtcggtgcggtgtggtgggtgctgcgtgctgccttttgtctgtgtgggggttctgagttggtggacggcgatctgcagtcaagggtgtagggtcccaggtaaaagcctagtccggtggttcaccgggccggcagtggctacgtcttcgggcgtcgtaatctccttggggcgttgtcgagggtttccctctccctttctcgatgagtttctctgggtgaaaaccacatcttttttagatgggtgatggcggcatccttggatgtcgtgaccaccgtggtggcatcgttttcggagtctcttctctgtggtgttgccgtaggcctagcggcgttcggccacgcttagcgggggtcgtctggtgctaggcttcaccctcagcgttttgtgcttgggtggtagtgcgtggtgtgtggcaatgcacctcggtgcattttgttgttttttcttgtaacttttactctttaatatactcggctggcctccttcggccgtcccggagaaaaaaaaaagataatactaggcctgcagccctgcatggctgcaacccaacaagcagaaatggacactggaatcttcttgtgttcctgctgtcctaatttgtctccattagaggacatggatccttcccaagtgcaaatctcctcatggactgccctccccatgggggaaattgcagggggcaggcttgggacacagcatgacactgggttttctttgagcctcaagaaaaggttttttgggtctatggtctagtggtgttatgggctaagcaaaggaaaggatttgactggtgtgttgattaatcaacatgctaattattggggactgactggaagttggtgtacccctgcaaattgcaatctctgcactttttatctgtaacatagatgtgcatattttctttctctgtcaaaagtttttggctgaagtgtcaatgtgtcaaggtggtgttacagcctttcttctgaatttcttttctttatcttcacactgagtcctgactagataaaacactactggcccaagccaatccaatctaacctaccaacctgctgctcctaccattttattccatttttgcaagagtgagtcattgctcttgtctactactgctactaattattcactcatgtagtgttggaatgatggttcaaaggaatcaatcgatcactagcttgcaatacaaaattggggaggactcctgtcatgaaatggattattagtattaacaaatctgcactttcacctgctgtctgggctgtctaggtgtctccacgtgtttcagagttgccgggaaggtcctaatggggattagatttattgggagtatgaaccaaatctgttgttttgttaatttgtgcaagatttgattatgcagccggtcagtgtgagaggtttattccatggaccacaaagaattgtgccctaactactaaacaaatgtgtaaagtccgtgtgtaatggcgttagggagggtgaagaaactcggtgaaaaacacgtgtaaaaggtactgatgcttctcctagctgccactaatggttatggacagctgcaaatgatgctcaaacatggtgaggacagattattttgttcaaatttttatggctatggactcgtaactagtcgatcacaccacacttacaccaacacactcaaatatataagcatattacttagtcgtagaagaacgaacaaaacaaccagaagatgaaaagaaaagaacactaaaattaattgtggaaaaaactccaaaatcaactttaaaattaaattctaaaatttaaatgagccatggcggtaaaccaaccagtaaacaaatattttgtttggggagcttaaaaatctaaaaacagctggtttgtatctagcttccgagaatttaaaaaagttgattttcccaacttctgatttctaatttactgtatgggttctataactacgtattttaaaaatcctagccaaaaatctagatttttaaaaagaactagatattctaaaagaagctatagcctccaggttgttgcgggtcgccgccgtcagagctatgtccgcccccaattggatcgttgctgggggactgaacttactcttgctggcccatgtggccatgtatatgggccggcccaaatccatggcccatgtgacccatgtatatgggccggcccactccgtacgcgcggcgggccgcaacgcaaccccacctggccgggcccgtgaaatgcgtaaagcgccgtccccgaactgcgccgcatttgaccgattccggcggcggcggcggcggcggcggtttccgggacgaagaggcggatcggcgccggagatccgacgaatccacggcggcaccggcggcggaggtgctaggatggaatcggggccagcatttcttcaccccgcacattttgaatttttgatccgacggtttctgtgactcgaggccggagaaattggaaagccggcgcgtcgtcgtcgtcgagatcggcgccgtcgtgtgcatcgatgattcaacgtggtcgaggagaggatcgctcgcgctcgcggcggatcagattcagagaccgtccccaaacctcatgtaagttgttttagacgcaccaaataattttgttactgcttcttgtaatttgtaatatggttttgttgctgctggtgtttgtgtttctacggatttagattttagaatgggctgaacagactgaactcactcttgctgattttagtgttgattttttttatattttcttttgctgatttttattttgttattgctgctgctgttctctaacgctggtgattcttggaaggcataccgcataaattttgatgtgaattgaaagggtttgtactccctcgttctctaaatgtttgacgccgttgacttttttaaatatgtttgaccgttcatcttgttcaaaaacttttgtgaaatatgtaaaactatatgtatacataaaagtatatttaataataaatcaaatgataggaaaataattaataattacttaaatttttgaataagacgaatggtcaaatatttttaaaaaaatcaacggcgtcaaacattttgagatggagggagtatttaggaacaatggtaatgcagtgatcactatgagatgcagtaatcaccatgagaagatgcacaaaaagtttttttaaaaaaaatggcgtgctgacgaatgaggaatgatgctactaagcactgtgattctccttgggcaaaacagaagtacagaatcctgaatctaccttaccacaaggggaactcctagcagaaagctctcaagattcaagaacaacagatcaaccagaagcagcagcccctccctgacctctgtactgaaccaaaatgcaataatatgtggcatgacagattagtcccccaaccagccaaaattcacccatcctaagatttacaaaaccatcgaaccaacatcgaaaaaacatgcccccatacaagtagaagctgaagctcccccccaattctgctgcggtccgaacccgagctaaggcggatcacacggaagggaagaacttgttcaagttgaacggcagagagtagaactcctcgctccgggtgtccgtcttgaagctcctgaacttgtcccaccagtggtatcccctgtctctcctcaccccattgtcgcgcctctggatagtgttgtctaggaagtacgcaatgagccctgcgacgaacggctttgacgcgaagggtacatttatcatgtcattgaactgccatgccaaaatgatgaacatcagtaacctgtaaaggatttagctggaaaaaaaaagatatatagaagtacaagaaggttggaggttttctttacatacccatcgagcgccggtgtgcactggaccataaccggcaaccgatgtatactcgttgaagtactgaggaaccgataagcccatgaagaacgagaaccccacaatgaacttggtcctgaagctgttgagattgcagaactgaaggaagctcagaccacaggcacctgcaaatagaggcattgacaatttggaaactgcaatgtgcaaataaaagcacagaaataatcaaaagcctggtaaagggtgctgaatatctggaccacttaccaatatatgcaaagaagatgcaatacagtgcagcgaatattggtaagggaattgacgcaaagattgctccgaatttccctggtttagcataacaaacattattagcctaggaaatcatatggtactctgattctgtctatccttattaaaacttatatgtactctgattctctctatccctgcacacgacaactacgagcctactagatttttcttctgaaagctgatatggagtactaaagttagaaaaagcactgcacattaccaaggatagaaaagaagatcatgaagccagcagatatttgcactactctccggctgccaacatgtgtcaaagctagcaaaccggcattttccctgcaaagatcaatatggattatgacctacttaagagacaaatgggaagaaaaccagttcccaagtaatccaggccactaatttaattagatggtaacattacacttacactgatacagcagttccattggctgtcccgaaaaatgcacctattaaagtaccaataccctgcaaatgatactcagcagtgatcagtaaaacctagcgattgactaagatgatgcttctgggggaaaataatcaacatgtttacctgccaaccaattccacgaccaagcactgatggaggtatcatagtcgcacttgcatatcttgacacagcaatgaaggtcccagttgactgaaagatagtagtagcagcgggttaaaacttataaccagcaatctatgtttcactttcaggtaaagctgtgcagacaaacctctacaagagcaacaaatgaggccatcatcatggcaaaagattcaccagcatcaaatgttggagccccccattgaaaagggaaaggaactcttatcctacaagatttttttttcagtgcttctatgatgagtactatcaataaagggcccaggaagagaaatgatgaaacactcatgaattgcttaccatggagctccactgataattccagagcgatcaacacgacagtgcacttgtgtcttcggccgggcattcttgtatgcgccactagcagttagaatgtatgcatacagccacacaatagcaatggtgaaaatcacagcaaaccggtcgaacacgggctttgccacatgtatgacatggggtaaatactgcacaagggggcaaatgcagttagctcatgactttcagcaaccacagctatacttgtgtgaatatgcattatgactgctgcaatcacctgagaaaatacaagcagtagaatgatttctgggagcccaatttccacgcactttgcaacctgcacatacagttgtggcactaaaatcagtcttatgaggtagggaacagccaaagaaaaaaaaaagaatctccaagctaactcttacccctggaaaaccaagctcatagaggccaaatccagcaagtgagatcaaaggaacagcagacaatggactaagaagtctgtgaaagagtgggcaatggtcaagccacaaactaaaacaatacattgtgcaacgagtcgccaaacctgataactgaaacactgcagttggcaagcctgcaaactgaaatgatgcaattgcacaatgtacattcagaagttcaacaatgatacctacctaactacattgcgccagagaccactgaaaccaagtatgatctggattgtcgatgcaatgatgagagcaccttgtgttcctcgcattgtccgcaagaatttcttcacagcagtagcaaaatcttaccaactttacaagatcacacagaggatgtgacaatcttaatgcttagatacagctagtgcggatactacctcatgaggatctgcttcattgctatagcggccagccaatatgatggaaattgtcggcgcaacaatggtgtacgatcctcccatcacagctggaagacgagtcccgaagaacgattggcagagggtgtttatcccggcaacgaacagcagcgtctgaatcacccgagccttctcctcctgagtggcaatgcaacgaaatgcaggtacagttcatcagttttgacatgcaagctcatcacaaaattacagtagtaacagtttagatcttctgtgacattcttcaaatgcacatgtcaacaagtgaaatcaaccaagattcagatattggaatacttttcaggtgattcttggggagactcacatttccacctcccatctggggaacaagagcactgggaataatcactgatgtgcccagcatcacaatgtagtgctggaatccaagtatgacggcctcagctgcaggaaaagagagattcaaagtttcaaacccatcaacatcgtcaggaccaggtgtgagaaccaccagagtgaagtgaccacaaactacaaccaaccaacacaagcaaacctaggaggccgacatcgacatcgacatcatcaatgctgcaaatctatacggctaagagaacataaatgccacaaagtacagtggatgattagcagctccgccatcaaaatcaaaaggcaaagatggccttggtgatatagagagagaatcagagaagaagaaattaagagacgtacgccatggcggtgggctggtgatgcagtaggacacgctgggcagctggtccttcacctggtgaggctgcaactcctcctgcttcggcggcggcgccgcccctcctccggccatcctccaccacctccaagaacccaacaaaaatgggacaaacaaaggcaaaaaagaaaagaaatgcaggaaccaagaacagggagtccaagaaccagaacagtgcagtgaaagcacaaaactcagagagatttcagagagcagcaaacaaaggcggctaccgattctttgcgtgcaaagaggagcaagaacaaaggaggatgaaaagaaagggagacagctacagctgctgcttcttgctttctactactactcctcccagtgcgcagtggagtgaagcagcagcagtgcaatgcaatgcaacacactcgcagctagcagctactacctgggtcgaaggaatctacaatgctttgagcttttcctccctcttttatgtttcccttcttttctctcgctaccagcaatgctttttttctctggccatgggatcggagtttcgcctttgcgccaccgcctccgcgaaaaacgcgccctccgctcctcttcccaagttgttatctttttcccaccaccgtaaaggagatggcagagagaggaaaaaagattgcaaattccacaatgggaagaagttcgggtctgtttggttgatatcttcgggtctgtttggttgatatcttcggtatactccctccgtcccaaaatataaacatttttagctatgaatatgtctagattcataactaaatattgtaacattttgggacggaggtacttcctccgtttcacaatgtaagactttctatcattggtcatattcatatatatatatatgtatttagattcattaactatctatatgtatatagattcattaacatctatatgtatataagcaatgctagaaaatcttatattgtgaaatggagggagtagtattatatttaaggttagctaggagtatgtcacaactttttaaataactatttggttcattgtcacaatagtctcttgtcaaactttttagacacatggacttccttgtcattgattcaagtttttaaccaaggttgtgtttagatctagtggttgaagtttcgtcgtgtcacattggatatacgtgcacatatttaaagtattaaacgtagtttaataacaagacaaattacagaatccacctgtaaaccgcgagacgactttattaagcctaatcaatccgtcattagcaaatatttattgtaacaccacattgtcaaatcatggcgcaattaagcttaaaagattcatctcacaatttacacacaatctgtgtaattagttatttttttcatctatatttaatattacatgcatgtgttcaaacatttgatgtgacagggtgtaaaattttgctagggatctaaacaaggcctaagcttgtaatgtggataaggatctataaacataattctgtgataagccacaacttatcacaattgtgatttgataaagttagccactaaggccatcaacaatgcgtgcccctggagagtagcctcgcaaatggcatccaacttccgtcgtcgggtcgtcccctgggagggaggtgcgacccccacgcgggggacgagtggctccgggctcctcagctcacttttcctgagctactccatcggggctacgcattggggtgacccgatgccccgtccccacctcctcccccattgcttccccatgttgcccctcaccggcagcgtgacaacgagagcgagagagagagagagagaagagagaggcgacggcgacgggcggagacggcttgaggcgcccgtgctcgccgccgaggagcacaaggacgacgtcgtggtggtggtcatcgcgctcggggacgacggcgacgacggccaccgtgcgccttgcccggccttcttcgctgacaccttgctcgccaccgctggcgccgtgcccgctaccgccggcgctgccactgtatcctccccgatctggccgcgtggagctcagatccgcccactacggtgccggatctggcgcccctgaccggcgacggcacgaggtggaggatgccggagaggacagcgataggcggcaatgggagagagggagagagaggggcggcggtggacgccggcgacgggagaggcggccctcctcgtcgtcctcgcagccgtgtgcggcgagagggagaggcgagtgcggcagcgaaaaaaagagaatagggggcaggagagagagatcagggatagggtagtaaaaataaatatgtggttttgtaggctggaatattcattatgggttggagtgtctctattaagttgtttcagattttgaggagcccatccagagatatcctttattgtgagctgagtttctcctacgagtgttctcagttagtgagtacactctaggagtgactcacattgtagaatgccctaacggaaacaaccccaaatcttcaaagtttttcctctctagagagtcttttatctctctctagtgtaggtagagaggagcagggaactttttgccactgcggtgcaaagctttttctgctttggctgctgctgctctgcttttgctgcggctaaaatggaagaaggggaggggaggtgcgtggagttgaatgctgctgggagcgcatgtgagcctgtgtgagcagagcagccatgggcaaaaatggacggcctctcctctcctcgcagtcgaaacgcaccgttgcgtgtagccatgtggtacgcgttggcgtttgccgttgccaactcctcatttgcctttaccgttgccgttgccatctcctcatggctagctgttcacgcttaggcgcgagaaattgaacggatcgagaagctcaatttccttaaaaaaaatacatgaaatatgcataatcttacacatttgcgattacacactctaacacactaggtgagttatctagagctttttaattttagccactaacacttctcaaactgctaaacattgtttcatgaaataaaatcattataaatgtttttttaaagaaacttgattctcatttttaattttatagtagttaatatttaattaaacatgcactaattaattattatctcatttcacgtatggctgattagccaagctaaaaaactgaaacgaactaatcctaaggctgggcttagctagttcatggcatgaggcagatgatcagcgtgtgattaattaactttaaatactacaaacttaaaaaaataatttatttgatttttagtaaatttatatttttcacaaaacacgttgtttgtaattcgggaagagtgttagctaatctcaaccatagtatacacttaaaaaggtcgatgtcaacacggtagcacttgattttactaaagtcctgggtaagttggattctatatgaagaaa

SEQ ID NO: 79604 - DNA, 30489 bp, Oryza sativa
agcagatgaactgttgacatcaaccgtaccgcataacgggcaaaccttttggttttgccatccttctttttacaatctgtccgccgttcatactctattttgaataactagccaggagaaaaatcactactacactacagattttcctagacaccaaactagtttgtttccaggcggcccataagtgcaatcgtatagaaaaatgaaaaaaggggcatcaggacatcacccgcacacgaaaatagattttcctgtgcgggtgatgtcctgatgccccttttttcatttttctatacgattgcacttatgggccgcctggaaacaaactagtttggtgtctaggaaaatctgtagtgtagtagtgatttttctcctggctagttattcaaaatagagtatgaacggcggacagattgtaaaaagaaggatggcaaaaccaaaaggtttgcccgttatgcggtacggttgatgtcaacagttcatctgctagctaaatgctaaatgtagggttacaaagatagtgtggtcagagatttagagatggactagcaaggaccttcagacagccaaatagaaagattgttactcagtcaagcactggtggaaccttgtgctggaatcccccgacaaccttcgcaaacccctcaaaaccctggtgatcctagtttcctaagaaatttggtgtgagcgaatgcaagaacttttcgccacgaatgatgaggacataactagctcgaatataaccatgactaccttatctattcatcaaacaaaggtgcataagttctatattagatttacttgttatatatttgaacaaacattgccacacaataagtttaattagtgtattttcgtttgcaaagatacttacttagttgaaggaaaagagaccgagcgtaaggaatacatggatgatcaaagaagttgattgggaaccaaaccaagaccttctccaagtccactcctacctgtctatgtcacttttggtctatagaagacaagaaataaagttctacacattttgggttcggatccgggtctcctgatagcatcaacttcaaacggacctagcagctgacctagaaagaattttggggcccatgagtacttgttggaaagcttatagagtctactttcaaatggtttggtcccacgtcataattaccactgagctgtcgggaatttgcaaaacaagccacgtacctcatccagtccgaatctgattagggtctagggccttgtaattgtgtcgtgggctaagtctaaaggtgtgcaccctagggcaaccctaggacgtcctaaatcatatttattccgtagccgtcatagtttagaatcggactttgcttacattatttgtgccattacagtttcgccggtaaatcggtttgttgaactccaaattcgagtgcttaattattcatatgcaattgagttgctatctaccttgttcttgcttgtgttctttgattcgcatgtagggattagccttctcggcgaggtcaactgggcagtgtactgctgataaccagaggagatgtggtgctatgattgtagggctcggatcgtgtgtgtcaagtttccaccaaatcgacagttatcaatatctattggaagatcggaacctagtttcctcatcaacaaagcagcaacgccggcctcaatactagccaagatcaaggaagaagtggcagcatgggtgaaagcaggagccgttaggctccgggagttcgaaattttgggagatattgcctaggggcctattttcggcctcatctattttgataggccctgtacatatctttgtttgtcttttgtataattttctccttctcaattaatatacgaggcaaagcttttgctgtccctcgaaaaaactatataccgcgatattttattaaaacaactatacaattacaatttattttgttatgccgacttatttcatcattaattttatttgacccacgacttatattcttcatatttacataaatttttttattaagattaatgatcaaatgttatgttcataagtcaacagtgtcattcattttaaaatagaatgaataacaatccactgtagtattctagaggattgtatctcttaattaacttaacatactctagaggattttatctcttaattaacttaacattattaaattgtctcacaacatataatgtttcaatatttcatcaaaaacaaaatatatttttccaagttatcaatcgacccaaactgatattacgtttagaatgctttgtatttgggaacataatttccattttccaacaatctagtatccaagtcaattcctagggatttgttctcatccaaaagagttcataaataggaagcggcattttatcccttgagaatgtgtccccttgtgtactgtacttttcaaattcactatgaaaagttatagcaaaattaacaataatgtagagtagtgtgacacctacttccacaaatataaaatccaaatttgatctatagagcaacaaagacaaacatgacagtgaataatgtgtctaccactactagaaaaaagatttttcatagcgttaccctatcattttcgctggtggtcatacgcgaaaaccgctagcaaaaacgtaacgagaggtggggggctatggactgccaacgaaaacaaatctttgttggcggccgagttaagcgggccgctagtgaagatgtagctattttccttgacggcccacttaatgcaccgattttcactagcggatggtaaagagcaacgctgcgaaaaatccaccgcccaccaataattttcacgcttctccgcctctcctcccaccattctccttcctttctccatctctccatccggccgcctgccgggcctcgggagctacgacgatgaagctcgtggcgcgcggtggcttggtcgacgggcggagcttcggtgactcgcgaggcggcggatccggtggcaacgaggcgtgctgacggcggaaccgacaacggcaaggcctgcagacggcggatccgccggctaggcacgcggagggcggactcgcgagacggtgggtcttgtggggccggtggatggctcgttgccgaggaagacgagcggcagcggcgcggctcagtgacaaggaggaggggcggctcagtgacgaggactttcggtggccgggctcgatggcggcgacccacctcctcgtcgacctctgccctccttgtcgccggcgatggaggatgggcacgctggcgattttcaaattttttttttcaaaatctggattccgattttctttttttttttaatccaaaaaatattttcactagcgggtatctttatcttccgccagcgaaaatattatttgtgctagctgttgtcttagccagccaccagcgaagacgattttcgccggcggttgccttaattaagccggccgccagcgaaaatcaatcttctctagtggtttaaccgttcatagttagtacatatttttctttttttctttttttaaacgaacaaccgcttattatgtgccaatttcattgaatatagtaggaaaaaattgtacaagagtagctctatacaggtttcaaagaaaaaagagggctctaaggcactatgttacatttatcttttattttcctctcctcaatgtatggatcgaatttaaactttgaattttccagtacagtatagctagatattcactaatgtcatcaaattcttcagaattttacatagctatttacatgtatttttagaaaaaaaaaagaggacatcccctaaagacaaagcaccatatgcatgcccctctagaaaagaaagaattaatacatgttgcacattgagatcagcttaaaccggcaactgatcaggcggattcttgcccgggtcaagctcacgccggcacagcgggcacgtccggtgagcggcgagccaccggtcgatgcagtcggcgtggtacacgtgctcgcacgccggcagccgccgcaccatctccccctcccgcaccgctcccaggcacaccgcgcactcccgcccgccgcccccgctcgccgccgtcgcgccaccatcctcggagcttccaactacataagcgtaggccggggggagggcctcgacggggaacggggcaatggtaccgccgccacgcgcgcgctcggcggcggcgccggtgtcgtcgtcgtccgagcggacgcggtctctgcacaggaggcagcagtagacggagaccgccatggcgaggaggaaggtggagaagaagatggacatgaagatggccgtcgacgcgatccatccgcccggcgaagcgctggccgcaggcggcggcggcggctgctggtagccggtcggagcaaagccgttcatgcctgtgcgcgctgccaagaaatggtgttcagaggggagctcgagactggaatttgagagtccattggaattttggctgcaaaaatttaaagttatttgcaaaagatcagtgaaagactactggattttatcctattattatcaagtaaagtcagaagagggatcgatagatgtatctttcatcttccattatatatatcttaaaaataaagacaagcgaattaagctagtagagaattagagattcgtcatgtctgacctaatccgtgactacatcttttgtgtaatgtaatgtaatgtagcttggcagagagaacatgagctgatgatctcaattagcacaattcgtaaatctctaatctcttacgtccctttcgtgattcatattttcaaactgaaacttacatatatatgttgtccaaacgtttcttatatgcacaggaaaattctcatgtttgtgggtcaaacctgttaataaaatcagctagtagcttgatgcccaagaatatatgtatcgacattcgacaaacgtaatttgttttttattattaggatactaataattgacaacgggagagtaataatgcatagggatgacagtcgacaaaagacacacggccaagaatgctaggctaccaaccacatagatggtggaactgtacaagtattaataaagacattaactaaatctcatcaaaaggcaaagaggtcaactgtatttaggaccccagagaaatctaaaagaaattgaaaaccaaccgcagactattatagctttagattattttttgagaagcgcttctatgcttctcaaataaaaaccagcacgaaaactaaagcgcatcaatggcgaggattagaagtagattataacagagtgatccctattagcgagaggcaattttgtccttgcagaaaaactgagcccatatcctatctgtgggagaattcgactcaacgcgatagattagattgatcacggagcaaatacatatataggcaacatccttccctatccactcaactgacttatagcaacagaatcgagagaatagggaggagtgccgagagatggatatatatggcacaatatgcactaaacccccccctcccgcacagtcgcaacgtcgataggacgaacggtgttactggagtgaaactcggtgaagacaggcgtcggtagacccttggtgaaggtgtaagcatattggcaggaggtaggaacgtggagaacacgtatggcaccgaccgctaccttctcccggacaaagtgtagatcaatctccacatgtttagtgcgttggtgctgcacgtgattagaggagagatagacatcattgacattgtcacaatacaccaaggttgctttggggagtggcgtgtgaaggtctaggaggagttggtgaatctagcttgcttctgcaacaacatttgcaatagccccgtattctgcttcggggctggagtgggaaacggtgttttgcctcttggaagaccaagacaccaagttttcgccgaggaaggatagcatacccggatgtggacttccgtgtgttaggacatccaacccaatcaacattggagtagacaacaaggtcattgtagggagactgctagatgtgtatgccgaagtctgagagtctcgcgaacgtagcgcaatatcctcttgaggcgcagtgaggtgaggatcgcgagggttatgcatatgaaggcacacctgttggacaacataggagatgtcacggcgagtgaaagtgaggtgtgctattgaatctgacaaccacggtcctgggacaaagatccttcatagtaaagccaaagaggtcaaactcgatggagcaccaattatcaataacaaagcgacggacataaataagattcttaatgataactagggagtcaagaatatctttaagagtaaaggaacggttagggtgatgaagattagtttgaacaatagaagtgataggtatagtagagccgttgccgacaactatgtgggagggatcatgagaggtgggtgggtgggtgaaggagaggctatcggcgtccgaaatcatgtgtgcggtggcacccgtatccatatacaattcattcgtcggtggttgttgcagcatggtggtgttgaaggcactggttgggaagcctggtcccattgggagggggcccctgggaacgaactcgtgggctgaattgtcggtggagcctggactgcttggcacatgccgacgtgctgcacagggtagtgcaccggctgaaaagtccgctgcacagggaggcctagaggcggcctagtgagaatggcgcccgcaaacggcgaggtaggctgtgggccgagcaggccacgacccagaggctccagccacatttgaattatgacggcccatggattgtgcagggagggcactcttgcaccgagctggcctgggaggcaccaagtttgaaccgacatatataggtgtacatggggaagagataagaaatgattacatatatggaagaagtccacacaaatcaatcatatcctaatatgactctagttaccatatactctaacatccccccacaatccaagcatgagcatcgcggacagttggaatggagaagaaacggacaagagtgctcaacacaaatgatactagatgggtaccccacgcgttgcagcgggagaattgtgtgataatatagtagatatgagttctctttcttacctactatacgattttttttcatgtgtttatatattttgtatctttatcaattatcctaaggatataaatggtttggttgtatggtgtgccttttggggggaagagatgcaatttacactcttgatgaatcatccaaaggctaaaaacaattgaggtgatgtggcttcatgagagaagagagaattagcattaactacacttagtggggatgaactttatagatatataggattcctttgtgccgtagtcgatgtagccaaagcgatggatgcgaggggcctgtgatcgatgtagccaaagttggagagtcgatgatgtcgaggtagcctagccgtggggcgcgcatggggtgtcgtagagtggtcgtgggtgaggatgcactgaagacgatgacggtgacgcgatcgcgacagtcattgaggaagatcacaccggagatgtcacgcaggtttgccagacccggagacaactctggacaaacgcgcgcaacgatgttgccaatactgcgcaggtgttgacggtcgttatagaccaatttcgactgccaatatatctagaataaaggagaactagcaatgcttgcatgcatatttgtttaagaatagtctatttccacttgtacttcgaacattatttgtatacagtagatcttcacataaatggtggagaaaacgatggaaaataaccgaacaattaatcgaagtccaacggatggcagacttatggatggatgggcttacaaacccattaaaacagctgcaattgggcctaatcaccatgcctatggacttaggatctatcaagcaaagtctacgcaaaagagccagattggccagcccaggttcagctgaacctagggttcggccgaaccgccactgtggctgttcgtcctggccttccacgtggacgtccaagatggcctcccaatgacagttgcatgtcatttccgacaattccaaccgtcattgacagcgtatttaaggacttaactctctccattccaaagtgcaccaagaaggatcaaatccaagaagcttctagtttatttacattattttagtgctagtggagtagaaatagaatagtttctttgctcttcaagtcttctggagattttgggtatgactctagtagctcttctttcttttgtaagactttactcattaatgaaatattcttctttatgtagtttcggtctgttacttcactcatataattattcgagtaccgactttagttcatattttatctcgtaataattatgtagctagcttactggagatatgcaatggtgttggtttaatgtttatttatatgattgttctatgtcacctgcagagatgtggagcactatttagtaatgtaagcacgatgcttagattattagataccattaaatggtgttatatgtcacgggtctgtagaggtaggtcgctgatgatgacagctcagtacgggtattcctccacgtgcgtatataggactaagagaattccctattgtgggtactactccgtagtgattacaggttggatggccatgacgggttgttgtaagaaactcggcaaccaggggtcgtttctcgatacaccaggagggcatagttaggggtattggccgtatgattgtatactacgaagtgtagactaaaatgactatatactagaagtacataaatgattcttttcttattctttctccacttagcttagattatattttaatgagagtattctggttagttccttctgtgtgccaactcattctacccttaaatttattaacccttgcatagactttgatttatacaagtgatatagattattagcatagtaatctcttatcatatcttcccttgggattaaataaatactcccgggtgaaatgctacaacggtatatccgtgcgcttgcggatgtatctgtaaccgcaaagtatatcgagaatatttcggcgccattgtagggaattatatttctagtgaagtcattaagaaatatcaacacagtcataggtgctggcattgggaaaccctgactttgactctgatatagattctagagtttgcacttgttgctggtggtacagctactgcatctgttgcatccggtgttgcgttgcatctgttgcatcaacggggccattgtctgagtctgattagccatgacttggggtacagacggatttccgagaggttgaggtggaaagctcataggattgtgctaagttactccacgaaactgtctggatcctcatctacttacactgtccctgatgctgaccatctgttgttggtagaagagagagacgagatgagagagattactaaagataagaccataacccacttgactactgatctgttgtgactagacttttattgttcaagttgattaagcaaacaacctagtatagtcacatcctcaccaccgatacaaaccatacccctacacacaagcaaacaacacacgttctagcagctaccgacactactcttcagggaaggattgggttcaggttagctccgggaaaacttcacttgatccacgcggaacaacgactctggactgatcttctcgctcgttgctgcatgaatcttgaggcttgacttaactttcaggagtagatttgtaactgacggtttatcttccaagtttgataactaaaagagttggagaggaaatgaggaaaattcgataaaccgttttgcaaataaatgccgaatggtgagaagatacatttttcaaataggattttttttgagggaatcacaatggaggaggcctccacagtatagattattattaaaaagaagagttatttacaagagacaaaagaaggagaaaagaacaaaaggacaaaattacagaaggtcaatccatgattgaactagaggatgatgagtttccttgagcctaggtaaatgtaaactcaaatctagctttaaactccttttccaggaaagaaccccaagctgaattccattgaaaattaggttatttctctccttccaaatattccaagtagccaaaagcaaaagctctataaaacagggactagagatagaagcactctatgattgaatcatacgatgaaacccctgggaagtgctccaattccaacccagcacactccaacactgcatactaaagctgcaagtaaagaaaagatgttcccttgtttcccttatattctgagagcagcaggtacaatagatagttgcattatcaggaacacattgctttctatctaggagatcacttgtattaactctatccaaaaagaagagctagcgaaagacctttattttcatattaagtctacttttctagatccaaccaaacgtaactggggagtcagtgaccgaaagttaagcttataaataggattttcagaaaactagcccttagggttttaccatttgcctcaccctacagtcgagttggctctgataccattttgtcatgcccagaaatttaacccaaattttcagactgttttgtgcataaatccttgtccaagaatcaagccagggtacaaaaaaacaacaagtaaatatacagatccaaacataaataaagtgtaaatacatataaaagaggcacttagtcctcacataaaaaagaaagcagcagcagcagaaaaggcgatcctaaaggggcttaaactacacaccacaggcaaaaactcaactggggtataagcctcggtcctctaacttcgtcttcagctcaaaagcactacacttatgaaaagtgggaataaaagtaaggctgagtacaaccaccgtacttagcaagccacaccaatgatacattcgtggaaggggagacaaagggaggtttgtggctatttgcataaaggcagttgtaaacattttagttgaaaacaataaaactgtcaaataattaaggcaagattaaatctccagtgaacaacgttgcaccacgttgaacaggcccaaccaaaccgcctgaactacagcagttcattaagtcaggttactaaaggtgtgagactaatcacggcgaagctgatcgattgcccataaccgtgggcacggctattcgaatagttttactctgcccagaggtgcacaactgaaccaacaagacacatcccaccatcttgttactgtgccatgcatgacacgtgaccatgacgagtgattgtgacaagaccctttgcataactccccttagccaaacgaatcacactgcaggttttgcccctactcttaaaataggggtaggcagccccctcttgtgttgcggtgaatctgaaagccaatcaacacttaaaacctgggctgacccaactccatcacgcttaccctcgcctaggaaagtcggaaagggaagtgctatactacaggtccagaagttaccctttcttgcttggggtaagcacggtaagtcttccaggttttcccgtgaaccagtctttaattgccatgggtgcaactagcaaaaccatgcacccacatccctccataaagcaatattttagctggataattatgtccaataaaacatggctagatgtctcgagctcggagctcaaccagatactagagcaaataatgtgattatcccatcaagtgagctagtggtaattaagcatggctaagcatatgtaattctagctagttcaacaagagtaacacaagctagtcaaattatcacccaaggtttgacaaagattggatatgaaataaatatggcacaagcgagcagataggtaatcccatgtaattagcaaaacctgcaatttatttgcaaatagtaaaacattttataaattgggctcaacatgctcaaggggaatgtgtgactttccttgcttctttaaacgatcttctgaactctttcctcacggccgcgatcttccgaaacgacggattctacacgttggcacacaaaacaagagaaaactctaacaaaccaaataaacagtgcatgaaatgtaaacaaacatgtagagctaacttttagatgaattttgcaagttgaatggctcaatttggagttcgcatgaattagttatgaattttagaagttttgagccatttaaattaatttctggaattattctcaatttattgcactaataccatttatggcatcagccgaagggggagccggtgtgacatgtgggtcccacacgtgggtgactcaaggaggggcgggtgcacggtggagcgggtccacatgcgcactgttcacgggcgcaccatgtggcacacacgttgcggccacagcgaacaagcaggcggaggagaaggaggaaggggggggagggctctcactctgccctctcaacggcgagaaggcaacgggaaggcggccgacggcgaggaacagcagcagcgggctcctcaggaaggaagccggacagtgctcctgtggtggttagcgaggacgaagggcgaacgaggtcgccatcgacctgcagaaggagaagaaggggttagggaggggagaaccagcgcggagcggctagaaatgatggccgacgaaggaagcacggggtggagctcaccttgtgtgatgacgacggggtttcggcggcttctgacagcggggaaatgacagccgaggtgcggcataatgctgtggagctggtggaggaaacagcgtggcttggggtggctctggtcgacggctatcgccggttggacgtggcgaatgcggtggcggcctcggtagcatgggaaagaggatgactaggtggcgatttgaggaatttgaatggcggctgtggttgtgtttgggatggcgaagctagcggtggtggcgcagcacggcggtgacgcgcgaccggagatctccaacgagcggcatgcggagcacgggaaagagggggaacatggagaggcagcgcggggagcatttttatagaccgatgggtgacgaggaggatggggagaggccggaaaaggcgggtagagtggggctccggcgacgtgggggaatggtggccctaaccggccctgatttgcagggaaagcgagggagagaaggtgtgttgatgcgaaaaacacgaggcctagaagatctgcttaacttcagtgcatgtccaaaaatcttgcctttaggttcctgagcgtgccagttgatttgatcctgcaatcaataagaaataaagacaaaaaaatagcggttaaatctataaacgatagccgatcggccagccgccgatgacgtaacatttatctttaagccgatgtcatatttaaatcgatcggcagtcatgaataagtaagaaagaactaaatctatttgatcggctgaagatattaatagcatataatgcttctgtcgatatatacctaaatcaagtgattgggatagatcggtcaccgtgccgagacagtataaatcacttagatcaaaatatatattaacaaggagattataagcattcgtagcatagccgatcagatagatctaacatgtatcggctaataccccgataccactctttattaagatattaaagcaaggaaaatatattagacaaagcttaatatacctaaatgcgacaagatcttaacataaagggcggatttaacttgtcaatcaagcatataagatataatgtagttaaatcaggtaagatcggttgaaaccccgatactaccctaatcggcaaccaaaaagcaggctagagattgagattctaatcacgacttataaggtcaaactcaactgatgtagctataagtatgaaaagaaggacgatatctagacaatcaagccgttgggtttcatagggcggtagatatcctatataatctaagtcaacattgatatttaacctaatcgactgccttccaataatggacgttagccgattgaagattagataacaatattgtcgaagattatataagatatatgataactcgatgaattacataaacaagattagagtatcataaagatggaaacactaatcccgagaacacaagccgccataacaagttttacctctagttgaagatcgaaaccgatgcagctcaacccgaaagcaagaactcgtcgaaagtaaacgaaagtaaaagggtggcgatgcaacgagattgtattgaacgtgtgttttttgattacataggttcgggtcatatttatacccgagatacaaaatatgtccttgtcggacacgactcttatctttaacaaactctaagataccataagtctttgctgcagacttttgcccaaacttatctctaaggaaactacataaaatatcctaattaatagatacaattgccttttcaggactcaatccgtgcatggcaattcatatgaagcacattaacacaacccgacaacgcataccgagccacattgtcggaatcggctcaatcggctatctagtccgactcgaactctgccgatcctgattgtagccgatttggactttagccgattcttgctctgtttccggaactatctctatcttggattccacttcggttttatctcgatctccgatacttgaattaccaaatttggttgttaacaaggtggaggtggtggagggtaacgagtccacgcggttgggcgtgagcgttggatcgggagtccacgcggttgggcgtgagcgttggatcgggagacacgcgggagaagtgacgacgtgagcaaagtgggaggccatggcagttgctgtcccgaggtggctggaggttggggatggagttgacgggtgggactatcggagagagaagggtgaaccaagtaaggggtaggtaaagcgaactttggtgagggaaggggcgagcgggctgagtagcgagctgggccggggagagagaagaggggatggcggcccgaggtgagggagcgggccgtgcgggaaggggcaatggacttcgcgcaggcatgtaaagtaggttatgcttgagtaacatgtaaggtggaatatcaatcggatggtacctgctacgcttgaaaagtactatttctttataaattttcttcattgacattgcttagataattttttacaagatatttgtaaggtttgaactatataatatttaattcattactataagcaattaccaatgatcttctttattttctaaaataaagagtgagtccgtaaatacgtaggagacatatatattgtgcgcgtcgttttcctattatatatgtgatttatggtgttctttaaaaaaataactagccaacgtgagtcctaaatttaaagttgatagtagcatatatatatatatatatatatatatatatatatatatatatatatatatatatatatatatatatatatatatatatatatatatatatatacctttttaaccaaactaagtacttctacgtcattgctaccatagtatgtcttatatatgcaataaatatgagaaactcataataccacgatataggatagatggaaggccattaatatctaagcactcaaacatggttatggcaatagaacatacgatggttgttccaattttttattttttgcaaatgtattagattctctctaattgatttaattcaatctctattgacatttttttctacttttctattttattttatacaagtcttattttaggttaaaaatataggcattatggatcaggaattgttggtttaattatttaataggagaaaattccctgtgtacccttgaaacttcacccaatcctttctatgcccctgagatttgctcattcccttccatgcccctaaatttcagtttggatcccttctatacccattccattagttgactgttaattgaccactaaatttctaccataaagtccattttgccctttgctatcaagaaaataacaatttatgaagtatattgatgaagtgtataaatttattgtatgtgactattatatgcatgagtttattttgtgagatattatttaacaaaagtaatattttagtttcgcctcgcgaagggaaaacaaaaataatttttatccatgacaaccctttggtatcaagaaaatataaatttatgaagtatattaatggagtgtataaatttattgcatgtgactatcatatttatgagtttattttgtgagatatttttaacaaaaataatattttagtttcgccttgcgaatggaaaacaaaataatttttatctacggcaaaatttattttatttaaaacaaaaaaataatatttttttaccattaaaaactgcatattttgttagagtagtacggaattttttataagataaatcttgttatgcgagataaaaaatatttttgttaaataatatctcacaaaataaactcataaatataatagtcgtatacaataaatttatacactccattaatataattcataaatttatattttcttgataccaaagggtaaaatggactttatgatatgaatttaacggtcaactaatggtcaactgacggaaggggtatagaagggattggatgaattttcaggggtacagagggaattttctcatttaatagagcaataattagattagaaatttgatgtatatcttaaaaatatggtcttttcagtattattcatagtctggtttgatagctaaaaagtagaaagggggaggaagaatggagagcggagagcgtgagccaaggttgaaggggaccagtagtgttgtttgcatgtgccggggggatgaggtttggggaatttatttttctaattttttttataaataatttaagtaaaccgatgatcatatgttttttcttataatttgtaaggttttttgtaattttgatgactgttaaaatcatatatgaatgtcccctttaatgggtgaagccgacaatatcagtcgaggctttatttctccactgcctttaaacataggtcctgagtcgacatagtcatgccccgcaatgccagcatgaaacataattttaatgtctagttaactatcagcactctcatagagaattgcatcaataattacaaagttaagcactattgtcaatagtggcctctgctggggtggcttcaactcaaccatatgtatgacccttgctataccttgctatacttgtggtagcatagcatgcttggtgccctttaaggaaaaaaaagagggaatgtaggcgacgaaaatatttttccgatgaattttgtgtagacaaaaatttttatggtattaaccagtaatgtttaattttttattgtttagatacaatattctattttgaaaagagcaaggttgataaaaaaagatatagctaaacggatatacgaccgtgacaatcttggagtaccatatcattctttatattttgactaagatatatactggagcatttggtgtctcgtcatctcatctcgtctccgatcactctcctcgtcttcgtttgtcctggtcttcgctctcgctcgctagctcgcttgctcgctggttgagctgtggtacgctcgccatggcgtcgtcgacggggggttggaccacaggctcatgttcacgccgccgccattcaattgagctgctgtcgggaggcggcggggacatgctcgccgccggcgccagcggtgaggcgcggtcgccgtgggggttctccagaggcggagcaagggtgggcggcgggttgcccaatttcaagtccgcgcagccaccgagcctaccactctcgccgccaccggtatcgccgtcgtccgactttgccatcccgccgaggctcggccccaccgagctgctcgactccgccggggatagagagaagagagatggaagatatgacatatgggtccaagggcattttagaactttcacgcgatttctctctcctcttattttaatcggcgtggtgtccattggcaaattaccacgtttatggagtgttttcctccaaaagtgagttcagatagtgtcctaaggctaaaaccatgaaattggagtgtcctatagcaaaaattgcctttatttaattaaagaaatataaaggattataagttagatatatatttgaaaaagaatttaaaatatgaacatttaaagacagctgatttggtgctttatattaatctagtttaaccgtgcaaatttgcggagtaataaattttatttataatataggaaatcctattttaaagaccctatcgttcttacagcgtacatataggttttttttggcttttttatcttcctacataaggatatctgtttgtttttttaagagaacaatacataaggtctatatccctggccgtttttttttgacaaattggcccttttcataaacttatagcgaaactagcccgtgcaaaaaacttcaaccaaaaataggccgcggggtcaacgccaagcctcctggcactcgctggccaagctagcgccaaccgctttggcgctgaggcctgcaagcgcggcggcccatcttttcccccatgctgacgtggcggcagtctcagtgccaaccgccttggcgctgaggtggccaagctcagcgccagccccgttggcgctgaggtagcggcatatatgccgcggtcgcgccgcccctgcccgagccctgcttctttccccccacacagagctagggttcttccccccgcgtcaccctctctcctcccctctaaaaatcccctcaaatccacctcaaatcgaaggctatttagtgggcattgttttcgatattggtttgcaaagtaaatcccctctaaaaaccctaatttcccccaaagttttccctcattttcgtagagtattttggttgaaatcgtgggttgttaaatgttgctcgggttgtgttgtggattaggaaatgtgggtaaggatgcgacgttatagttgtatattgatagtacagaggattcataccatttttgtatgttatgcactattttggtaagggtgaagttgagatggatgtgtagagctgttgtattatgaatattttggggattcatattgattaatgttgatattgaagggcatagatcgtaggaacattgtaaccggtggttaatcgatagaatttttaaaaaatattttatttaggtctggagtacccatgttatgtttctatttttatagcgacgtattataatagaataatgcacatatttcatcggtaatttgatgtagatggatagattggtacgactccattttgatggcagtgtggtagatgaaagtactggtggtagccaatttgaggggatgtctgtcaggcagttagtgttttgcgccaaacccacatttgaggagttaatttcacgcacgaaggatgaattggattggagtgatgagtctgttggtatacaagggagatacgatgtaggtaccggtgcagtgtcgcataagtacatattagatttgaatggagaggtggaatgagaaacatatctggaaatagtcttgggttcacagttcaaatcgcttgaggtgtttgcttggaagaaagagcgtagggaatggaaggaagaattgtttgatctcaatgaaagtccgcacatagaatccctggtctattgtcatgaactgaagaccgatgtgcttgtggtggatcgaaagaagaattaattgaggacgatgtgcaggtaggggtggaaaaacaggttgaggaggatgtggatataggtgaggagaggcaccgggatgtggaagatggggaggtagagaagaaaatttcagatggtggtatggatgtgaatcaagcagataatgagaatattgatgaacttgagaagaggcggttgattttattcattagagaattccttgctgatgaaatttacactcgcgaggagtgtgaggaatctatgatatttaatggattaaacccgaatttgttgtatgctgatttggacaatgaagttgatgagtttgcatctgactctgatgacgatcgtccagtgggcaagatgtcagacgaggagagcactatgtttgagaaaatcattggtcgaaatccggaaataactcaattcgaggaccttagcaatggaagccttgctgttgcagatggtgatccacaatgcgatggagccttcgatgcaatgggggaggaaccgaggaagggattagaattttgatccatggatgagttgaaaatatggttgcagagctactctatccgggtgcaccgcccattccatgttaaggagtccaatgcatctgttaagtacactgtggcttgccttgatcgttactacgaatggcagattcgtgcaagaaagagcgctctagtgtggaagcaactggcaagcacttgcagctaacctcgaggtttataggtaacagattgcaggcatttgttagagcggaaccaacattgtctcctgcagctattgtagaggcagttgagcacatatggcactatcggcctacgtatggcaaagcttggcatgctaagcaagttgctatgaaggtcatatggggagattgggacgaggcataccatcgcttgcctatactactgaatgccatcaaaagtaagaacccaagcatgtatttccttgttgagtctcaaggggagaaatcaagaacggttgatggagtccataggcgtgtttttggtcgtgcttcatggatatttgggctgtcagtggaggcattcaagcattcgaggccagtgttagcaattgatgggaccttcttgatcggtaaatttagaggtgcattgctcacagcaattgggattgacgcagggttacaccttgttcctttggtgtttgccctggtagagagggagaacacgtccaattgggagtggttcattgacatagtgagacgacgtctgattggaccgaatagaaaagtgtgtataatatctgatagtcacgttggcatattgaactccatcaagaatgagattccaagccaccgacttattcaccacagatggtgcatgaggcatttttgtgctaacttttataccgcaagagctactcaggatcaaatgaaggacctcgagcgcatatgtcaaatcaacgagaaagttctattcattagcgagatcaagcgtctcatgggttttcttggggaaggtcctaagaagtggctaacggataatatggcattcaaggctaaatgggccagatcatttgataccaatggacgtcggtacagctttatgactagtaatatggccgagagtttcaacaatgtcttgagaggaattcgaaaactgcccgtgacagctattgtggcgtacacattctcaaagtgcaatagttggttcgtcgatagacataaagatgcttgtgcacaaatcaagagtagacacaagtggctagaaaaaattaatgatatccttgaggagcagaaaaagcgaactttgggacaacggaccacacaattcgattttccatccacgaagtaagaggtcaccgagcaaggtggagtcatggcagctggtgttcaatggggcggacgtcactatgtcatggttgcaagagataacacatgtacttgccaattcccttaagtccaccacatgccatgctcacacatgataaccgtttgtaggctccgaggtttgaatatagaggtgcccccacggatgtgttatgaagcttccaatgaggctatacaacacacctactccccgaggtttgagccctaccaagatccgtctcagtggccaagttatgacggtgaattattcgttcccgacttgtcgttgaagaacgacactcgaggaagacgaaggacaaagagattcaaaaatgacatgggtaaagggtataaaggtgcaggcaaacgacgactagtgaagccaaacaatacaaattccgagccatccaatcaaaatagatgttctatatgccaccaaccagaacataagaaaacccgtgtccgaatcgagacaaaccaaaggatagaccgaagaaacgccgtaggacggggggaggtgatgggtctagaacacgggttgttttttgttgtacatgttcacatgttttaatataaatatttattacaattgtttctttcatatgttttctcaattatgcatattacaattgtaccatttactaatgacttaatgtttaattgcaggatggcgcagtttccgggtctggaggattactacgaggagaggcaccgggctcccaagatagcgagcagagaggttatgcaatacccttttatttgtatgacaatttgtttctattctgcaataatttactaacacttgcattttttttagtctattgatgcaacgcctcaagacccttcgagtcagaggcaacacagcgcacatgtcgttcgacgaccgatacattccgtacctacgtcgggcgaagctgttggcgttcatcaccatggcgcagtggcccatgcctctgtacaacgccgcggcactgacggctcttgtggaccgatggcgcccagagactcacaccttccacctgccaagcggagagctgacggtgacactcgaggatgttgccatgatcctggctcttccaatgcggggccaggcaatagccggtgacaccgcttccggtaactggagggcacgggtggttcagtaccttggtgttgagcctcctgaggctcctgacgggcagaggttgacgaagacctccggagttcctcgtagttggctgcgtgccaacttctcacagtgccctcctaacgctgaccaggcgacggttcagcggtactgcagggcatatgtgttgtacatattcggcagtgtccttttccctgactctggaggagacatggcttcttggatgtggctgccattgctagctgattgggatgaggcgggtacctacagttggggttctggagctcttgagtggttgtataggcagttgtgtgatgcttgccgaaggtctagtgcagatgccaacttggcaggatgtgtttggctgctacaggtaggaggcagtttgtatgatgtgtttcatttgttactctcaagctataaatcctaacgagctacatcttgcaggtttggatgtggatttgcttaccggttggtcgtcctacatggaggcaacatccggcatggccattcgaggatgaggatcgacgccccacagttgctttcctttgggaagtgacaccgtcgcctgtagtaggccctagaaacttggcctattacaactacaccaatgagatggattacctccagcccgagcatgtgagtagtcaattataatatcatcaaccatttgggatttgatagctgtactaactcaaaatttgtttcacaacataggtggaatggatgccctacgagtcacaggagatagctgaacttggaattaatgccatgtgcaacatagagtggaagatgaatacactacggtgccctctcatatgcttctacgcagttgagtactagctttgccaccgggtgatgaggcgttcgggaggcggcaaacgatcccgcaaagattctctacaagcatcaatatccataagtaagtcaatttgcatccgaccatttccattaaaccactgtccattaatttatataactgtattgcgtgtagggtggacaaaaggaaaaacaagaagaccaccggttggattgcttatcatcatacacacattgatcgatgggaccagtttgaagccaaccgcgtggcggatagcgcaatgcacaacaggcaagagttcgacgcatacttagcctagcttgtgaggaactaccgcctcgccctacgtccggcttggacgctagtcgacatagcggacgacccgactaaggtggaggagcagaacgagtacgatacaagtactcgtagaggtagcacgttcgagacgggtccggttcgagaaagagtggtgagtatgggttctttttacttgttttccaatttccgtactttgtgtttataacttctcctacaggcacgagagctagtcagggcagtgaacgatgcgggcgtggcatttggcacgccccctggctcgcaacaagagagcagcgttctttggaatgccttataggtagatttgtaaaattcatgcaccatacacataattggaactaactccttccttctgttggtactagactctacgacagcgttgcaggaagttggcggcacggctgggatgcagggtcgacaatgtcgtcgaaccacctcgacgggccgagcaggggacaagtcgaggagtggctcaagagggtgaacaagaggaagagggagaggaagagggagaggaggagggagaggaggaggaagagcaagtggagctcggtccctcccagctgcaggacgctccatagtcatcacaggggccatctcgaccacagcgcaagagagctcctgtttccgactagaggtacactcccgatcagcctcgcgctccaaggggtaggaagaagtaggttttatttggttgggtttagttcggtaacttgtgtactttatgaaacccacaactatattgcgacttgaaatcttatattttgatgaacccacaactatggttgtgtttaggcttaagtctgtggatggatgtggttgtgatggaactggatgtgtatggatttttgatgtttggatggttatgtttatggatggatggatgtatatgtctgtgaatggatggatgtatttgtgttgatggatgtatatgtgtgtgaatggatggatgtatatgtgtgaaaatctttattggcacatctatattatgctgtgcatatagttaacctgagatggacacattctcctgatggcaaataagtgtcacacggttaaaatggctattttttccagctgatgtattcaccatgtgaccttgatcaaggtgacacaccttttctaatctgtattccttctcttttttcagcttttcctgtcccatgaatcaattgtgatgcaaccatagtaaagtttcaagggtgatcatgtgcttatgttactagtgatgagctgctgtttattgctttgaaaatcatattgttcatggccatttgtattttatatacatgactgactgttatgttagtgttatacaggttcaggctgttctattggtttagtaagcatggctgtacctctattggtttagtaagcatggctgtacctaccacattcgatgaaaaggtatccatgttctgtagaatctctacacaaaggttgtttgaatgcatatgcacttttaaatggcattcctgtcttgtatatgtgtgtgatgtttgtgaatggatgtatatgctgcgacagtggcagtggctgtatgccagcggctgatgaaacacctcagcgctgaggttaaatacatcagcgccattacagctggcgctgagatcccctccgggccacacagagtagctgcttcggcgagcccggctcgggtggctaagtgccgaagctggcgctgagatccccgacccggccgcacagaggggatgcttgggtgagcacggcatgggcggctatctcaacgccagggcactaagcgctgaaattgaatgtctcagcgctattatagctggcgttgagatccccgacccgaccgcacagaggggatgcttgggcgagcccggcacaggcggctatctcagcgccagtgtacttggcgctgaaatccccgacctggccgcacagagcgattgcttgggcgagcctggcgcgggcggctaaaggccgaagctcagcacaaaaggaaatggcgctgaggttggccatcttagcgccaatgtaggtggcgctgagatccatgccacgtaggcgtgggggaaaagctgggccgccacactggcaaggctcagcgccatggtatttggcgctgttctggccaagctcagcgccagtgtaacatcccagcctagggcttaataggattaatagaatactcatatcaacaagttgcaacttcttttccggaagccgatttccaaagaactcaagggttaagcgtgcttggcctggagcaatttaggatgtgtgaccgaccaggaaattcttcccgggtgcgcacgagtgaagacaaagtgtgcagaattcttcccgggtgcgcacgagtgaggacaaagtgtgcaggaaagacatgtgttggtctgtgagggcagtctatgacctataaaagctatcagatgtaagcgggcccggcctgggggaaggcggtttcacgggcgcgtgggtcgcagttgcgcaggcatggtgcgcatggctggtgtggatccgaagtggtcacacagcatggcacatgcgctggcactggacacacggacgtggccaagaggggacgttcctggcctagggttgatcgacgggggcgtcgatctctcttaagggggtgaggatgtaacatcccagcctagggcttaataggattaatagaatactcatatcaacaagttgcaacttcttttccggaagccgatttccaaagaactccagggttaagtgtgattggcctagagcaatttgggatgggtgaccgaccgggaaattcttcccgggtgcgcacgagtgatgacaaagtgtgcagcaaagacatgtgttggtctgtgagggcagtctatgacctataaaagctatcagatgtaagcgggcccggcctgggggaaggcgggacgttacagccaggatacttggcgctgagtccgcagtctatttttggttgaagttttttgaacgggctagtttcgcaagatgtttttgaaaagggacaatttgtcaaaaaaaaaagggtatccccagtatgtacgttaatttttctagtaaataatttctatgaagctgagacttttttaaatagatctaatctaatggtccaaaatagcaggcccaccaatttaagtgaaaatcgacagttagattaaaaagtgccatgtggcagtttaggagcgtttgtaggagtaccacgtggtggcttaggagcgtttataggaagtttcatggacgacttttagtagataacagatttaattaattgactaaatgaactttgtgatattaaaattatttcttgagctccaaaaattcacatgaaattttagagagtattttatagcacggaaaatattataaaaatatttctagccatgattttttaaaggaaatttttaattttctgataaattgacttgattaaattgctttgacttttaatataaatttaggaatacattactaagagatttttaatcccgactgaaaattggtcgtgacgaccatccgcctccttcgcaaccacctcaaacaacccgaaaggccgaaacatctcctccctccccttcaaaacgcagcgtacctatcctcctccaccgccacctctgtcgatcatgcccgtagcacgagatggtggatctgaagccagctaaggggcggtggtggcggcagcactgcagtagaagggagatggcgtcagcgcggtccccggaagggggtgatgggggagggggggtgcaaggtgtgatgcgggcggctacggaaaaggcgaatcctggagcaggaggtggcgaggtgctcttccaccatgactacgatgacgacctaagacagcaaaaatgacagcgatgttggctaaccgatgattcggctcctctcacacgagcacacaagcgagaatgaaaaacataaacacactggactagagaattttttttgctgcacacctgcacaccacagcactcacaagcgcactgctattaatcacaccacaaaacacaagctaatacactgcttaaatagcacacattaagccatgttctggccgcactacccagccaaacactgcatggtttatccactaatcacttccctacatgcaggccacatctccttgcatatagaacaccacactcacacgttcagttgcaggtatctaatccgccgatgcatgcgtccatgcaaaacagactatgacctcttcctgctcctaaactgtagacccccgtttttataacaggaatcaatcgtgtaaatagtaccatttccctggatcaagtagtctggtacacacgagttcatagctgtaataccaaatgctcatacacgagagtctagtgcgaattattacaacataagcccgcaggcattgtcttaaatcatcggaccgagcggtccggaatacatccaaaagcagaaatagataaggtagcggaattaaggcagcggcatgccatcgccacaggcaacgaccgtactaagacctattgagcgccatcgtcttcatctccctcctggtagtaggcatagggatcctctaaagcttcatctcccgcttctgattaattttatattcgcaagggtgagtaccaaccgtactcagcaagccaccacagcaacaatacatatgaaaggggtatttcaaaggatggctagggttcttttgcgcaaagcaagttttgtaattcttttcacaagcctaagacctagcattgactgatcaaattttagtaccagtgtttgtatttaaacaacgacggttctgtccaccatccattgtgatcccaaggatagcttcccgccattgaatcgttatggttttctgaggacgcccaccttccctcttcttaggaagtggctacatcagcataaaaaaaattcatcatgcaacaacccatcccacacaagttaataatttagagactagccaagtgtaatacatgtcccggtgctcaataaccgcgagtacggctattcgaatagatttggtttactcacactgcagtggatgtacactttacccacaccccgcgactgcccaacacatgagccttgtctcaacacatgagacgcgtcacggcaaagcttttcgataacctcgcattggcagtacccgctccatgaacttttcatcctcatgcactctaggcgtacacagtttctagcagtgagaggagttctggcgtacccgggaagggaagattcacacccatgtatttaagttataactaggttcaactcaacactcgacagtcctagcaatggcgacaccattgtagagcccctgccttacacatgagaaaccactatgcatggatactgcctccgcttggctatttactccgctaggtctatccccattcgagaaatgtggttgtacggtgtcgtttcatgcttaacttcatggcttggtctttaattgaccagggacggtactagcctttcccggataccacccaaatccaccgtccgccccggtctaaaacaaaggtttttaattcctttcatgtcatcattatcatggcaatgtggtgctcatatctccacatgccgcatcttaattaccttcacaaaggtaattgcccaagcatataatatttgataaacatgagtatgcaagattctaaagtagcatttctaagcaagtgtcatagttgactagggactcatacgtaatcaaggttacaaagatttaagggtaaacaataatcaaggcatggcataatcacaagtaggatgttcatcattgcatgcaatcttatttgtaaataaaaattgatttcgcaattgggatcaacgtgatcaaagaatagtgatgacttgccttgctcgaggtcttgcgggtcttggccttcacccggatccacggctccctcggtccctatagttacgtgcgtaagaacaatttgaattcgattagaattcaaacaaaatccaaataatgaccgaattgaaaaacgagcgcgggaggtgaattctatataggctactttattcgcgaagtggaattattcttctccctaagatatcttgtaatttatagtcatgtcctaagacacatcgaattattgagttcttaatcacatgtaaattattaccgcgaaattgattccctatggagattactaaaaataatctataacaatccataaggattcatctaattgtttagttcttaaataattaattctataatcaaattctagtactttaggtatttaaatagtaggaattcatctagctatattttcattaatcctataattaaattctaatatttttaaatattttaaatctccccctaatttttccctttttcttttctctctctctcttttcttttctcttcctattttcttttctctctcttttcctttctttttcttttctctctcttttcctttctcctcccggctcctcccttcctctccctctcttggcttcttgctctcccggcggagtcggcgatgaacgcaagggggggggcggggcggcggcttccgatggcggctacggcgacggcggcgacggtggctcgaagcggcagcgtggcgacctaatgcggcggcgcggcgacctaatgcggcggcgcggcggcgtggaggtggtggcgcggcgacggcggcacgtggggaaagcgaagggggaggggaagatgggggatgtgtgtgtggggaggcttggggatagagggaggggcttatatagggcgcgggaggggggcggcggcctcatggcgtcagcagggtggcgcggcgcggggctcggcgcggcgat

SEQ ID NO: 79605 - DNA, 2907 bp, Oryza sativa
aaagggagctgggccgagaggggaggaggcccaagaggagggagagaaggagagggagagaaagagagggaggagggaaggacttcgggctgggcttggcccaaaggaggagggagggttgtttttagattttctttttaatagactttgataattgttgttgttgtttaataattatttccagtgctctgaaaattcaagtaaaatttgagggctccttttagaccaaggagaatttaacaaaaaatctccgggccacatttgaatttttcttgcacgtattttagtgtttgccaatttctttccgaattttaattaattctattattccttttagaaaatgaattttatttcgggatgaatttatcaggacgtgacagcaaccgattattttaccaagtgggtagaggctattcctttaaagaaagttgattctggggatgctatacagttcgttcaagagcatataatctatcgatttggtatccctcaaactattacgactgatcaaggttcaatttttgtatccaatgaatttgttcagtttgtcgatagtatgggaattaaaatgttgaattcttcaccgtattatgcacaagttaatgggcaggccgaggcatctaataagagtttgatcaagttgattaagaggaagatttctgattatcctcggcaatggcatactcgactggctgaagcattgtggtcttatcggatgtcttgtcatggatcgatacaggttcctccttatgaacttgtttatggtcatgaggctgttttaccatgggaagttcggatcggctcgaggagaacagagttgcaaaatactttaacagccaatgagtattataaccttatggccgatgaaagggaagatctggttcaatcacggctacgagcccttgcaaaggttactagggataaggagcgagttgcccggcattataataagaaagtagtacctaaggacttttcggaaggtgaacttgtatggaagttgattctgccgattgggactcgggatagcaaattcggcaagtggtcgccgaattgggaaggaccgttccaaattcataaggtggtgtttaagggagcatacatgttgcaaggactagatggagaagtttatggccgagctctaaatggcaaatacttgaagaagtattatcccagtgtttgggttaatgcatgatcggctagtgttgccgatgcatgatagccgatgtgtttgcatcgccttgggatggtcgatattgttatatcgcccttagttgcttttcactattgtaatcggttgtggtttgccgatgtacgaatggccgatattgttatatcgcccttagtcatttctataattttgtcaatgttttcaacattgtaaaattacgggggcacatacatagaaaattgcaaatttttgcaaatttttgtgtcttagccgattacaacagtttcttacagactattacatggaaatcactgagacaagtatcgctggatagccgatatagccctttgcctaatctgatttatttcttcgatggcttgggcgtcttgagcatcggttccaggaatgactttcaaggatttagtcatctcagcaacgttcttgattgccgattttagccttgccttctgctcttcgacagcttgcaggagatcggctaacttcctgtgctctagatccagttcagcattgcattcttgaagttgtgccaagagttcaatcttgcgagcttcaagccgatcaatattggatttgatcaggccttcagataactgatcaagcttggctttctcttcatgaacaagctgtcgattggtttggattgtagcctcgatgtccttgtgttcccggagatcggctaacctctgcctggctttctccagtttgaattgatgctgctcgaggtagacagctggagtaagagcatcgactaattcgtccggaagagaggcttggatatctgcaaatcttgcccggatcgagccacagttggtcaccaggttatctagtgatgctcctagccgatgggagatgtcttcgagtgttttcttcacatcatcagacaggagagctgttgctttactggtggtgtcttcttctgtttcatcgaggtaatctttgatgtcaaaggagaatagatcggctaagacctgcaagagacaatatcatggatgattaaggatcaagatatgattggccgatctcaagtttatgttaataaaacttactggaatagtaggtgcagctaattgttcctcctcttcaacatgatgactacctgcagccgatggagtgcggccgcctgattctacctgcataagaggggaagaaggaggaggaggctgccaaagggataaatgttagatataatcagcccaagtcagttaatgagatgatagaagtatcttactggtggagctggtttaggggttggagtaaccgatttcttcctcacggcaattttctttctctatatttattaaaattgtgaggaatcggctataaagtaaatgactgcaaaagtggacagagaaagttgcttacccttgccaattgagctggagcagaagggaatggaggagcctgcttaggtgaagccgatggtgttttttcagtatcgcttatttcggctgcggcttggtcgatgtcttcctcgatttcttcttcatccagagcttgttcgatggatggatctagggcgggtagatcgtcagctggcttagctttctttgtcttagccttcttcttcggagccggggctgaagtatctgcagccgatgatctggttctccgcttcttgccggcatcggctggttctctgatgagtccttggagaagtgctgaggtctttggggcattgtagccgatggcagaaggagatggcccacctccattgggaa

SEQ ID NO: 79606 - DNA, 10335 bp, Oryza sativa
aaaagaaagaagaggattatttttaatttttttctttttaataacatttgtcaattgttgttgttgtttaataattatttccggtgctctgaaaattcaagtaaaatttgagggctccttttagacaaaggagaatttacaaaaattctccgggccacatttgaatttttttcttgtacgtattttaatgtttgccaatttcttttcgaatttttaattaattctattattccttttagcgaatgaattttaattttgggatgaatttatcaggacgtgacaaatccaccccccttacaagaatctcgtccccgagattcgaggaggctagcaagaagttaggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatagggcttcagttccagaactttgcatagttcatatctttggagtcaacctcatacaagttacccacttcatgtcatgcgtcgagatcagctcgtcattactaagataccatgcttgtcatcatttagcattcaaagtattcccttacacattcagccctgacgtattctttttagatttctcttatcaatcacctttcgacctacttcttggttcgataataaacacctttgctggtatcttctatcaatcacctcgtaaactttgtcaaccaagtactcttcactccgagagttgtggatgcttctggtgacgatgaggtcctttggcttgctgcctttcagtgaaacccttgaagtgtttcgccaaaagctatactaactgtcgttgcctttgatccgaaaaggactcatctgtaactcttagtccaaacaaatgtctctttggttaatcacttgatttttcttttccatcctcaggttggttattagctcgaggttagaatatagttcctctggcacgagaccctaggtctcctttgtcagtaaacaattatacacatgatcacatatcagcatcttccaaaataatcctctttagaacttgtttttatcacacatgtctcccttattacacgaatacacggcactaccttaaacaaaaagggaagatgcttaacatcggtacattgtttatactatgggttagaattaacatgaggcctcacaggtacggcgtttgctccagtgaccacaaggcgagtgactcgtcttcttcttgcataatggccggagtgatggcgcaggttacgcttcggctgtggacaatctctagagaaatgacctggttctttgcagttgtaacaaatcaacgtcttctttactgagctgtccatctggggacgatcattgtgacttggagttggaattggtggttggaaatccttgctaacattggcatcagtggtaccatagttgctatcaccattggagtctttctcagagtcaaaattgctaaggttgtcattctggtttccaacattgatactatcgttgacatcttggtgaatgctactgacattgcacgctttattcgagtggtcactaatggggcaagaaccatggttgttggtggtatcatcatcattagtattgctagtgttgttgtctgcattgcgtccatcttcttggggcggaaactcttgatgcgcaacagaagatccggtgatctgaagtggctcagtgcgctgtctttggttaccacctggaaaatactggatgttgacaattctttctttgcagttcggtcttcgattatgctcactttcgagtttcatggttttgtccacaaggttctcaaaatcttcataatcctctagaagtagttgcactgcaagctcatcttttaacccctggagaaacttctcttgtttgtcttcatccgtttccacatcttctggtgcatagtgagccaaacgatagaattcatgcaggtactctgtgacggtcaaatctccttgcttcaggtagcgaaactcttgttttcttagtgtgaccattcctgcgggaacatgtgatctcttgaatacagatgaaaactcgttccaggtgatggtatgtccttctggccgtgatgcttcgtagctataccaccactctgaagccggtccaaccaactgatgagctgcgaagccaacccgctcctggtcggtgcactgaatcaaccctagcttcttctcgattgtgcgcaaccaatcactggcttccataggatcgacggcaatggcaaaggttggaggccccgttttgagaaattccgataacttgcactgttgctggactgtaggtacttgaacgttggttgcccctgctgggttgttccgattctgtaatagttgaaaggctgttgccaacatgttggtttggttaaccacaatttggattagctctggtgaggtttcgttgatgcttttctcattcccattggcttgggttcttgagtcatcggatccatcattcccatagcctttgttaccagtattatccatctgtcacaaggtagaggttgagagggaaagcatacaaggaaagaatagaccagagctagggacaggaccttaaaggaactaactctttttgttgatgtgttgtttgttttgcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatctatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcatcaggcctgacaatcaaaaataaacagcagcggactagcggacctacggctccatcttcacaggcgctcaactggggtataagccaggactccacctaagacatcttctccaaagcttctcttactgaagagggaaaagattgagcaagaatgagtacgaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataatccgacaattccatagtgtccagatgatatgagaattcccaaagtctaaagttataaaaccacctaatgttgtcctatttaatcagcgaagcatctacctaaattcatactagtggaaccatgaatagagcacccactagttggggtttttattttcctagggtgaacaaggtaataataacaataacaataataaggtcataacaaaggtaattaggcatggctagataaaacagtgataacgcgggaatttaaataaagcggtaatgcaataatttaaatcaacataattttacaaactgggattcaatatgttcaaggatgatgtgacttgccttgctcagagagaacggacttccgaaccttcggcgacgaccacgaaccacgcttcgggaacttccgggacgacagaagctacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaggtttaatgctgttatatggagatttgcggattattataattaagctttgcaattataaaacatgtgtaagcgctagcctggaaaagacaggaaggctgcgccgttgacatgcggaccccacatgtcaacagaagggaccgcggtagaccgagtacacagagacggtccacgggtcgacggaagcggaccccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgatcgcacaacgggtacggggcgacaccgaaaggacgagggcggggaagcgagaagacggatccttaccaccacgcgacgaggcgtgggaacgacaacgacgaacgggcgcggcggagacagacgggcacaacggagacgaacggcgaggggacggcttcggcggcgatccttgggcgaaggcgagacgcggccggcacgaggcttgacgacgcggagccgaggacgaacacgaggacggggctgtagcgactcgcttgacgaacgcggacgacggacgagaacggcttgacggagggacgaacgccacaacgatcgggaacgacgagaggacgggggcgacgacgaccggggccggcgaggaggcgacgaggacagccggcggcggctgcacggggacgaggacgacgagggacacgccgctacgatgacgatgacggaggcggcgccgcgagacgacgagccgggcgagagggaacggtgaagacgacgacggacaccggcggtgttcggtcggaggggaggcgaggccgaggacgacgtcgcggctgcgatgccgaagatgatgggggtgtggccgaccggtgcacggcgtggagggacgggcggccgaacaactccggcgaggcggatggaggggctcgcggcgatggcgttccggcgaaaccgaggagtggacgaggtggagggctacgccaccacgcaagggagagatggcagcgccggctgatgcacgggcgcggcggaagggggctgccggaggagatgtcgacgaggaggaaggtgagaccggcgcgggcaacggcgttccggcgatattcgggcgacgccgtggcttggccgggaaagaggacggcactccggtgccgggaaaggtgatggcgacgtcggccggcgctccggggacgcggcagaggcggccggaggcgaaatcgtggcggcaacaccacggttgccggcggggaggcactcccggaggtcacctcgcgaaacggagggcaagccggggtggaggaggtggcggcgacgctggaggaggcgacggcgcggccggccggcgcacggtcgaggcggcaccggcggctggagacggccggcggcaagggagagagaggaggacggcggggagaggtgctgcggccgtgggggagctcgggaaggggctaaaacgagagaacgcacggagggggttgcattttataggatgggggagggagccgggcacgggagagggcggaacggcgacgggaatggcggccggcggcaatggagggcggccgaggaagacgcgggcgttcccggcgattgggggcgccattcaagggggaaattagggggaattgaagaggagtcaatggggattaaaaccccccaattaatttcggaatccatggtttgatttgcgcggatttggaggaggaacggagtagggttcgcacgggagggagagaaggccgtgcgggaggaggaagaaggcgacggcgccctggcgcgtgggccccaccggtcaggcggcggcgtcagcgcgcgcacgcgcgcggcacgtgcgggaggggagcggctcgggggctggggcggcttgggccgagcggccggcccaagaggagaggaggggaggcggcatgggccgagcaggccgggagggaagagggggggggaaaaaggcagcccgagagagagagggaggagggagtgggccgagagggggagaggcccaagaggaggagggagagaaggagagggagagaaagagagggaggactttgggccaaatttggcccaaaagaaagaagaggattatttttagatttttttctttttaataaactttgtcaattgttgttgttgtttaataattatttccggtgctctgaaaattcaagtaaaatttgagggctccttttagaccaaggagaatttaacaaaaattctccgggccacatttgaatttttttcttgtacgtattttaatgtttgccaatttcttttcgaatttttaattaattctattattccttttagcgaatgaattttaattttgggatgaatttatcagggcgtgacataaattaagtggataaatcgtaataagcaaatatatggacttataattaataaaaattccaatagtcatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctctagtcaattataattagcatatgaatgatagtaaattaaatgttaaaaactctaactaacatatgaaattgccacttgcgtgatttaaaacttttaaaaatcctctagtcaattataattagcatatgaatgctagtaaattaaatgttaaaaactctaattaacatacatatgaaattgccacctatgtgatttaaaacttttaaaaatggtaagtatcacatataactagcatatacatgatttaaacttgttgaaacctctaataatcgtgcataattaacatatgccatacatcaattgatttatatggataatcaatacatccaaaatagtttacatcgtgtacacaataattacggcattacatcggcggtgacggttcactgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgatgttttggttcgtgctcttcatgtcttgggctctcgtgtagaatgtgtacccattgatctcatatccctggaatgtcgcgatcgacccagacggtcccctcgccaggaaggcaaattgttggttgatcgactcgttacccatgagatgttgtcgtagccacgcgaggaaagtatcaatgtgatgtcgtgtaatccatgcatcggacttaccgatgttcctggcgcgaactaaagccaagtgctcctcgatgtaaggagctaccaatgaagagtgttgcagaacagtgaaatgggctttacgaaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatactttttcagaacgcccatgtacctctcgaaagaaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgactttctgcgaaattacgttcaagaatgcacatagctttgttattgttgcccgaacattgtctggaaggataccccttattataactggtagcagttgtgtcatcaacacgtgacagtcatgagactttaggtttgggaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttatgcaaaggttcttagtgaggtgcatcacgtcgattgcgtggcgtacgtccaagaattcccaatatggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtgtcatccatacagtgagtgcaagccttgtaccccttgttggactgtccggataggttgctaagtgcaggccaatcgttgatggttacgaacagcagcgctcgtatgttaaactcctcctgtttgtcctcgtcccacacggggacaccttccttcttctacaactgtttaagatcttcgaccagtggtcttaggtacacgtcgatgtcgttaccacgttgcttggggccttgaataataatcggcatcattatgtacttcctcttcatgcatagccagggggggaggttgtagatacacatcataacgggccaagtgctatggcc

SEQ ID NO: 79607 - DNA, 10132 bp, Oryza sativa
accccctcgacccaatccggcgcggttttgtcctacgtggcgtacgcgtggcaatccagtcagtaccttatttattaaaaaatggggtccccctgctcagctcgcgggatgaaggatcggcgcagcctgctcagcccgccgtcagcctcagctcctcgcccgctgcccgtagccgcctccggcctcggctcctatcccgccgtccacagccatccccgccgccggccgcccgtcggcgtcggctcctcgcccgcccgccgtctgcagccatccccgccgccggccgcacgtcggcgtccgctcctcacccgcagccaccttcacgacagcccgccgccgcctccgtgcccgctcacctccagcctcagctcctcacccgccgccggccgcccgtcagcgtcggctcctcgcccgcccgccacccgcagtgttcagttgttcaccgagagagaggggggagagaaggagaggaaaaaaggtgttgatagctaggccccacccgtttatatttgtttttgctgactgtatcgccacgtgtgtgccacgtaagctgaaaaccgcttcgaatcgagttagggtggaaatttagccggttttaagtgtttggggtgtcaaatgtctggtattatagtttagggggggtaaatcgtattaccgtaatagttgggggagggtaattcgtactttttttctttataaaaaggaggttattatttttatggaaggagtacttattagtgtcgattactgttgttccgaatttgaccatcagtaagttttactcctaatcatcaatgtatattggacatttacataaaaaaattgtatattggacatatatgaaaaatattcttaaactttagaaactgttaatcacgattaatttctaagaggatttgggtgtgtttgtttgtgctgttagaggagctactccctcctttattgtggacacacttatcaaaatactaaatggtacgttttttaaaaaaaaatcctatataaaagtcttttagaaaataaaataaatcatttaaagtttataattattaatacttaattaattacattttaatggtatgcctcaattcatatgccactaagtaagctgagccaaactgcacatttgaacgaagccttagtgtaaaaacaaaataatggttagtgtgacccccttttatttaggattttgtggaagaattttgtaggatttaaatcgttatccttttgaaacaaaaaattagagctttccaagtcctatagaaaaattcctatggaatatctcgatgtaaattttggaataaaattagtaagagctttaaccttttgggaaaaaaagagtccaaactacatataatttgactaaattatcataaaactatatatttaaggtgatatccctcacaaaactacagatttaacaataaaattatcacaaaactacaggtttaaggctaaatatcacaaaactacagattttggggtttaaattcttagcactaatgctatatttgagtgatgtatgtccaagttttctgattgatattaaacatatagttttaggataatttcattagtaaatatatagttttgtaatacttagccttaaacctatagttctatgataaatttagtaataaatatgtattcttgtattatatcatgttaaatctatacttttatgataatttgattaaaatacctatagttttgtgtttactaaaaaaaatccttctgaggatatatctctcttatttatttgattcctgcattttttcttcacggtcattcaagtgattgtccttgtattttatttcccatgcatttttataattctctattttatatatacattcctagcaaatatgttttttattcccatatctaccattcttgcatggctataaatttgtcttggaagtaaacttattatattttatagacttattctgacacaaaagagatggcaaacgttttaaatagtttggcataatattattcttagcatctgatatttatgacaagagagtgtatactattagattatgatgaacaaaagttgcatgattctattcatgatgcaaattagtttgataacatgtcaaaattaaattcaatattgtaaagagggtaaatcaaaatttgaagatgaacgctactcgtattatttgaaaatagagataacagcataatatatgtatagggtggtggggaacatggaatttattctctcgagacaggatagagtgccccactgatgagtataccctacacacactgtaaaggaaaacatgcagaatcttgctggattaatataccagtcgaagtacatccactcagagggagtatattacaaccatgaccacgaggaggactgaaccagttgaaaacatgccgaatcttagttagcataagcagcacatcactagtagccaagtaatcctgcctcaaatcttggctttagcatgcaatcctactataataatgtctatttgaattttatcacttcgttttcttatcatatatttgtacaaattattgaaagtataacaaacaaagaagtatttgttaatgctatatcaaatcttagtatctttatatatatatatatatatatacatatatatattagtgatttaagattgtaaaaacttgactcagcaacaatactacttatggagtaagcattagtattaccttgaccactaattattgttaaatggtcagactgtgtttaccatctttaagtttttttgtaattttctatagaaaaactagaggtcaaagtttgatgaatagtttccctatgaattattatctccatttaatattatagaacttcaaacttcttttagatctgaataagcttatagaaaaagatattaacattttgaagacaaaatgaacatactatcgtatcaaatatattcgatattgtatttaatatactaattcggtattataaatgttttttattataaactttgtcaaacttttaattttgaaaaagtcaaaacaccttacaatataaaaaataatggagtagtatttttttaaaaaagtgtgctatcttgtttggatgatacccacactattcatagaaaaatatgtagtgtaaacatgtaaactaccgttagataaacaaaataagcgtcttatatatgtccacgtcactatgagtgaaacttttaatgatggttaaatttaggagtaaaagttttacataggacaacatagataattctcagtcatctaatttttatccaacggtagtttttaggttcgcactacctatttttcccatttttccctactttttttctaaccatacttagggtgtgtttagtttacgccaaaattggaagtttgattgaaattggaacgatgtgatggaaaagttagaagtttgtgtgtaggaaagttttgatgtgataaaaaagttggaagtttagggcctgttcactttgatgccattttcaaccttaccaaattttagtaaagttgtaaaaaaatagctacatttagtttgctgccaaattttgataactatataagaaatcctgccaaaattttggcatagttatcaaaatttcggcaatgccaaaatttagtaagttttttttggcattaaagtgaacatgcccttaaagaaaagtttgggaactaaaccaggccttgggacaaggttttgcaaaagaatgaggttatggactttatgatatggccaagagtttagcatgacaaaacatgacatgcaactaaacagtgtcgtgtctataaggacaattttgccagtggatttggtgaaagcatcttggctttaacacagaccaagaccaaggaataaaactgaagtgtacgggcggtcaacatgaggattgatagtactactcctacaccatgaacatgaatgcagccgttctactactactccgagtatctctcctcgtgcctctgccgcctgcttgtgtcatcgtgtgcaagcacagtagcacgcctacacaccatcaatggaatcagagcacagtggaggagacaggacgagtgtttttgccgtcagctgcatccgttgcctatcatttattattatattttgtaacctagaaaaaaaaacttttatgtaatgttggtatgtacttcctctgagaaaactttattaaggaaaaaaactaaaaatatcccttgttaatgctccctccgtccaaaaatataaacatttctagttgcttatccagatttataactaaaatttattatattttggacataaagatagtaagtactactggtaccatttacacgtgaatattaaaggattaaacttcttgaattgtgaatgcggacatcaatgtccgaattcatatgtttcggatgattttaagccccttaataaattggatttttatggattaattttaaatgtgttatagcgtgtttctacgagcataactattatcaatagtctaaaagttaatataaaaaatagactacatttccttaaaagaattaataaaagacaacgatgacaaacactaaagggtgtgctcgaaactgctctttcaccacaaattttagctgcatgcaaaacgagatgaattattagtttatattaattaattgagtattaaatataaaatgcatttgtaaaaacacatcgtttagtagtttaaaaagcgtcctcacgataaatgagggagaaatagattcacactcatgtctgaactcagtctaacttttaaaatttaaattttggccgtggccaataaactaacaaatagattaggaaaagtacgaattacccccaccccgaactatcgcggtcgtccgaattaccccctgaaccacagaaccaaacattctttacctccaactatgcaaaccggacgaattaccccccctcaaaccaattcagagcggttttgtccaacgtggtgcacatgtggcaatccagtcagtgtttttttaataaaaattgtgggacccgcttgccatactcttctcttcttccctccctctctctcttctctctctatctctcgcatggcatcggccgccttcccctcttccctctcttcactctctctctctcacagagtcactgggtggcgcagggcagtcgaaggatggtgcggccgacgacggcagcttctggggcggcgcgtgggctcagggcagcgcgagctcgccggcctccctgcccccctcatgcaggtcggcggggggtggcgacgcagcagcggcaggcgcggaggtggaagcatatggatgcggcgccggcgagcttagggcagagggagagagtgtaggatcaagatgtcgactagaggagggtgaataggcgatttaaaactaaatgacacctaatcaaaactaacctaagttgctaggcttggtgagggtcaactctaactaagcaactaagttatgttttgcaaacctagggtgatagtagctcaattatatctctaggaaagtaaatcacactcctatgtcaatgtttagcactcctagggtgatatgatctcaagtatgtctctagaaatgtaaattgcacaaatgtaaatgcgacaatcaaatgagacaaggagacaagagatttttcactgaggttcggaaactcgccagtttcctactccccattgaggcgagcccaactccaccgctcaaccacgaagccaccgcacgcccccttcgtcaaggggtgggcaaggcaggagccggcccacagagaggactacccaagcctcgatcactcggggtagttcttccttcactccgaatgtggtgaactccaaaccactcacaaaccggcgccgggcctcctccacaatcttctcggagagatcaccgggcaactcctccacaagccatctaggaggcggcaacctccaagagtaacaagcaatgacctggcatggagatgatcaatcaagtgccacactagctctacaaatggaagcaatgcacttgactcttggctaatcaaccctctaacacactagatggatgaacacaaagctaaagtgggtgtgagagaggtgcaaggggtgtatgcaattgaaatgggtgccaagagagtccccttgctgctggagggggagtatttatactcccaccaaccaaaactaaccgttaggggcgaaatcccccaactctgtgctttgccggtctgaccggaggtatgtggccggtcagaccgtcctactctacaacggctagttttgtagccgttgtagggctgtcattgggccccactgcctaagtcggtcagaccgacatggggtggccggtcagaccggcctcggctcggtcagaccgccatcagctcggtctgaccgaatacggctccggcggctcgggatcgacacaccaagacgacaccatcccggccatatggccggccggtcagaccggcccgcacccgccggtcagaccggccttgaggctgcggtcaggccggctatgaccctgcggtcagactggttgccctggccggtcagaccggctctaaggccgcggtcagaccggttcggtcaggccacacagtgaaaacataaattgaaatatggggagtctaaatgcgagcacaagtctaaatgcataatgacctaatgtggcaattaaaatcatctctttgctaggtcattacccctcttaatagtacggcaaagatataaataaactagcacaattttgattgcctaacgcctcaatcaatttaaaatgtaaacactagtttaccgtcttctcttccttttgctttgcgccgtcaattttaatccatcaatgatcatccatgtgcacacaaataagtgaacctaactcaaacaaatagctcaaacacaatggtagtccacaattagtgcttgccattaattaccaaaattaacactgggggcctagatgcttcagagagaggatggagtggaggggaacagcgtcatcggcacggccaccggtgagctcagggcagagagagagggcagagtggaggggaacaacgtcgtcgctacggccaccgatgaactcgaacgcgtcgtcggcctcctcgtctcgcaaagccgcccaccgaccgcccccgcgtgccgtcgtcccccgcccgcgctgcgaggcagcgctcgcctccttcgccaccgcactcatctcctcgccgccgcctcctccgcttgcatcctcctcgccgccgtgctcgcactccgactcctatgctggcgtcgtccccaatcgagaacgagccgccgtctccagcgccttcttcgaggagatctcgagctcctcccccttgtccccgccatcgccatcctcgtccgcgccaccctcatcccccccgccgccgccgcgcgatgctctttccctcgcctgcggcctgccgcctgtgagagagagaagagagagaagaagagtgagtgagggagaggaagagtggatgagagtatgacaagtgagtcccacaaattttttataaatagaatgctgactggactgccacgcgtacgccacgtagactaaaaccaccgcggattgggtcgagggggataattgtccggtttgtatagttggggatgaagaatgtccgattttcaggttcatgggggtaattcggacgaccgcgatagttcggggggtcatactttttccaatagattatgagagatatgttttttttttcacatgtgggataatgtggttgaaaagtgtggaaagttaattgtggcatcaatgagacaaaaatctaaggagctctatagggttgagtgtgatggtttgtttattgaactaaacattccataggtagtcagatatctagacattacattttacagcggcggagccagctcccacgcagagtaggcggccgctcaggctctctcgctggtgtttccactatggacacctcagaatactattagtcgccaggcttaaaggcttcactaattcgagagtattttagaacataatcccttatgtagttggatccattggtggtttgtgttgccctctcgccacctcacgttgtctgtctgttttgtctatttctcatgcatactcccttcgtaaaaaaacttctgattataaggataaatttagacacagtgtatctacagattcatatttaagattattttttttgacagagaggtaaatgcataacctaaggcctctcttaaattgaagaatttttttttgcacaaaatataaaatcatggagtatattattttagtataatttttaatgagatttttatatttataagtttattatgcgagatatatttacggcaaaatttagttttggatataaattaaaatactaatatttatttattaattattaaaaatgggataggtagcatatttttgttgattgtagtacaacatatttgatgtataagataaatctatttatatgctacctaaacagtttttaataccaataaataaataatatttgtaataaataaatattatgttttatatcatattacaaataaattttattataaataatatctaactataacaaactcataataattataatagtcttaaacaacggatttctgccctccaataatctataaacatatatgtttcttcaattctcatgataaaatggttttttctataggaatttaacagtcaacctgcgattaactaacgaaaaagatatgaaagtgatctaaatttaagtttgacatacgtagaagaataactaaaactcaaacgcatagatgagattaaataaaatttcagaaatacatatgagattttctcaaactaagagcaagcacaatagcaagctataaaccaactataaatatattttaaaaagataaaggaagtgagagaagagcagcgggctacagatctgtagccagctgcagcacggactttaagacgtaatgtttatatgacaggtgagactagatattaatagtatagtaagcaactattatataaattagctattacattagctatagatgatttggagatagtaattggctatacgattaaacttgctctaaagtgacataggcataacctaggacatgactagtacacgatcacactgtcaacacaaacatttctttacaatgccagagtaacatttctttactatttcgacaccaatgtaatcattcattcggaatatattagcacgtgtggcggtgtacgtccacggaggagcagtgcagagctctgcctgcgctgggaaagatgccgacgttaaaaactttacgatgcgggcacggcttttgaggtagagagattgggaggagagaaaaaaaattaaggggttgggaaattgggatggcgttcccttccctctcggccggcgttccagttgggccagggtctcatcaagtctcgctgcgcccggctcaggaatccaacggcctaccgagggtttacctgtttcaggcacgtactgtaggagcagtactcatccacatttaaaagagcaggtaaaataatcagctataaaaaaggagagagaaatacagtgggctgcagcacagactacaaaatgcatatgtgttgacaggtgggaccaaaaaaataggcaactactgtatgaattaactattaaattaactataaatgacttggagccaatagttagctatactactccctccgaccttaaataattatagctttatacggctcatctccaacatttaatcgtttatattatttgaaaaaaaaattatgattagtattttgttgtcattagatgataaaatatgaataatactttatgtgttactttttttttgtttttttcataattttttcaaataagacggacggtcaaacgttggacacggatttccacggctgttcttatttttggatagacgtagtaaatagtgactacaagtcaactataaacacatgtggatgagataagagcaaatacaatagtagaccaaatccagctataaacacatatcaagaagataaaagaggagagaaaagagcagcggactacagatttatagccaactatagaacggactctaagacatagtgtatatatgacaagtatgactatctattaatagtgtagtatatgtttatagatactccctgtatctacttttgatagtcatatttcatcttagta

SEQ ID NO: 79608 - DNA, 5305 bp, Oryza sativa
cggcgcggcagcggcgacacgacggcggcgcggggcttgaggcggccgggcgtgcgcggcaaaggggggggttagggctagggaacctcgttgaacacctagagtgcaatgaacagtgctagcctaatttaacctattctttataaatctaaatcttgtcctttaattcctaattttccacaaatgacgtttacatatacttgtgttcattctaatcgaaaaattcactctagattgatagcacccatattttatttttatataattttcttgaatttaattagagttatttcttattccgtcacttttaaatttaattaatacaaatatagtcgtaataatattttactcatttctatcctcactaattcttattttaaattgcactttaattatttactttgtcaatttacttcttagggcttatacctaactaattatccattattcacgatttataaattccaaaatcaaaatccaataaaacaatcgaacaaaatcggcatgatgcaatttgtttaaaaagtttttgaaggcccatatttttggagtttagatttttattggtcgaattttcagggtgttacgtaaacttgcgccatgactcgatcgaccaaacacttggccacacacacatgcaaaactaattctaacacacacgtacatacacatcatgccaccactcttggccaccaccacgcagcatgatgagaacgtataccactaactacagtttaacagttatacaacaagattaatttctaacaatcaccccctaatcttgttggctttatttgtgaacacctgtcaccggcttcaaagtaatgttggctcatcatcagcatctgcaattgcaagctgcgccactgccttagtcatcttccgaggctcgtcacactcatcagcgaagtgtccaaacttgccacacctgcagcactcaatcttcgacttgtcgaacttgctgcgaaacttcttcgtgacactgccagaggcctcgtagctcttcttctcttcagcaacaatggcctcccactcagcgcgtgtgagccgttgctcagcccctgcaataagcagctgctcctcccctgcgttttcacgacgtcgccccttggaggacacctcgaacgcccgcaaacatccaattgtctccgtcaccgtcatctccgacacatcccccactgctcgatggtgcttatgagggattggaacttgtcgggaacggaatgcaagagcctctccacgacggtggtctcctccactttcgtgccgagagaacgaatctcattcatgatcgtggtaaccttcaaagcaaaatcattaattttctcactatcaccctcacccatgtacataccatcaagcactctcttgagagtttgtactcgggccttcttgacacgctcttcacccatgttcatctgcttgagggcatcccacgcctccctcgccatttccttctcggatatgaccatcaccatggcctccggcacagcttggacaatggtggcgagagccatttgatccatcttctctcatcggctgcgttgccctccacggcagtccacacaccttgtgcgcacatgaaaattttcattttcaccgcccaaacgctgtagttgttctccccgagcatcgggtagcgtaacgtcacccccgcctcattcacttgctgcacgacgagctcatggccgcctaggctgccatccccgccgttgccgccgctgctgcgacggatcggcggcggcgtgtacacaccatctccagacatggcacctgagctctgataccactgttggctaaccgatgattcggctcctcttacacaagcacacacgctagaatgaaaaacacaaacacactggactaaagaatttttttgtgctgcacaccagcacaccacagcactcacaagcgcactgctattaatcacaccacaaaacacaagctaatacattgcctaaatagcacacattaagccatgttctggccgcactacccagccaaacattgcatggcttatccactaatcacttccctacatatgcatgccacatctccttgcatatagaacaccacactcacacgttcagttgcaggtatctaatccgccgatgcatgcatccatgcaaaacagactatgacttcttcctgctcctaaacttgcgcaatgactcgatcgaccaaacacctggccacacacacatgcaaaactaattctaacacacacgtacatacacatcatgccaccactcttggccaccaccacgcaccacgatgagaccactaactacagtttaacacataaacaacaagattaatttctaacaagcgagggctgtaacagtgacgacaatggcaacgaccatggtgggtagggctcacccttactggtctcagcggcgatggttccggcgaagtcatgctcgggatccggtgaccgcgacaaccaccaccactacgacacacacccgttgaggtgaagatgacctggtgactgctagctccttgactcccgctactttgcctcatgcagatttggagacgagaggcggacctggtgaccacgacgatgatgatttgtgaatgtgaatactctgtgaatttgtgaatgtcaatgctatgcattttctggcctggattggactttcgtgggtcctattgagattagcaggcggcgctaggcgaggagcggtgttggctatgattttttttagcaccgaaaaggattttcgcaggtgcccggacggctgcgatattttttagcgttggaaaagatttttgtaggccaatgacttaagaggttgtctgcgaaaaaacatgaaatttacagtcctttaatgccaggaggaatgccgtcagcatgtgtatatcaattttggccacctgggaaaatatttgtagtagtgatattataagatattttatcctctccatcccatatgtagattcaataagacaaattttactacaggacatcgtgacttcgcggttttagatataggacaccgcacgaagtgacttttaggggaagacactcccaaaagtgatatttgctggtggacacggtatgcattaaagtaataatttctggtttaagaggagagataaatcacatgaaatgtcagaaatgctcttgggctcacatatcagttcttctctctatcccacatgctagcgatgacggtgggcaggtgaggtccggtggcagcggcggcggcgggagggcgaggttagagcggacgcgactagcggcacgcggaggagcgccggcgccagcgcttatggacagcggcggcggccggacaacaggcaaggttcggcggtggcaggtgcgtctggtggagtggcagtgcggctggacggcaacggctgcagcgcgcggagtgaggagggaggggcgccgtcggtggccggcaccgctgtccgggcaccctcccgtcgccacagccaaacctcacttgcccaccgtcgtcgtcctcatgtggcgagcgagagagaagaggagggaaagagaagagagataggagagctgatatgtgagtctaagggcattttgatatttcacacgatttctctctccccttcaaccgtgcggtgtccatcagcgaatattcaacttttgggagtgttttcccccaaaagtcatttcgtgcggtatcctatagctaaaaccgcgaagttatagtgtcctatagtaaaatttgccattcaataacgttcatatgaatttagatataaatcaagcatttacatgtatctataaataaatctatccaaagcctaaagcggcttacaatacattggtttttttaaaccaaaaccaacaacaacgtccgttcaaaccgctcaactttagctaggagtacactcagtatttcatagtattaattttcattggctgaatcgatgaacaaataggaagtggattggcttatatatatatatatatatatatatatatatatatatatatatatatatatatatatatatatatatatatatatatatatatatatacggtgacgctacacagcgccacccacaggcgctgcgcgccacgaaacaaaatggtgccagacacaaacgagtagaggtcagcccaccaccgacaaaatcccaccaacgaggcatccaacccacccgcggagttaaaatttaacttagatacagttggtggtggtggtgcggtgatatcgttgaggagttaatattatgcgatgattcagttggtctgagttaaagtttaacttagatacagctggatggtggggtaaaaccagcggagttaaattttaacttagatacagttaggtggtgggtgcgatgacgtcgttgaggagttaatattatacatggtttcagttgatatgagttaaagtttaacttacatacaattgggtggtgggatgcgatgacatggttttggagttaaaaaattacttgttgttgttcaattctggatgatatgtgattgagtctggtcgctgctgagttaaaaattaactcgcgatacaaaactgcaggacatcgttgtagagttaactcagattgtatgagctaaattttaacttgtgtacaacaagattttaactcaacatatgcgtcctcacaatctataagcgtaagttaattttttgtcagcacttgctccggacatcaacggcggagcgtcatggaggtgtccgccgctgctcctccatgtccttcggtgttcgaactcgccgccgcagaggtcgccgccatgtgcgtggggcgcggaacggcggcccgatccgccgccgccacggctgtagcccgcagtcaccccgtcacgggatccgccgtcgagccgcctgcatccacgcctgacacgcaccaccgcagccggatccgtgtacgtggggcgtggagcggcggccggatgcgccaccccctcgcctcgccatgccatgttggatccgccgacgccgcgccttcccgtgcaggattatccccggatccatcatcgtgccggatacgccctaccatggccagatccacgcgcgtggggcgcagatcggtggccgggtgcgccgcctcgtcgcctcctacacaccgtcaaccgtcgccttcacgcctgcagccgtgccgtaccggatccgccgacgtcgcgcccgccgctgctcggcagaggaggtggtgctcgacgtcgcgccgccagccgtgccatgccggatctgcccaatgccgccaccgctcaccgccacacccgctcgccgctctcatctccgaaaaaataggatctagatatgtggttggttacggggtggatgtccaacactgg

SEQ ID NO: 79609 - DNA, 8085 bp, Oryza sativa
gcgccgccgtcatccgtcgccgctttccgcgcctccggttgccgtcgccggcgaccgtgcgtgcgcgccaccgccctcgccataaccggtcggccggtttgaggccgagccgagccgaccgggcgtctcctcctccccatgagccgccgctcggtggggcccgcttgccagccgcccctctctctccttgagtcactgacccgcgggtcccgcgtgtcggcgccacccctccttgtgctgacgtcagccctggggcaatattgcgcaataaattgattaagggtttttcttttatagtaaaaacacagagaatcttctaaaaatcataactaattcatccgagctccgattaagtccattcaagtctcagtaaattcataaaaatgtatagaatccattaaaaatggttttgcttcctgtttcagtagtcttatagcatgttttgcttgtgtgctttgtttgtcgcgtagatttcggtcgtttcgtcgattcgcggtttcttgaagacgttgctgtggcctcatcagtgcgagagcaaggcaagtcatacattgcaattgatcatattgtacccaatttacaaatgtcccgcatttctattaaatattgcattgttttacaatatcatgtgggatgggtcctattactcagctatatgttgtttcccttacgccattaataacttgggtattaaaatgactagatgttggtttaggagatgcttagccatgcttagttcaactagtgcacaaagggggatcacattaaagcatagacttgattattggcatagctttgatttagtgccaccgtaatggtgtgggttaattaaaatacacatcatggtgggctgtgggtgcatggtcttgctagtcgcacccatggcatttaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggcgtccggttgatcggcttccggattcaccgcggcatgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgtcgcaacgtggtgtaacgttggacagtgattggttaatatggattaattactgcaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagcgttgaagtccttctcagttgaagatgtctcgaagaggttggtttcgtcgctgccgtcaaggatgcctgtggaatggagtcgcccgctgcagaagtcaagccttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggtgtgacaagttggtatcagagccgaccttgaccgtaggtcaagccaaatggaaaccctaagagctctcttaaaccttttcatctgcatatgctttttgcacttggatttgtttcgggaaaaatttggggttttgcctcttttgattttgggagaaaatcttggtcgcttatttaatcggatctcttgactagggacagtccaaggttttagcaaaactttatttggaatttatttggcagccagtcgggaattgttaggtggtatgcattaagttgtgtttagattcgatgggatgcagtctttatgcgcatcattattatcatgcatttatatcatacattaagttattgtttagtcagttgcattagtgtcttttgtctgggttcatgaaaaatgttctatgcataaaaatcatcatgcttggctagttgtttgggccatttgttgctttgtttaaatttggatttgagcatgcattgattcctatcccttgtctaccttagaagtcagacctgttcttcgatcgcaagcgccgctccgagcttcagagtcgccgcccttagctttatcgtcttcttagtctgtttgcgtgctagtttttgtgtttaggtttgttgcttgtgggttagtcggcggtcgatatcatgtgtgagtggtatgacagccttaattaggaattgtgtgcctctttttcagtgttttaatcaagattaagataatggcacttaatttcataagaaagattagtttccgagccatctgttttcttcctttctcttatttctacctatcccctccagatggtgaagacaaggaatgatctccgtgactccaacggcgccagtggcagcgaagagcagacagatgaagctcataccagtggtgcacctggtagcagttcatctccgccgcccgagaacccaacagtcactcagatgatgacaatgatgatgcaacagatgcagcaacattaccatcaaatgttgcagcaggtgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggtgacccgtccagatgcaacgaaggttacttgggtagagttttgtcaaaactttaggaaggcacagattcctgaagggattatggcacaacagaagagagagagttccgtgcattgcaacaaggaaccagaacggttacagagtacctgcacgagttcaaccgcctcgcgcgctacgctcccgaggacgtgcgcaccgatggtgagaagcaggagaagtttttgtttgggctcgatgatgaattgaccaaccaactaatctccggagtctatgaggactttgagaagcttgtggacaaggctatccgccaggaagacagctggaccgaaaaagaaagacagctcagatcagctttcctcaggggaacaatcagaagcctcgtttcatgacgggacagctaggtgggccttccaccctgatcgtctgtcagcaccgtccctatcgcccgagtaacttcaacaactattacaatggtggcagtcacaacaatagtaagcagcacaaccacaactcgactccacccccactaatggcaccagctcagtcagatccgccagctgtgtcagctcagtcagaacagcccaagaagggggctgtaggaaagccaggaccctgcttcaactgtggcaagcacggccactttgctagcaagtgtccgaagctgaatcgcactggacccaggttcatccaggcccacgccaatcatgtgtctgcaatggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgacatgaggacagcacattattgcccctcggtgactatagagatcagaagatcaccgtttctatccaacctcatccttctcgaatctaaagacctagatgtcgttctcggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcaccactcggtatgggttgtttgagtgcacagttatgtcatttggactcaccaatgcaccggctttcttcatgaacttgatgaacaaagtgtttatggagtttcttgacaagtttgtcgtggtgttcattgacgacatacttatctattcaaagtctgaagaacaacatgagcaacatcttcgtctggtactcgagaaattgaaggagcaccagttatatgccaagtttagcaagtgtgacttctggttatcggaggtcaaatttctgggtcacgtcatttctgctcaaggcgtggcagtggatccatcaaatgtggaatcagttaccaagtggaccccaccaaagacagtttctcaaatccggagttttcttggacttgcgggttattaccgtcggttcatcgaaaatttctctaagattgccaagcccatgacacagttgctaaagaaagatgaaaaattcaaatggtcagctgagtgcaaccaaagttttgaagaactcaagaagaagttagtctctgcaccagttctaattttgccagatcagacaaaagacttccaagtctactgtgatgcatctcgccaagggttgggatgtgtgttgatgcaagaaggcagagtggtcgcatacgcttcgcgacagtaacgtccacacgagaccaattatcccactcatgaccttgagttagcagcagtggttcatgctctgaaaatctggcggcactatcttattggcaaccgctgtgaagtatacactgatcacaagagtctgaagtacatcttcactcagcctaacttgaatctccgacagcgaagatggctggagttaattaaagattatgacatggggatacattatcatccaggcaaagcaaatgtggtagcagatgctttgagcagaaaaagctattgcaatgccttatgcactgaagacatgtgtggcaaattgcagcaagatcttgagcacctaaatttgggcatcgtggaacacggatacgttgctgccctagaggcaaggcctacgctcgtggatcaagtcagagcagctcaggtaaatgatcctgaaatagctgagctaaaaaagaatatgagggtcggaaaagcccgagatttccatgaggatgaacatggcacaatctggttgggagaaagattgtgtgtgcctgacgacaaagaactgaaggatctcatactcacagaagctcatcaaactcagtattcaattcatcccggtagtactaaaatgtaccaggacctcaaagagaaattctggtgggtcagcatgagaaaggaaatagccgaattcgtcgcactctgcgatgtttgtcagcgagtcaaagcagaacatcagaggcccgcaggactgctacaaccccttcagatcccggaatggaaatgggaagaaatcggaatggatttcatcactggtttgcccaggacatcgtcagggcatgattcaatttgggtagtcatggatcgcctcacgaaagttgctcattttattccggtgcacactacctatacggggaaaaggttggcagagctgtacttagcaaggatcatgtgtctgcatggggtacctaagaagatagtatctgatcgagggagtcagttcacatcaaaattttggcagaaactgcaagaagaattggggactcgtttgaatttcagcacggcttatcatccgcaaacagatggtcagaccgagcgagtaaatcaaatcttggaagatatgttgagagcttgtgcacttgactttggtggagcctgggataaaagtctaccgtatgcggaattctcttacaacaacagctatcagtccagtttgcagatggcaccgtttgaagcattgtacggacgaaagtgccgcacaccacttttctggaatcaaacaggtgagcgccaactgtttgggacagaagtgttaaccgaagcagaggagaaagtcaggaccgtcagggaaagactgcgaatcgcccagtctcggcagaagagttatgctgataatcgccgaagagagcttactttcgaagcaggggattatgtgtaccttcgtgtcactccgctccggggagtacaccggttccaaacgaaaggcaaattggcaccacgctttgtgggaccatacaggatcttggaacgcagaggtgaagtcgcttaccagcttgagctcccatctaatatggttggaatccacgatgtgtttcatgtatctcaattgaagaagtgtttgagggtacctgaggaacaagctagctcagagcacattgacatccaggaagatctgacttatgtggagaagccgattcgtatcctcgagaccagtgagagaaggaccagaaacaaggtgatcaggttttgcaaagttcagtggagccaccactcggaagaagaggccacctgggaaagagaagatgaattgaaggccgctcatccgcacctctttgccaactcttccgaatctcggggtcaagattccgtttaaggggggtaggtttgtcacgccctgaagttcccctcccttgctctaaattcataaaataaatcgttcgaagaaattgtttaatttaacctagagatgaatccctaattaataaatgcaaataataatcggaatcggcatgtggaatttttcttggattctacatgtcaaaatatgctaacaggatttttagtggaattttcagagccttggaaataattttaatcaattaaaataagcaaagtgcaatattaaatccctggaaaaatcctttttcctttttatcttttcttttccctccttttttctttttcttgggcccggcccattttctcccgcgccggcccgctcctccctcctactcccgaagttcacccggcctccttctccctctcgggcgctgacaggtggggcccacctgtcagccctttccctaacctctgggcgcccacgcccgcgccaaccgccgccgaaaccaccacccatcgcccgccgcctcccccggctttccgcgccccgggccacgtcgcccactttcccgcacgccccgcccttcccgcgcccacgccccactcccgctcacccccgcgcccgcgagatggccgggattcgatttgaatcccgcctctctctctctctcctcctccacctcctccactactccggcgaaattgcgtcgttcccggccacgactcgccgcccccctcctatttaagcacgcccgcaccttcctctctctttttcctttctcggccgagccctcccgagctctccatcgctcccgcgcctctcatcccgccatccgccgctcgccgccaagctccggccgcactccgccaccgctagagccgtcgccgcaccgcgccgtcgacgccgccgggttcg

SEQ ID NO: 79610 - DNA, 5953 bp, Oryza sativa
attcctgcagcccatatatagatatatatatatagacacacactatactatactatactacaggggtgcgttgtattaaaacgcaacccaccccaccccctccccataggcttaacgtactaccgcaccgaactaaatcaccagtaatctatttacttagctattatgcgtatattcatattaggatacaaccaaccaaccatcgatcctattttcctggatctgataccatccacttccacgttgtttttcccggatcgagcaagagggagagagcacgggcgaaggttggcggcggcggcatcctccagtggcgggttatgggtgaaatcggtcggagacagcggcgcatctacggtcaatggcgatggcgaacaggttccctccctgtttgttcccccttcccatctcttccccccttcggtctcttctttctcctctgatcctctcccatcctggcaccgacgttcacttgctgaaggtggcacacgacggcatagggcagcggcgcatgagaaaggaggaggcagcgacgcatggtggtggttgtgtcgatcttctccattgtgcgatgcatgaggaaggaggaggcagcggtccgtgcaacatgccaagaaattgccgtgatggacatcgatttaagaaccaggcccgtcgctgacccaagctccttcactccgatgaaaaggtaatggatcttagactaggctttgccatgccgatctgatcctctttctcgtgctttttttttaccttcctttccatgcttatggatttttcccttgctcctgttttcatgtgcatatattcagaatgcaaacgaaagtgcacccaaaatttattgtttccatagatttgcaggtttcccgatcagagcacacacgtttcccaagttctcactgaggtgagtcagatccaacatcaaccttctccacggagccgtgtggactgtggaggacgaggcagtgctgcctggcagacggagcggagggaggaaagccagcgctcagctcctttctcagaaccagtgtaggccatcaatcttgctgtgtgctgatctagctgcatatttcgttgacgatcgcatgcactccctgttcttaatttctctacgcttgtttactctgttagcctttcttcacaaattctagtttctagtttttcatgcctttgactgcaattacagaagaatctttttagttgatactggcatgtcctaccggagcactggcaatcgtatataaaggctatggattaagtgtttttagttgatccagatgactctgtacgactgtacctatctagatagtatcagaatctattctaaatttcatggacaacaattcatgtcctcatgcatcaattaactaggtatttattttataaagagtgaaaattggcatggtttctgctttaagtaagatctcagatcgattgatcatgtgcatgtgtgcctcatgcaggatgaaattaatcatgaaagatttctcggtaattagtcatgccttctatgtaaaattaatattaaatgagtgttcatgtgtccacatgtatgtgtcatcagttcacacagcttgtgaaaattcggtgttgcgacaggaactgaacatctgcatcatgataaaataaataaatcttcaggataaaaatttagatattcacaacttaaatctacaggatgatatgcataacagtgtcccatcgttgtttttctgcattgtcaaaaatcagtacttagcactgccaacaccatcatctgagcgtgcagtaatgctttagttcgtctctattctcaagtgtgggaatattgattgatcttggtttcgatttcgcttaattgcacaatgtttggttgcaggctaggacaaggcctccaaacaaaacttctacggttgttggcacatgcgccatcgtcgtttacgatttgtcctccgccgatccaattggagcagcaacatctagttttttcatttgtacaatcaatatgtatgtgtacccccgagtctttataaacatgaaatgtagctgtaatttatttttggctatattgatttgttggtaaatatgttactgtagtagttagggagtaatttccccacaaaaaaaaaaagtagttagggagtaatttatttttatgagagaagattgaagtaaatttgttgttagagcgatgtgttagtacgtttttatctgggagtaatttatttaccaagagaataccagagtcattgttggtatggctatatcaaaagtaatcaatttactgagtgaagcatggaaaagtaaaaaaaaaaaaacaatggctagattaaaagtaatccatttactggagtaatatttgttgctaaatcaaaagtttttactgctaaattgtgagaaatttatttactgataaaacaccatagtaaaaattgtgtataaccaaagagtaatttatttactgataaggcgacgtacttagtatatttcgtgtgtaataatttatttactaaagaccatgagtgggactgatttattatcaagagaagcacccgtccaaatagtaatctatttactgtgttattaacaagattaaattgtgaaaaataaagagaaatacaggtatttctattgtaaatgatccatcaaggataaaaattataacgatcagtagtacggttccctacagggccttatttaagatgttagtaattcttttactcacgggcttaagcgcgagtaaatctttcacttacaggcccatctagagagggcctattagtaataacgtactcagggtgcggtttagcgccattttcctatatatatatatatatatatatatatatatatatatatatatatatatatatatatatatgtatatatatatgcgatgtatacaattactctgtctcaaaatataataacttttagccctcatcatttgtcccaaaatataacattttctctaccaatattatcttcacaaccaatcataatcctacaacatttattttttccacctacctccacctttatctaatcacaaccttccgccactcacttctacttactttcttaataaccgtgtccaaccttaaaacttcttatattctgagacggagggagtgctaattaatagtatcacctcatgaggacggtgactgttttcttgtcccagtcgtggccatttgccaggacctcccggaacttggggcgctgctccctgccgccgccgtagcggcgcgccggctgcttcggcgtcggcagcgccgagagcgctgccacgccaccgtggagcatcagcacgacgtcccacatggacgggcggtcctctgggtcctcctggacgcacagcagcgcgatgtgcgcgcagcccacaatctggcccatcaggtgtggcgcgtcgccgcccacgctgatgcgcagggacgaccggatcagcctctccgggttcttctcctcgaacaccagcctccatgcctacatcggttttgtacaggccggtataaattttgttccatgtaatatatcaatctacaagacattttataatacaggggctatttggttctctaccttatcaaatcattggtagtaccaaattcttggctgttttggtactaccaatttttggtagggtagagatttaattatacatgtttgaattagaagaaggttctagattattgacaaattgatcattggtgttaccaataactagctgggtggcccgcgcaattttcacggctagcacccaaacaaaatcatatttttttaagtatgattttatttaaaatttattaaatagctatcttattgtcttaagtctttgaaagaccaaaccttatcatcctcgtgtttataattacatagttttttaaagtcacaccagttactaccccttatgtcatctccttctttatttgcttgctcgatctaccactatttctattcattcttcttgtaaccattaaaaattggattttatagtttttagagtttattgttacgtggtttcatttttataatttctaaatgtcatgtcaaacattgccattatactcctttacgacctgtccactgtctcttctctttattgtcattgagattttaaaaatcgaacataattatcgtttgggttcatttttaccttttagaagtcccaccaaaccgtcagcggctttgccattgtactcctctacggcttgcccgctacctcccttcttttattgtcattgagattttaaaatcgaacatgattatcattattttttttttactttttagaagttccgaaactttaaaaattggacttgtagtttcattttttatatatttttagaagtcccatcaaacgatgccactatgcccctctacagcccgtccgccacctactctttattatcattgtgattctaaaaatcgaacgtaactatcgttggaattcattttttattttctagaagtaccatcaaccgtcagcggctctgcaactatactcttatacaccccgcccgctacttctcttttttattgtcattgagattttaaaaatcgaatatgagtatcaatagggtttatttttttactttctagaagtcccggcaaccaccttactcgtttgcttcacggcctgcctgacgtccctccttttaatcgtcattaggatctattcgttgttttattaacaatttttatacgtcgtatcaaccgccaccactctactcctttatagacatgttacataatttatttatcatgtgttttagatggtcttttctttcaataatctttatttttatcacaaattttagtttttataaattgtattcctaattgaaatcttatttttctttttctaatttcagaactttttttaaaaaaaaactttagttaataccgtattgtgttcttttaatgtttttatttttattttcaatttcatttgtttgaaaaatgtattcctatttaaactctcttttaatttttctaattttagattttattttattttatttctaatttcgattaatctcgtattaggttcttatatggaaacttctttcaatattgcttatttttaattccgaatttcagctatttttaaattgtatttctacttgactctcctttccttttctaattttggattttattttatttttattttgaattttgattaatctcgtattgggttcttatatggaaacttctttctatattgcttatttttaattccgaatttcaactatttttaaattgtatttctacttggattctccttttcttgtttttctttttctccgattaatgtggaaatttctagctcccacagcgaacgtggtgcctccttttaaagctgttttaataatgtaatagatttgtcttcaatccaaatccatactattactattcaagatactaataaatttgtagtgcacattttggcaccaatccaaaatgcccacaatcctataatataacaatctataaccgaattagacgctattcggtcctatgttgttattttatgggacggagggagtactacttaacaaatagaaataagtatttactaatccctcttaaattcaaattgtaattacaacatagtagaacggtacaataaatcttgaccaaacctattccatattgtaatacttttgggacggagagactactatataataccttgttcattccttttattttcttaattgaatagtttcaacattcaaataataataaaaaagctttttcccctaaattctttgtttggtctaattttgatcctacaatttaaatataggatagctagaacacatccttatcttttagtaccagacaggtttgatcccttctattgttcaagatggttttggtcgacatgaatagcagagttggtggaaaactgactttgactcaatattaaaaagaatatatttcatatactaaaaaaccttaacca

SEQ ID NO: 79611 - DNA, 577 bp, Oryza sativa
gtcacctttgagggaaaatgcacctataaggggagtactcaccttctagggatacctcacccataaacactatcctaccttctgacagtgaggatgatagtgattatgtaggaggagatgattgcccttctgaggatgatgaagaggctagggagatagaaggacactacaaagagttgaagaggaagatgagagctggaaaggttcatgagctagatgaggttgtgtttgagggggtttaaaagtcagtcagctagaacagctggaggtccaaaagatggcaatgacaccccatatgcagatagtgatgatgaagactcatatgatgaggttggcagtgatggtgagcttgttagaagaaagggcaagtttccaaggtttcagaagcagccaggggttcctgtttttgagctaggaatgaagttcagctctaagcatcagttcaagaagaccattataaaatatgccctggctgaaaggaaagtgattaattttattaaagatgatcacaagagggtgagggcaaagtgtgattgggctagctgtccttgggtgtgtttgctgtccaagactacaa

SEQ ID NO: 79612 - DNA, 1693 bp, Oryza sativa
gtcatctattaaaaaacagagggagtattatattatatttccttcatcaatcttaatataaactaaagcaactataattatgtactccctccgtcctaaaatataagcatttttccgactctgagacagtctctgagatataactctaaaatataagctttttcgattctgcgacggtctccgagatataactttgaccaccaatatatatatgaataatatgttttaaataaaaagagttatatattatgatagtttttgtttattgataaatctaataacatcaattttaaatgattgatctttttaattttattttttttctattgatagtcaaaattaatgatgtttgactcgttactatttaaaaatgcttatattttgggatatgggagtaactattttgagacagaggtggcacctaactacccattgatgtgacaggctgtgagtgaatgttgttttttttatagctaccactaattaattaatggttttttgaagtacgtttatagcactactctttgatttcaatctaacctattcaaccaagatgggccttcatatatcttgctcgtctgatcgctctatttatatatatcctgaccacacacacaactcccgatcgagaaccctaagcgaccaagcagccggggcgccaattgattttgcttagatatatagctgcatcgcgatgatgatcaacgcatcaggcgagggcgcgaaatagctagagatcgagacggagatgggtgagccccacatccttattccgctaaagtagctaagctgtacataagtccattacattatttgaaattaaaccgtgcattacatcaataattcttgaaaaaggaatggcaatgttgtatttttgtatattatcagaaggatttcactaaagatgaaattacaactggcctctacatcaactaggtatacacaaagcctagacaaaacaaactgattcaaacatgaagatatcatgtagttttacaccaacacactcaaatagaatcaaaacaataacataaagtcataaatatcatctccgaaaacaacacttataatatattgacgtgtaatctttttcgcgttcggaaaaaaaacacttttaaggacttgtaagcaccacgtgggacaaagactaatcaaacaagcatcgtgttagctgaaagccggcctaatactactaagggacataatttgtactaattgtggatgttgagggacaatggttttacaattgagagaggcggattaatctctccccctatttgagggacgtagagtgaaccttttaccattgataactatccagatgggtgggccgaattgggccgcagtgatggtgccggtgtaccgggcactctatcggtggcacggcacggcggcgtggatgatgccgggggacgtgaacgcgatgatcggctggctgtttggtgggccgcggaatgcagcggcagcaggtgccaggccggtcgccaccggggggggggaatttaactattcgccacttttaggtttgccaattatccaaatgcccctcttaggtttgcacttaataatttgccactgaagagaggtaattttttaattatttgccacttttgcctacgtggcgtgccacccgtgcgtgccagcgtggaaaggaccccacccgtcagccctcttctcaccttcttctctacct

SEQ ID NO: 79613 - DNA, 20686 bp, Oryza sativa
  unsure (1)..(20686): unsure at all n locations
agtggcctataaagagaacaatgaagaatgtgaatggtgtttgtgacttgctgtgtagtgatctgagggttggtgatggaagtggatcggtcttcatctctgaccaatagaaggtaatgctcctgatccactgtttgcttttatgttctgtcaattctgtcattacacaatgcatacctaatgtcttgtgcatgttactatcaaatgcagggaataattaatgctgtctctaagtgggctccagaagctgaacacaggaactgtgccaggcatatctatgccaattggaagaggcacttcaatgataaagtgtttcaaaaaaaattctggaagtgtgccaaagcatcatgcagaatgcttttcaacttgccaagagcaaagctggcccaactgacccctgctagagctcaagcaatattgaacacacacccagagcattggagtagggcttggttcaggttaggatttaattgtgactctgttgataacaacatttgtgaatctttcaacaaatggattcttgaggctagattctttcctatcataacaatgcttgaaaccattagaaggaaagtaatggttaggatccatgaccaaaaaaaatgttctaatagatggagtactgtcatttgccctggtatacttaagaaacttaatgtgtacattgctgaatctgcattctgccatgctatatgcaatggggctgacagttttgaagtcaagcataatgagcataggttcatagttaacctagatatgaaggagtgctcatgcagatattggcaattgtcaggtttgccatgtcctcatgcaattgcttgcatctactatagcaccaacacactagatgggtgggttgctccatgctattaagtggaatctttcaaaaaaaacctatgcccattgcctgcagccagtagagggcatgactagttggccagatgatcctagagagcctctcaatgccccaggatacatacagatgccagggaggcctaagactgaaaggagaagggagcctaatgagccagctaaacctaccaaagcttccaaatttggcacaattatgaggtgcagatcatgcaagcaacctggtcacaatagcaagggctgtcacatgcacagtggggcaggtggtagcacatctgcagctgcaacatctgctccaggaaatacagtcactgcaaataacaacttagtgttgtcaagcacacctagcagcattgcacaaagcaggaaaaggaaggcagctgagctcagtactagcacatctgcttgccacactaggaagagaacatctcctacaaaaaaggtatgtcagccagtcctcattcaattaaacttttgaaattaacattcatttgctaacaacacttgtttcttttccttccagtcagcaaacacaaacagttcacttgtgaaggttgcagccagtgctaggctggcaactgaaagaggtggttcaaccagtgtgaaacttcaggccatagtgccacactctcaatgttcttcttctgcttcaatgaggatcacttctgagaaagcaagtgtttatgtgcaagctcaagaaccagccactaccaagcccaagaaaacacctacaggtccactgatgctgattcccccatgggaaactgacaagctgtgatgccatattgtgctaactatgcaatgttatgtgctttttgtgtattttggcagactctaagccaactatgcctactgtgaactttatgtaatttggcagactcttagccaactttgcctatctgtttagtttctgtaatttggcaaactgcttgccaactatgctgtgatatgtgcttgttctggcagactgtaagccagctaagctatgtggattgttatcatctaaattgagtgactttgctcaaatgatgtgtcatagcctaatctgatatgagatggtatttactgagctgatctgatgtgatgaattgactcttatcaatttgttatgctaaaatttatgtgcaaagttacgaatactcagccactgcaaaagatgatattcagtcacaattcaaccaaccactgcaaagtcagctcaaatatatgcaatgtcagtgtcattactgaatatcaatcacaattcagccaaccacaaatccattcacttaacttagatagtcaaagagcacagctcagtttcttggcaaaatgcagcaaaatgctttcagctaccagcattttgacacatagattaacacattgcacctcacagctgaactaaaatcatagcaaacaacacaagcatgcatcccaacgacatcagtacaagccaaactctctgtttctctagcctactgttacttgctctcatagcagccatgttagcttcattctcagctgccacaatcctcaattgtgccacttcattcattgctacccctaattctaggcactgctcttctacctttggcctcagttcttcaacacaatgttgcagctcattcttctcccttcttagcgataacacggcttcatgaagatcgttcaacagctccctcaaaaaactacttgttgcaggctcataccagtcaaaaaaatcgcagccggcgccctgaaaacattacatcccaaatcacccaaccatactgccagctcaaacaaaaaccaagcaagcaaacgaaatcttcatcactcacccgattgcggcatcggtagtaccatcgaccagggttgtccacnnnnnnnnnnnnnnnnnnnnnnnnnttcgcaccacatcggcacatcaccgccggctgataatcatagggcccaactcgcgccgggatgggagcacgactgctgggatgcgacgaccccgacgaccggtcactgcaataactcgccatcgcctagcctcacctcctcttgtcgcccccgccgccgccgccgccgcttccgccgccgccgccgacctaagctagggtttcagctcgagaagaggaaaatgtcgcggcaacgcctggaaacagcgaggacagagcctttaaccccgtctattaactccccaatggtggactaaccagtgggtcccacagcgcgacacgtcaacaaaaccgggcaaaaactgagtcaatactgccgagggaccttctacggacggatttagtaattttaggggtacacatttctggtattctagtttagggaccttaaaaaatctcggatttagtaattttaggggtacacatttctggtattctagtttagggaccttaaaaaatctcggtgtcaatttgagggacctccggtgaacttattccatgtaaaaacacgaggcctgggagatctgcttaactccagtgtaagtccagaagcttgcctttaggtgtatgagcgtgccagttgatttgatcctgcaatcaacaagaaacaaagacaaagaaaccacggttaaatccataaacgatagccgatcggctaattgccgatgaagtatcatttatcttggagccgatgtcatatgtggatcgatcggcaatcatgaataagtaagaaagaactaattaaatctactcgatcagttgtagatattaacaatatataatccttatgtcgctatatacttaaatcaagtgattgggattgatctgtcgccatgacgagacagtataaatcacatagatcgaagtatatgttaacaacgagactatatatgttcatagcatagccgatcagatagatctagcatgtataggctaatactccgataccactctatatcaagatattaaggcaagtagaatacaccaaacaaaagcctaatatacttaagggcagatttaacatgtcaattaagcatatgagaaaatggtagttaaatcaggtaagatcggctgaaactctgacgctaccctaatcggcagccaaaggcagcctagagattgagattctaatcatcactcataagattaaactcaactgatgcagctataagtatgaaaagaaggacaatatctagacaatcaagtcgttggatgtttcatagagtggtagatatcctatataatctaagtcagcatcgatatttaacctaatcggctgccttctagtaacagacgttagccgattagaggttagatagcgatattgccagagattatataagatatatgaaaactcgacgaattacataaacaagattagtgtatcataaagatggaagcactaatcccgagaacgcaagccgccataacgagttttacctctagttgaagatcgaaaccgatgcagctcaacccgaaagcaagaactcgtcaaaacaaaatgaaagtaaaaagggtggcgatgcgccgagattgtagtgaacgtgtgttagttcgattatatggggctcgggtctatttatacccaaaaattacaaaatatgtccatatcggacacgtttcttatctctaacaaactctaagataccataagtctttgcagcagacttttgcccaaacatatctctaaggaaattacataaaatatcctacttaatagatacaattgccttcttaggactctatccatgtgtggcaatcatcatgaagcacgtcattctaacccgacaacatatgccgtgtcatattgtcggattcggctcaatcggctaaccctgtccgactaacacatgccccccaagtccagaattttggataatgtttcggatttgccatacgtcgactgcgagagaatattgcacttgccgttttccgaccgttattccaacgctttaaatactaaccgttgtccccgagaaatctcacaccgtttcctccgttttcaccgccgaagcaaactccgtcctctctctccgatgatcccctcggtgcacgaagcgattcccaggcgatttcctctccggccaactttctgcccacaacgatgtagacctccgccagtccatccgccgcatcttcaaccgagtacgcagaggtaagtttccattggctagatcctctcttttcgcatcagattagttttccctttccttatcttgttttcttcttctctgttcttttggatccgtagcaactttccaatctgatcgcagttccgagtttgtcgcataaaaaccactactttcttggtccaatcggcaatcccaatcccactgagtttatcattggtgaaaccaataggatccctttcagattagctaacccgaatctaggtcactggaagaatacttttaaatcttggccagccctcgagaaaacttcacccgagaaaagctggaccacatggtacaagcgtgtatcggctagcaagcaaacacactgggatgagattggaatcggtcaagcacttgcccttaccatagcgaattcggctaaggatgaacccctaatagctgccgccacctatttctcgtccaataccatcaacgcctttttgttgaaccaagggccgatgacaccaaccctgatagatatcaccatgatcactggtctagatgtgacctcatcggctaaccctacgagtctgaacaccaagaatcaatatgacttcaagaccaagagcataggcggttggtctggttacgtggcagcatatatgggccaaggatctgttactgctcaagaacacgtggcctttttgctcatgtggctagaaaagttccttttctgtggatccagttgtggtcctacaaccaactggcaatttgtagccgaggctctagaatcaaaaagacaatttcctctaggcaaaatcatcctcggctacctataccaaatgctgaacaatgcatcgactaagatagtcgtcggctcagtagttggagcaggtggaccatggtggctgctgcagacttggctgaatctggtagtcatgaaagctgtcaatcggccatccgtgatagaagccgaattcccaagactgcagccgattgtagaagatgatggagaagaaagcactcatcgtagatgcatgtcatatggagaatatgcattcacaccagccgatgctggagcgaagttatcagccgagctgctcaaagattggttctgcagcttctatgagggttttcaaaaagatgctcgagtttggtttccttatgaagattcagtgcatcttgatctcccatcagactttagattcgaagatatcaacaatgaaaaatctcaaaaatctaaagaagtcttctcagctgcgattagcccatgcattcttcctgtcggcatacatcaagggaggaacattcaggtttcctatgaattttatcactcgatgagctctgccagaccacttgggatgggtcaactaccaatcggcttgctctttgctgataaaattcaatgccgaggagaaatctcatcaaccttgatgatggatcggctgctgaatatccaaggacctcctttgggcagcattgaaaatatagagctggcaaggttcaggagcaagaactttgacagatggtggggtgaatggaagctgtatttgttccaccaaccggcctcaatatatgtgacagatctctttcctaatgttatccctcaggtaaaccttgacttcattaatttcttttgaacaattgtcagccgattcataacttgactaatcttctcttctgttttgcagacaacagaatcttctcctccacaccaaagcaatagtggcagagatatagagtatgccccaggcctcttgccaaatggtggttgaccaacccctccagttatcagctatcatgcccccaagaccgcaagtctgcttcaagggcagatgatagagccagccgataccggcaggaagaggaaacccagggcaccaacaatcgatccattagttctggctcctaagaagaagactaagaaacaaaaacccaaggtagctgatgatctgcctgccctagatccatccattgagcaagccttggatgaactagagattgaagaggatgttgacgaagctgcagccgaggtaagtgatacagaaagaactccatcggcttcacctaaacagactcctccgactccttctactccagctcacttctctagggtaaacagctctctttaattccttcttccaattgttttattcatagttgattactcataaatcttgtcttttgcagaagaagaagttcgctgtgaagaagaaatcggcagcaacccaatccaaaccaactctgccggtaagattcttctgaaaatatttcagttccaatcatactctatgtggactaacatctattttctttagcctcctcctcctccttcacctcctgtacagcatatgtcaagtgaatgaactccatttgctgtaggaagccacaatattgaggaagcagaacaaccagccgctcctactatcccagtaagtttccttttgacacaaggatttagatcggctatatctatttggcatctaattctctttgaattatttttgcaagccttagccgatctgttctcttttgatatcaaggactacttatagaagaggacaccacaaacaaacccttagctcccttatccgatgatgtgaagaagactcttgaagatatttctcatcagctagaggcatcttctctagacaccttggtggtagattgtggatcaattacgactcggctacacgaagttcaagctctgattcctgaagaactagccgatgtcctcactccagctgcttatcttgaaaagcatcaattcaaactggagaaatgacacgcccagaaatttagcccaaatttccagactattttgtgtattaaatccctgtccaggaccagccagggtacacaaaaagacaagtaatacacagttccaaacgtaaataaaagcgtaaatacttacagaagaggcacttagtcctcacaccgaaacgaaagcagcagcagcggaaaaaggctatcctagcggggcttcagctccactccacaggcaaaactcaactgaggtctgagccttggtcttctaacttcgtcttcagctcagaagcactacacttctgaaaaagggggaataatagcaaggctgagtacaaccaccgtactcagcaagccacaccaatgatgcagacgtgcaaggggaacacaaggacggtttgtggctatttgtataaaggcggttgtaaaacattttattgagcaaaacagtaaaactgttgagtaattaaggtaatattaaatctccactgatcaacgctacaccacgttgaacaggcccaaccaacccacctgaactacagtgcattgggttgatttattaaggtggaactaatcacggtgaatctggtcgaccgcccataaccgcaggcacggctattcgaatagttttactctgactagaggtgtacaactgtacccaaaagacacagccccacgacacgtttctgtgcgctgacatgccaccacgaaataccggaaagaggccgtgacaggacccttcgcataaccccctctaaccgattgcaccacaccttagggttcgcccccgtccacagcaagcaacgggtagcccccctctcgtgccgcggtgaatccggaagccaatcaaccggaaattttcccttaaaaaccattggccgagaatattttgcaatattctttgtgccctaaaatactctctgaaatttcccgtcaattttcggagctcaagagataatttcaaagtcacaaagatcatttaatcaatttaaataaaaagaaaaacaaaataaaacctcccttcctccttgggccattttcggcccaagtccctttcccctcccgcggcccgctcaccctatctccctctctcggccagccttcccttcctctcacgggccgtcgacccgtcttcctcaagactgctttgcgtccctgtgccagcctcctccctcctcccctcactgacaggtgggacccacggccccacccgtcaggcccatccccttcctccggctccaactgtcgccatggctgcccgagccaccccactccgccgccttttctgtaccaccccgccaccgccgcgatgccaccggaggaggacacgaggccggaggtcgctcagagcggcggcgagggatggccagaggcggtaaagatggttgcggctcgggttggcagtggaggtggaattccaacgatggaatggggaaacggagtggagaacgagcttgcccgcaaggcggcgaagccggcagtggaggcggcacagcacagcggcggcgggagcggcggtggcccgtggctggaggcgacgagaggctgttgtggctcgggtgcacggtgaaaccggtgcccgggtggtttattgcagaagcggagcggtggacggggtgcggcaatgcgtggcgaggccggcggcgcaaacggcgcggcgcggggacggcggcagcggccagctggagggtcgtcggcgagcggcggcacttgggatcacgtgggaagagcgggagagagcgcggggagtgcgggaaagttggggaaaagggagaggatggccgggggagtgattttataggctcgggagggagtggctcgggccgggatgggcggcaacaggcatcgaagtgggaggcgacgtggagctcgtggggaggtcaaactggtgccgtttttttgggggaaagtgggggaggagagtggaggaggtggaggggatgcggtttctcttgattcggatgcggtttctcttgatacggtgtacctcttcgattatcctttgctaactcttcctgggttgacggactattaggccatgcaattgcttttccaaatatactgcaatctgaacgtctattggaaactgcctttgatgttgccgagaatttctgccctttgatcataacaacttcacatttgtatcttcggtaaagatgatccgtcgagaagaggttctctgccatacgccctgctgattacacctttcgggacttgattcttgtatgctgctgacccatgtatggaacaatttctaccaacttccgagaaacatcatgatgatttctagaatttatattagttgccttgaactaaggaaaaccatccatgattcataatcacaccactaaggtgtaattattgcatagttaatttctcaaaactgaactgaccgactctgcattggaacagacgcagcttgacaaagatttgtaacgccccgattttctttcgggattaaaaatcatttaataatgcattcctagaaattaaataaaatttaaatcaatttaatcaagtgaaataatgggagaattaaaatttcctttaaaaatcattggccgagaatattttgtaatattctttgtgccctaaatattctctgaaattttcccgtgaattttcggagctcaagaagtaattattataatacaaagttcatttaatcaatttaaataaaaagaaaagaaaataatcttccccttcctccctttcaggctcggcccaaattccttcccccttcccctccggcccggccgcccataaccgtctttgggccgctcggcctgctcgctcccctccccctccaagtccacttcgcctccctcccagccttccctctccctccggctgacaggtgggacccatgggctccgtctgtcatctcctacgtccagccaccccacagcaacttccatggccgctgaaaccatcccactccgccgcaaaatccgccatctcccgtcccccgtgctcgcgtctaaccccacttgcttccccacgtcggcatcccactccgccgccggttgccgcctctcccaggccgccccgttgccccgagccctataaaaaccatccccgtgccatcctctctcgtttcccctcctcacccaagctcgtcgcgctttctcccgcactctccacgccgcccccatctccgcggctctccggcgagctccagccgccgccctcgccgccgccacaccgcgccgaggccacctccggcttcgccacctcacgacgcacatcggtcgtcgctcattttccctaaacaatcactgttacaccgcttcccccgcaaggtcgagccatcgccgcctgtaccacctccagcagccgctcctcgccgctttaggcaccgccgagccgtgccgccgcaaccgccagcatctcccagccgagctccaccccggcccttactctttttcccctatccgcctacgaaacgccgccgccacgctcaccacctctcttcgtcgccattgccgactccaacggcgtcgcgccgcctctccggtcgacgccgacttgcgctgccacctccttcggcttcgcagggacgagggcaagcccggccaccactcttccgaaacccgccctcttcgctctaggtgagctcctcctcatgtgatcgtcgtcagccgccgttctcggtcaccctgcaccaattctccccttcctaaccctcctaccatctctcccaggccgcgctacactgtcacgcccagaaattcactagtaatttcagaacttatttgtgcataaaatcctcgtccaggaatcagccgaggtacacaaactgacaatttaatatacagattcatcaaaaaaaactaaagcaaataatacttactgaagaggcaattagtcctcacatcgaagaaaactacagcggaaaaaaaaatctagcgaagctcaggctccactcccacaggcaactcaactggggtataagccaaacgtcttctccttctggatcatttttcttcaactgaggtttgattgataattacaaggtgagcatatgacatactctgtaagccacacatcaactatgcaagtgcacaaggataccaaagtatggcataatataggctcgtttgcaaaagcagcatttagcaaacatttaagagtagtaaaacagtagagtaattaattatcaattttaatcaacactgcatagcaccccaatgctgcacaggcccaaccatcctgtacaaccatacccggctgtacagatctaactccaaacttggagctaagcaaattattaccagttatagcacccataattattgtgagaggtgtgagactaatcacgaaaaacattgctcaactcgcccatgaccgtgggcacggctattcgaatagttttactctggccagaggtgtaccactgtacccacaagacacagctccacgacatgttaccatgcgcctcaataccaccacagtacatcggaaaggaaatgtgacagtacccctcgcacaacacaactcaccacagttcaccaatcctggatcataatcacccctaaaaaaaaccagaggcatggactccccagcgaccccatggacttctcgccgcttctcagtctggtgccccgcaatgaaccacgctatacgaaaggtaaagccgctacccacgctgggttgaggttggcacggttaatgtctcacaacagtagctcgcgaaccggtccttaattgtcatgagcacgaccttcaaaaccatgtgctcacaacccaccattgtcaagttttaattatcaattaattatcataacacgattaaccatcgtgagctaccattaaatataaccataaataataatgtagtttgattcatcccattagtgagctaatgtttctaagcatggctaagcaattatgtatatagcaattagctgaaccaatccaatatataaggtccaagctaatcaatttattacccatatgaaaataaagtcatcttcggccataattaattgagaaaggctcaccacccgatgacattcgaaaataatgcataagttgaaataaaacaatagctttaagtaggttcaacatgctcaaagggttgtttgggatctgtgtgacttgccttgcaataatcggtcttcaattaatcttcttgaacacttccgacgcactcacgaaccttcgcaatgacggaaacgataagctaacacgtaaaacgaagaaaaagactaataaaaaaacaaataaacagtgcataaaaagtagacaaacatgtagatcatgattttagatgaatttagagacttgaaccacttaattccgacttcatatgaattagttatgaattttacaagattaattccaattaaacctattaaagaaaagactattccaaattaattaaacaatttacatataatttataactgagacataagcctaaaccatcctccggaaattattggaatgaatttagtagacgacatatagtaaaaagaactaatatgccattgaaaagggataacaggatttatattgattttggacggctgagatcaactttgacctagtcgaccaaaattggatggctcggattgatctgatctaaggttttagatggctgtcacgtgggatctgagagacggcgtgacacttagatggtagggacggcagctaacaaggcgatgacatggcaaccatgcgggatcgacgccggcggctctattcggtggtgaggacggcaaacggcggcacaacggcggaaaccgagagcacggggatgaagaggaggacacgacgatccttactaacacttacgcagcgatgaacagcaaaggagatggccggcgacgagaacgggagtgacgacggggtactgatcgatgatggcggcggagtttcagcgacaggagacgacaaccgaggggtgaacgggcttctcctcggtgctgcgaatccaatggaggcggcggcgaccgaaggcgacgacgaacggtgcgagtggagatcaaaccatggcaacaacccacgggttcacggtgacggcaaccttccggcgggatttggcgcaaaagaactggcggccgtggtagagatcaaccttgcggagcagagggaagtggcggcactgatcgggaacggccggcgcgacgggaaaaggcggctggagatggcggccggagttggagagagaaggcgagcgtggggaggcggctagggttagggaaaacttcgggaaacagagggaaaccgaagaggaggccgaggggctgctatttgtaggcaaaggtggaggagatcggctcgagaacggatgaattcggtgaaggaagttaagatttatcccgagttcacccggataaaaacgactgaaattcgtgagatagataacgaattttaagggagttcttggagataagatagaggagatagagaggaatccgtttttgcaatcaattttggaagggaagcaacggatgcatcgaatttgatggaggacacggcggctctcgggaagaacacggcctctggacggctggctggagcttgaagacgcactgtagcaggagggagggcaatacagactttcagctgggcttcattttccaaggcctgattgaaggagggacaagaaatggacttcggaaaagagagggagagggctgcaggctgagaggagactgggccgagagtgagaggacttttcctaattcggcccgaaaaggaaaaggggaatttaattacttttccaattaaattaatcaccaaaatgatctttgaattgttaaaaatacttccaatgctcaaataatttcaagaaaaatcctgaaactaattggacactcaaagtacttaacaacgttataatcagaccatttaatgattaatttattatttaaataattgctgaactgctctttgtattattaaaattaagaattgagctccgaaaaatccgagaaaatttcagagagtataattaaccatggagaatttaatgaaaactaaatccagccatgctttatatttaggaaattttatttcctacatttagcttcacttgaaaattaatgaacatttaatataaattctaaaaataatttattaaataatttatgaaacctaaagcgaaaatcaggatgtgacatgcacctcggctgcttctctgccttcgccggaaaccgtcgggccgccatccgtgccgcctccccgaggagcgccgtcgctaatcctcgtcgccgactgccttcccgtcctcgcctcatcgtcccgtccgctcggtgagcatccctccctctccctctatctccactttgccggccatcgccgtcagcgaccatccggccgcgcgccgccgcctctcggccggctggcgccgctccgccgcccgtggaccccctgtggtccgggtccacggcgtctcctgggccgcggtggacttggtccaccgtgtgccaacccttgtagccactgacgtctggggcccacatgtcggcgccggcctccccttcgatgacgtgagcgactaccttttccctttgaaaaataaatagtaattgcgtcataattcgataataattctagaaatccatttaaatggctcaaaacttctaaaatttatatctaattcattcgaactccaaattgggccattcaacttgcaaaattcatctaaaattaagatctacatgtttgtttactttttatgtactgttttcttggtttttattagagtttttccttgttttgcgtgccaacgtgtagaatccgtcgttttggaagtccacggtcgcgaggaaaagagttcggaagattgttttgaagaagcaaggtaagtcacacattccccttgagcatgttgatcccaatttataaatgttttaccgtttacaaataaacatgcatgtcttgctaattacatgggatccgggtactacctatctgcttgcttgtgctatgtttacttgatatctgtcttttgtcaaccttgggtaataaatcgactagctcatgttacttatgtgacctagctagaactatatgcttagccatgcttaattaccactagctcagttgatgggataattacagtattagacctttatagtatcagaatgagctgcgtgcttgagacatctggccatgctttatggtcgtaattatccaactaaaatgcgactgaatggtgggctgcgggtgcatggttttgctagttgcacccatggaaattaaggaccagttcgcgggaaaccctggaagaatttatcatgcttaccacaagccagcgtgggcaacggctgggcttgtagtgtagctttcgtctagccaatgtacccaggcgagggtgggcgtgatggagttgggtcggccggggtgtctggctgatcggcttccggattcactaaggcacgagaggggggcttcccgttgcctgctggggacgggggcgaaccttgaggtgtggtgcgatcggttagagggggttatgcgaatggtcctgtcacggcctctttccagtatgtcgtggtggcatgtcggcgcatggaaacgtgtcatggggctgtgtcttgtgggtacagttgtacacctctggccagagtaaaactattcgaatagccgtgccggcggttgtgggcggtcgaccagatccaccgtgattagtcccaccttaataaatcgacccaatgcactgtagttcaggtgggttggttgggcctgttcaacgtggtgtagcgttgatcagtggagatttaatattaccttaattactcaacagttttactgttttgctcaataaaatgttttacaaccgcctttatgcaaatagccacaaatcgtccttgtgttccccttgaacgtctgcatcgttggtgtggcttgctgagtatggtggttgtactcagccttgctattatgccccctttttcagaagtgtagtgcttctaagctgaagacgaagttagaagaccaaggctcagacctcagttgagttttgcctgtggagtggaactgaagctccactaggatcgcctttttccgctgctgctgctttcgttttggtgtgaggactaagtgcctcttctgtaactatttacgcttttatttacgtttggaactgtatattacttttcgttttgtgtaccctggctggtcttagacagggatttaatacacaaaatagtctggaaatttgggctaaatttatgggaatgacaagaaagccatgcaaagactagccaaacgccgagaacgcaaagagaatgaatctaccatctaggccaatcggcaactcgtgcatgaagaaaagtccaagcttgatcagctatgtgaggggccaatcaagtctaatattgatcggctcgaagctcgcaagattgaactcttggcacaatttcaagaatgcaacgccaagctggatctggaacacaaaaagttagccgatctcccacaagctgtcgaagaacagaaggcaaggctgtaatcagccatcaaaaatgttgctgatatgaccaagtccctaaaaatcatctctgggaccgatgctcaagatgcccaagccatagaagaagtagaacaaattagccaaagagctatatcggctatccagcgctacttgtctcagtgacatgttgtgtaatagactctatgaatttttgtaatcggctaagaaactctggatctttgtttaactagtcttaatgtgccgattaatataactccatgtttttgctcaaaaattttacaatttttgcacatatatgccccctaattttacaatgacgaagacattgctaaaattataagttgaactaagggcgatatcataatatcggccattgtacatcggtaaaccataaccgattacaatatgaaaaacatctaagggcgatagaacaatattggccatctcaaggcaatgtgaacacatcggctatcatgcatcggcaacaccagccgatcatgcattgacccaaacacttgggtaatatttcttcaagtatttgccatttagcgatcgtccataaacttctccatcgagttcttgcaacacataagctcccttagacaaaacctgatagattttaaatggtccttcccaattcagcgaccacttgccaaatttgttatctcgagtcccaatcgacaaaatcaatttccatacaagttctccttccgaaaaagacttgggcacaactttcttgttgtaatgtcgagcaactcgttccttatcctaggtaacttttgcaagggctcttaatcttgattaaaccaagtcttccctttcatcgtccatgagattataatactcatcggctatcaaatcattttgcaactccgttcttcttgagccaattctaacttcccatggtaaaacaacctcatgtccataaacaagcttataaggagggacttggatcgatctatgaaaagccatccgataagaccataacgcttcggccaatcgagtatgccattgccgaggataatcggaaatatttcgcttaatcaatttgatcaaactcttgttagatgcctcggtttgcccattagcctatgcaaaatatgttgaagaattcaacaatttgatacccatactatcggcaaactgaacaaactcatcggacacgaagattgaactttgatcggttgtaatagtttgaggaatacctaatcgatagattatatgctcttgaacaaattgtatagcatccccagaatcagctttcttcaaaggaatcgcttctagccactttgtaaaataatcggttgccaccaatataatcttatgccctttgctcgatggtggattaatcataccgatcatatcaattcctcaacctctaaatggccatagtttaatgataggattcatagccgacgccggtgccctttgaattgctccaaatttttgacaatcttgacatcccttgtaatatttgaaactgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtcttttttccccccctccccttcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgcacccgccgcctcgcccgtgccctagcgccgccgccgccgcggattccgccgcatcccgccgcccccgcgcgcaataaagagggggaaatcactccccgtgattccctctccctttccccccacttttccctctctctctccctcggattcgtttggaaactctcccgcaaacttcgccggcgcatcaatggcggccggatcttccgcggccgattccccctcatccggccgttctctccccctcccaacactatataaacgctccccgtgccttcctccaccgtttccgccactcgccgctctctctccccgtcggaatcgagctcgcgccgtcgttccctctctccgccgtcgccgccgagctccggtccgccgccgtcgtcgcctcggactttctcccgcctcggcgtcgcctccttcggctccgccgcgaccttgccgacctcttccacccctccgtttcgcccgccgaccgccggaacgccgccgtccccgtcgacccgagccgcgccgccgcctctctccgcttcggtcgccgtttccgttgtcgccgtcgacccggggtgagccgtggaccgccgtttcgcttcccccttccctcccctctctcgggcgccgctccgccgcgccggtggtcgccggcggcgaccatcggggcgcgggcgcgtcgcctcccgtcggctgtgccggcgaggcagccttcgggcgcgccccgtggctgccatgtggggcccggccgtcagccgcccgctcccgcgggtacggctgacgcgtgggacccacggcgccggccggcgtaagccgcgtgcacgcggtccaccgtggaccgtgaggctgccgcgtgggccccactcccgtggacccggtccgcgcgcccctcccctcggctgacgcaataaatccgattttaaatcaaaatttaaatgaagaaattcgtaaatatccatttaaagagcatataagcttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattatttgttattgttattatttccttgttcaccctagaataaacaaaaccccaactagtggacactctactcatggtatcactagtatgattttaggtagatgcttcgcttttaattaggtaaccttaggcgattttacaactctagactttgggaatattcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtcta

SEQ ID NO: 79614 - DNA, 40774 bp, Oryza sativa
agcaatatctcctgcacttacgttaactgcaggaacagtatcaataagaacaataagtagctgcataacaaacattaagtaatcacaagatgaaagcatcagactatcattagtaaatgaagaatcactaattttgattcaagtataacgtttcaattttacaccttataagttgctagaatcacagtcatctttaaaaaaaaatcattccgaaatgatgtattaatctgaaaataagttgtttcatagcaattccgtgcatctctattatgaaagactagattggctctacaataaagaatgacaattcaatgagtcaatgaaatatttgaagctttgataatataattctgcaagaagctctgtatgctactccattggtaaaaacaagtagataactagtgtcaacaaactaagaacaactaggtcagtatccaataaagcatattctgcaaggagggacacaaaactgtaggtcctcaactatagtgctcacctgaattactcactgcctctgtgagctcaagtgacttcaagtttctgttgcgtgctatttggagtctacgaccagttgctcggataagcatggcagctataaaatctacggccacaaaaatcaaactgtcttgcattcatgagtgtaatataaattacaagatctccaacatagttcaaaaagataatggagtacattggaggcttcattttttttatttggtctgaatcattacatggtaacataaaaataataagaacataatttaaaaaatcatcatagaaaatccttttcatccatggaaatcaagtggctaatactgttagagaatagagacacagatcctaggtgtaatggaaaaaattacataacaacttatttacctgcaatatatatgatcatgatgtccaacagacctgtaataccatgaaatacaaggatgtgagtatttcaaacattgatctgatattgtgataaaataaaccaatcctgtcaaagcatatagctgcagtagtgcaaccaattgcgatcagagaagcatcatagacaaggaattgatcaccttttgttagtcaatggaccaagaaccaatagaagcaaaggggaaccatgatacattgaacctgaaagacaaaacattcaccgtgctgaataatcacttccagttcatgctacaagaaaaacacattgcaaagagaccctactaaaacatcatggataaacctataacaatgacaaatacctgcacaattatttgctaagtaaaaggtatggcaattttgcgcttattttttttaacacaccccattagtgcgggcttgcagcagttcatgcttaatggagcttactagaagaagtagcacccaatcaatttactttacttttaaaagtgctctcatgtagctagtaattccatccctatactgagctcaacaattcacgacttcagttgtcccccccaaaaaaaagtaatcaagcaagattaagatgtgtggaacgaaccggagtagggcgacatggaagcctgcttcagccagtacccttccgccactgcaaaacacacaggaaaacaagctattagtccaattacggcgacaacacagcacagctcaagtctgggacgaggaggcaggggagcaagggagcgcttacggcggcggatggaggtgaggggggtggagacctcggggcgggaggcgaggtggaggtccccgccgaagagcacgagaacgagccggaacccgacggccgccgcggccatcgaccagaagttccggatcgccatcgccgccgccgctgccgcaactccgatctgcgcacagccaccgcttcgtcgtcacggctgtaaccggagccgcggcctggcgattgggccttctacgccaagtcgtcatggatgtcgcctttgcgtaattgagttgggcttcagcagccagcaccggttggatggcccaaatcatctgcaattcgggagtacctatacatctttcgaaagatttttataatcgtatcatacagatttttaatctttgtattaaaatctgatagatataataaaaagcaaaaaacaattaagaaacaccataatgaacattaaattaccatatcctcaagaaaaagaccaaatcaaatataaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgattctttagtgttaaggcccacattagaaaactttggaagcccgacctggaaaaataccagcacaatgttttagagtggttttcaccaacaggcacaaaggttgaaacgggaaaatatgtggtgcaaaccatatatagtggaaacttagaaactaccgttggatcgagaaacgacgtcagagtttcgtccacgtcaccatgagttaaaatttaactcgcagattcactcatgagttaaaatttcactgggagttaaaatttaactcatggtgacgtggacgaatctcgaacatccatttctcgatccaacgatagttttcaagtttccactatatatatggtttgcactacatattttcccaggttgaaactgtgatcccaagttccaacttccaagcaaagtacacgtgtagttccatattgtattactacattctcataaaatatatactagtaatctaaaatcggattagatataacataatactataatctgaacatgtagaatatggataggaagcacatatcctaattggctagtagtatggatttagacagacaacacatattatatattatagtagactagtattacgggtctagacataagtttattatctatatccatagtacgtttaatccggtttgctaaaatcttctacttcaataataacccatatatgtaaacagatactttttttttaagataacatttgtgtcccaaaaaaaggaagcacagatcataaaaaggtagacaagatcgaatcaaacttctcaaaataccataatgtcttgacgatgacaagtagggtctggtacaacattattttattttagcaaacttataaattattaagacaactattatggtattatcaaatcttgcccgcgtattaaaatgcccaggtctcgcacgctagcttctgatcgaaaccgtctacacgcagtcgacgtctacgcgacaagccgcgagaacgtacgccgccgccacaacacaatcccaagctcccaacctacgcaagctcaccatcgccggccgtcgacccaatcccagcgaccatgaggcgtctgctcgtcccggtgctcctcctcatgctcggattgtctacctgcgagtcctccgtgttgcaggacacatgcaagtccgtcgccgccggccacaagtacgtcacctacaacgactgcatcaaggccttccaggccgacagcgccagcgccaccgcggccgacgcgcgcggcctcgccgccatcgcggccaggatcgcggagaaggccgccaacgccacgtccgcgcgcatcgccgcgctgagagccgcggagaaggacgcgaggaggaaggaccgcctcggcgtgtgcgcggaggtgtactcggacgccgtggaccagctcggggagaccgccgaggacatcgccaggggcggggacgaggccacccaggacgcggtgacgcagctcagcgcggcgctggacgcgccagggacgtgcgaggacgcgttcggcgaggccgacgacgcgtcgccgctggccccggaggacgccgagttcgcgaagctggcgaccatcgccctcgccgtcgctgcgtccctctcgccgccgccatcgacaccggcaaccatggattgatactgtctattaatcatcgtgattcgcgcataattagaaatttagcatcgtggactacattcagctataataaaagatttttcgatgatatgttaaattttttatgctttacttggaaggattttgtccagtgccttgcatgttacgcatgcaacgtggtttagtgggcgagtagccagcttggaatctcatctcgcgctttttttatactccgtacgtggtatgtctttgaacgtgggtgctagctgttttctggaagtgggagcgttgagtggaagcaaggcgtgctgccttctgaacagcacttttgcctttcgccttcgctcccttcttttctatgtggcttgttggcatatattgctacaaaattgtactggtaaatatacagatatatattgatctgctgcgaaattatgatttgtgtatcgttctggattatttggagttttaagtagtaccacgtaaaggccattcggtaattgagcagagcagcgctagatgttgatctcaagaaagatatatgcatcagaagccaatgagagtaatagtgccattgatcatggattcatgtcttgacgttcaccggtagccagaaactgaaagatctaagccagctttcttaccgcatcttgcacgattcatgctcttgatggcatcgtctatcgtcttattgtttgggtgcgtcgaacgtaactgaggtggcagcactatataatacccagattagagcctagctcattggttagatttggggcagggggagataatcagagaaaaaccctcacgcgtcgctctcccaggggcggctcaggaggcaacgacccggccgcccctctcccccacccccacccccttctccgcctcgccgtcgcccgagcggccgccggcgaagccgcgcagccacaaggacggcggcggcggggcgctcctcgtctcctcgcgctcgggcggcctggggagccgcccggagtggcgacggcggtgtccgccagatccgcgccgttccggccggatctgacgggatgggctggcggcggggacgggcgacggtggcggtcgaggtgagttgcgcggggtggtgttgtgggtgatggcggcggggatggtgacggcgttggggtggcaatggtggaggccgcggatccggcggtggcgcacccggatccggcggcggccggtggtggccagagcacgcaggcaccccgcggctgccactggcgtcctccggcgcccctctaggcgtcggccggcgttggtggagaggaagacagccggatctggctccttgcccagatccggcgcgtcctcgggtgggaacggggtggttggagtccggtcgtcgtgcaggtggtgtgaatatcgcaggtatcctcggtgtgcaggtgacatttggtggctcctgtcgtggatgctatggttgatgggtgctccaaggcgaaagtcttgctccgctctcggtgctagcaacggcgacacccttggacgccgttcaccttcttgaaggcgttgctactggagccctcgttcaactccacttcaagagttttctccgggtgaaaacctagattcgttaggatcggacgatgtcgtcgttgtcggcgtaaccttcttaaaggcttcgttttaggagtttatctcttgttggacggctgtacttaggttcggtttgtcaatgtcggggtttttgctggttttcctttaattaaccgtgttgttgtaaggtttttgggtccggtttcccttataaactggatcaactctcttcttctatagtgaattgcaggagctccctgtctgtcccctcgaaaaaaaaagatttgggacaggggaccataagcttagagggggctcagagaaggtgagggatcgacaggcttgcagcattgcagagtgcaaagagagcccgtaattagcagttttatgaaaacgcaaacccccaaatgaaaggcaattccaactaatctgaaaattctgatgaacctgaggatactcgtctcagtgtgtctgtgtgcgctctaatcttttctcctttttattttcaaaaaaaatcttttcctacatctgggccggcccgtcctcaggacgtacacgttctgccgtttgcgatcggtgtctgccgtttgcacgaatgaagcaggcctaacattcttcttccgagagacgtggaattatgaaggaataagttcatctgaagtctcttaacttgtcaacgaatccgattttcgtcctccaaccgaaaaatcagatacaacaagtccctcaactgtcaaaaccagtgcagataaggttcctcagcggttttagctgacgtgacgcctacgtggctaatctgactcggtctccatttgatgtgacactgacgtggcgtttacgtggcaatttgatctaagaaaaacaataaacctcgtgggacccacatgtcagtttcacacataaattaataaaaatggtggggcccatgtgggccccaggtgtcattctcacccatcctcttcttcctcctctttccctatctcccctctcttcctgtctctcctctctctctctcaggcgtgacggagagggagcggcgcgcgccggcgccgacgggagaggatgccgtcgccgcccatggcgaggatgccgtcgaggtcggagggcggcgtggaggacggtggaaacgggggcgggggccgcgatggtgagggcacgacggattcgggccaccacgcctgtcccctccggccaccacggcggcggcacgcccttctcaagcagaaagcggcgctgcggcgggtcgcagtgctgcatgagcgccgagagcaacgaacccagcgtggtgtcctgcagctcgtgcaggaagtgcggccctgccggcgcggcgccgccgacgttgccgtcgcaccccggcacggcattgtcgccaacaaattgtcagcctggtacttgacgatggcggccgggccgttgcggtcgaagcggaccttctccttccaccaggagcggaggttgtcggaggcgctgctcaccggcttgcccttctccgggatgatgccgtacacgaacccctgcgcgttgcacacctccatcatcttgagcatgtacttgaggatcccgtcttgctcctacgactgctgctgctgctcatgcaagctccgccggcgggaggtgaagagaggggagatggggagaggagaggggagagagatgaagagaggggagaggggaggaggaagaagaggagggatgagcaccacggcgatgttgagcaccacgagtccacgacgaggacccccatgaagaagccgaagctgagcacggcggacctcgacacgcggagtatctgcttgactgcttgccggaggcatctagtagccctgcaaattaattaatcagcagacgaagataattaatactcctagctaggtacgtacgttgtcgacgaagaccgttccgaagttgccgacgatgttgatgatgccgaagacgagtccccccgagctgagcatggcgaggtaggagcccttgaagttgccggcgacggggccacacgcctggccgttgcgcgagaggtcggcggagcagtcgcgagcggcgctagctggcgacggccatgaggcggtcatacaccacacgcgggctggcgagtgtgtagacgacgacgccgagcgggatgaggaagctggcggcttagatgtctactccggtgaggccgttgacgacggcggagccgccgaggaggagcatggcggcgtggcgcagaggagagggggagagaggaggggtaagaatgacatcccgcgtgggccccacatttattaaactaatgtgtgttaaactgacaggtgggtcccacgaggtttattgccccgtaagcgccacgtcaatgccacatcagatggagaccgagtcaaattagccacgtaggcaccacgtcagccaaaaccgccatccaaaccgtcgagggatctcatctgcactggtttttgatagttgagggatggattgtatgttgttttacggttgaaggacgaaaatcagattcattgacaagttaagggatctcagatgaacttattctaattatgaacacaagtccaaatgggcttatattactggattgttttgttcagggagagaaaagcccaaatcgagagtgcgtagcgcagcgaggaacgtgttacgtggtcgggacaccggagaacccaatgcagccagccaggcagatcgacgaaaatctcgaccatggacgggcgtcgtttccggcggatcggtgtccggttctcagcatcccattccattcgatgtgtgtcctaactcgatcgtgatctctttgctacagcaacacaatccaaaaaaggccctaggatgacgctgatgcttcgtacgcgatggaactacactagagtagtccactcgtgtcggagcacttcccgggtggatagcatacgatcgatgttccattacgtactattgtgcggcacagctaatgattgtacatgtatgaagtactttcttagcaaaatttgttcatagatactttcaaaaattttggtgttggctaggggacaccgttaaagcaaaaaaaaacttggctctttctttttactatataattcctccgtctttaaatataagggattttttcttccagattcgttatattatgatatgtcacatccaaccaaaagtccaaaatcccttatatttagagacgaagggagtagttcaaaacttatccatgttcgctacgtctatcacttcatctaagccacatagttcaacacgtcatctgtcaccccatgtgaacaaatcatcgagcagctgccgtcctcgcaccacggctcgactaactgccaccgccaccgcccaaggcagaatcttgcaagctcgacaacgccatcgcccatgtcttctcccactccactcggtgccactgctgcttcacttgggccgcactgcctttgctccgctcagtgtctcaacttcatccgccagtggggaaaggtagagagaagagagaggggagatgaaaagtgagaggagaactacactgtggagcatgtatcctttcaggggcttaggactaaccaacaaccaatactcggcaagtgcggtatctacactgctatcatcctaacagggtaaattcgaggtggcgaccggtgagcctcaccaataaaagcttatgcgtgggcagcccgagtatttttgtcatgcattaccattagcacgtgtcaatgggagcaaattaaattgggagtaaggtgagaaaattattagaaagatgtgagaagtaaaaaggatcatacattctaagggttttcacaaatagcttaagttgatttttttttcaaactattttcaaatcgtcaagccaagctttagcttacaattagcattgctatgataccaactgctgtgggcaccacacgtaatatattgtccagtgcttatcgtgactaacacatgtatttggatctacgtgtgttggtcatgttggacacactggacgatatattacttgggatgcccacattacgtctttgctgcgatcccctcttaaggttgtgttctttagggcctgtttggtacaactccaactcctaaatttaactctaggagttaggtctggagtggagttgtggagctgtctaaacccagctctacaactttcattttgtgagagagctccacccagctccactcctagttttgatggagctgaaactgtttggctgagctctagctccagaaggggtggagctggagctatgacaaacaggcccttagttacccctgctgcagcgccggtgcaagctattggattcatccgctatgctgactcaagcgggctagcatccccttgcagcccgtgctgcccagcgttgttttgtatcccatcatcatcgtaagctcagtcagggactcaggccctgtttctttcagcttaagattattataatctatattattgagtcatattactataagctagattgttataatctgtagtagaataagcggttagttgtttcttttctaaattattagagcctagattattgggtttgcaagtctaaaaagggagtggggtggcatggtgggtaatttttcacccaataatctggaaaaagctcacctaaatgagcttatcggattataataagctggactccagattataataagctacttcaataagttgtttgtttctttcagcttactcctaataatctggattataataattctaagctgaaagaaacagggcctcagggtcatgacgccatccatactctgagctatagatgaaccgagtggtactgaggtcatttgataatgtttctgtgtccaaaatagcaggaaataatataacaacgtgtgccataatcgatggcaaataatcagaattttggagcgtttacgaacaaaataagttttgcgaaattctcaaatatcgtttagcttttttttccctttttttgcgtgctttctgtggtcaaatttggagtgccaactatacatcagttgggctgatcctcactctacctgaaaatcattggtccacccagaacgaatcttggctgcaaagttggaaaaaagacgtttgaggctcgttagctactcgagcttggtcgttacatgctttgattcgctcgagcctgctctgaagcttgcgagctctgaccagccaagctcgagctgttcgccaatagcccctctcatctaggctcttttattgtccgttggctttgattcttcatgttaggtttagtcccatatcaataattgataatgataaaatataacttaaaagatgaaaataattgtcacctatcaaattagtattttagcctgtctaaagttatgaatccggttaattctacaataaaaaatatccaatatgttctgagtggtccatggtacactccactttcctcatgttcacatgttgttggatggtctgatagctaggactagctcctccaacccactcggtgcaccatttcttgttatttttgtaaaaagaaaaaaaaacactagttacactagttgttaacaaaatagaccttcggtagcatatttatggcttattcgtatggccacttcatccggctcaaagcggttcgaataaatgtatggtctttgaagaaaatcgattagggtatattttaaaatttcattctacttttgagctttggtgcttcacgcttcacggtgctgatcgattagggtaaatccaattcatgcccgaaaaggaaaagaaatgtctaggctcggctcgatgctgtgtcaagctcgagctcaggcatgtggtcttagggctggacaaaaaactcgttactcgttacctcgctcgctcggtttggctcgactatgctcgttgtattttttaaaagagccaagccacgtataacgagctagctcgatcgagcttgcgagctgctcatgagcttaatgagctagataggagagacattaacaaaacatggcccataagtataactcaacttgctggcccagaaagagaaaaatcagtccatcccgtgctaggcccaaagaaaatgtgcaataggaatgtccaaaaccctagtagacttggtcaatcagtccccttcccctcattctcgatagatccagattcggcatcggcaacagccgcccgtgcgccgcctgagccgtctgcgccgcctccgcacatcccacgccgctccctccatcctgagccgcctgcgcactccctccatcctgcttcgccgtcgcccgtccagcgtccagtggccgacgctcgctgcttgccggttcatgcccaggaaccagatggccggtccccaactgcggagctacccacgccgtgatgctcactggtcgctgtcggcctctcgatgagcaacccatgccgagtgtccctgtgcatcacggaggaggaagacgaggtgcagccgtgtaggtgtaacgtactaacatcctcctgtgatttgttcaactgatgattcatttgttgaacacttgactctgtgattcgttgcctcattactttgatacttagatacagttgcatacttggatttgaacgctggtttgataatctgaatttttattgcaaactttttggttttgttgtattggctcgcgagctgaacgagctagctcaagctagccgagctgatccagtcttctagctcgttagaataacgagctggcttggcttgttatcctagcaagccagaccgagccgagccggctcgatatccacccctatgtgggcttggtcgagatcggctcgttttagcccctgacgatagtaaaacaagggatcggtcggcggctcgcgaagcgaaagaaggaggaggcagttttcaattttcacacgactgcagcgccccaccctttcctactctttttatttccccacttgtcttcccccgtgcggcgccacacctcttctcatcttctcctcctatcaactccctctctctccaccgctccgcttgcctcggatcgcgctcgcgctcgcgcggagcagcgcccccaacgacgggcatggccggtgacagcggcaacagcgacggcggtagcaaccgggatgaggaggtccagatacagatcgcaggtcaatcaaatctttcccccccttcctctgtcgaaagcctcactgtttagctatgtccgattttcttcgttgagggagtgggggtgaggaggttagagtcgtcttgcgatgggcggcggtaaacgcagatgaaatgaactcgttcgttctctcgggcttatttggtgttcgatggtgtggggaagtaagcccgcgaggtgttcgatgaattgccttctcgtgcgtggcgtgttggatatggccatatgcccatatgggatttgttttttgtttatagaccatattaacttttcagactatcgtgacatcatcgagtggcagagtaggcatgtgagtttaattggcaaacccctgttgttcgcgtacatgagctggataagtggttgatgatagcaccagctatagtaatgcactgcatttaacaaaagtaaaatctttatattagtttttttatattagtgcaggatttccctgagattccaagtaactcgctttcatttgatagtttcaccaatggacaatactgtaaggatggagctatagtcttgtgttgctcgactttctctcaataaatttagagcttttggggtttatatggccaattgttggggggaaaaaaaggagaggagggtttcacttcactatgggaactttggtagtctattttgaataggaaaagaaagtttcagttggccgtgctatgcttaacacatgaagtttgggctaacctgttgatactgcctaccttctgtaacttgcagattcatccaaagctgcaacttcgtcaactcatgaagtacctatacagaactctcctgtcaagagttggcaatggtggctgatggtgggagttaacatgttcttcctcattgccggtcagaccgcatctacacttcttgggaggttctactacaatcaaggcggcaatagcaagtggatgtccacattcgtccaaactgctggctttccgattttgttcattgccctatttcttttccattcaaagacatcttctacacaaacagtcactagtagtcctgcccctacaatttctatccccaaaattactctgatatatgttgtcctgggcctcatcattgctgcagacgacttgatgtattcctatggcctactatatcttccggtctcaacatattcgctcatctgtgctagtcagcttgccttcaatgctgtcttctcatatttcctcaatgctcaaaaattcacccctctgattttcaattccgtagtcctccttacgttttctgcttcactccttggagttgatgaagattctcagggaactactagtatatcacatgggaagtacattttgggtttcctgttgacactaggggcatcagctacatactcgctcattctctccctgatgcaagtcacatttgagaaggttattaagagggagaccttctcagttgtgttgaacatgcagatatatacagctctcgtggcaacattggcttctcttgttgggttatttgcaagtggtgaatggatgactttacaaggagagatgcatgcattccagtctgggaagctgtcatatgtaatgacactgctgtggacggctatatcttggcaggtagcatcagttggagtggtgggattgatctttgtggtgtcatcgctgttttcaaatgtgataagcaccctagctctacccatcattcctgtttttgctgtgattttctttcatgacaagatggatggagtaaagattatagctatgctgatggccatttggggatttatgtcatatggccaccaattatatgttgatggcaagaaaggtagaaagactacagtcagtgtagaggaaacttcctaatcatcacaatgttgcctagaatgccgctcttaccaatttaagttgttggttctgagtaaggtactgtagttattaggaacctcatcaaagaaattccatttttgcaccatttggtatataactatacatattgtcttgattactctgatgtaaggatgtatcaagcaagagaataaattttatgtcacccccaattttccttgtcctgtggagtagtcaagtcgatattgtggttgtgatttttggcacgcttggcaagttgatactgtgccattattgggtttgattcaagtgtatacagtcgaatgcaggttcaaatatatgttatcagtgtctatgtgtatgtcaaacatccagattggatggttatcacaatgacttacttggtgatgaaatccaatcataagagggcgacgacgctcgatctgctgatagctctggccggctcataaaaatattaggagaattgaaattgagcaggcgaaagcaatgggacaagaatcagccaaagacgccgccatactgtaacgccaccaggagttagctcgccaaccaacagcttcaccgcatctccttgattttttttctcgcgtctaatttgtgaacaaaactcggaacgggacggccacgacggtgacggacgcccaaacgggcaacctatgatgaccaattttgctatatatttgtcgacaaattttctcttaaaaatttaacactataacttatatgtaattacactataactataatataacttataatataacttgtatgtaactttcaaaaatctctccataacatattattttggtaaaataaaggttgtgggaacaattttttttcagatatgtgtgtactgtgatttttttttcttcctcaccaaaacaaatctttataatagatctaataatttaaaattacgtgaaacttacatgcaagttacagtgtaattacatacaaattacagtgtaattacactacgattgtactgtaattacatctgtcaaatttttagaagaaaatttgtcgacaaatgtataggtggtcccatgatgactgctgaggtagagtgggccatatacgggtcgaatcttcttcgttgcttttgcacgagcgatcacattcggcccattgagccagtcagccagaggaataagttcaccggagatccctcaacttaacaacgagattttttgagatcccttaaccacaaaaccagaaatctctacccctaaactatacaaaaccgttcactcaaggtccctaggcagtatatatgggtggtttcactgacgtggcatactagtcagaaaaaaaaaattatacgtgagggccacatgtcagctgcacattccttcccttctcttatccttctcctcttttctctcttctctcttctcttcttcttcagtgagggatctaggccggcggccggtgggcggagcggcagcgggccggcggtggacgagcgcgccggggcggcgaggagaatggcggagaaggcgagtgaggcgggcggcgaccttgctcccgttcgcgtgcgtggagttcttccgaccttgctctcgtccggcggtgcgtccagggcgcgcccggcgccgtggagttcctcttgtccgtcgtcaaggggcagcacgccaccaccgtggacaagacgacgtccacaccgctggttcgttctttctaggaagagacgacgtgcggcgtgcaggattcggcgaaggtgagctcgccggaggaggcggctttgagcatcctgcatgcttcagctctcctccttcgcctgcttccgcgccgaccccactgacgacgacttcatcacgccattcccatacgcgtcccacccgccgccctcgtctcctcagccattgccgccgctggagcttgagctggtcgtagtagagcgcggtcagcacctcctaaccacaaaaccgttagtggtgtgcatgcatagcttagttagctgattagttagagttagtcaatacatgcatgtgttgcatgagttgtgtggcagttagcttcgtgtatgcggctagctagtggctgccaaattaagtggatcgcgtgctgcgtgcgcgtacgatgtggccgaagtttgtgttcttagctataaaagtcatgtaatctcggcttccggcttccggctccggccgttcacgccgcccgaagatgatgcggcgcacgttgtcgacgttctggacgcgctcaccggcgccgtcgagcgcgatggtcagcaggtcacccgcggtggcctgctcgagcaccgccgccacgcgcgcggggctccaggtcgcggcacgtattgggagccagcaagagatgacgccggcgaaaccacccaccgctccacccgccacccgctgaccgctccccgccgccggcctccctcaccgaagaagagaagagagaagagagaaaagagaagagaagaggaataacagagaagaaaaaaatatgtacggctgacatgtggaccccacgtattcttttaattgtttttgctgactatgatgccacgtcaacaaaatcacccatatatactgcctagggaccttgagtgaacttattcctcagccagactgctcccaaaaaccagaattcccacgcggccactctgaaagaggactcgcaggaaaattgggaaaaagtatattgaatgtccctcatcttgtcatcagattacaaaattgtccattaaccgcaaaaccgggtcactcggggtgtttaggcagttttgacaccggtttcatctgacgtggcaattaagccagcgtagcacctacgtgggccccatatgtcaatgaaacatcccttctttttctttccccctctcccgtctcttccccatcctcgcgtccgcactccagagtggcgcaacgggcagcggcgagcggccgctaacccacggaccccgacgacggcgtggacgatgggcggcggcgacaagctccattcctcgctcccctcctctagctccctcttcctcggcgtccccggccccttcccttctctccaaacgatcttgaggaggagcagcggcggcaacctccccgctgccatggaccctgacgatggggcgagcggcggctgacgagctccatgtgcacccctcctccacctcctcccatagtgcccccgccccttctctcccgtcgatcttgaggaggagcgcgtggtgacggacctgggactctctgcgtttgtccacagttacgccgcctaccttgacgaccggctcgagatccgcctcctcctcccaccaccgcgctcgactctggccccgcgccgcgccgttcctcgtcatcgacagcctctcccgcatccacggcatcggggagacgctgctcatcgtcaaccacgacagcgccgccgcggtttgtccgggacaggcgcgccgcgacggtggcgttggagtagacgggcagctggccctccctatgctcccccttcgccttcccccatgctcccgccgtcgccaccgccggctgtcgcgcctcctctcctgcctcgccccgccggcctcctccccaccaggcgcccccctgcccaaacgagaagaatagtgagagagaggaggaggtgagaaaagaggggaaagagagaggtgatgacgtggatagtctaacaggatgggttcatgtggtcccacgctgattcagatactacgtcggacgaaaccggggtcaaaaccgcttaaggattcagagttagccggttttgtaagataaggtatgttatatatctgttgtttttgcggttaagggatgattttgttatccgatgactaagttgagggaccttcggtgtactttttcctaggaaaagccactcttgagctttactgtgcggctgaacggcccatttggcagaaggcccaagtggctcgtgtgttctacgcaatagttaggcccttgtacaaaactagagaaaattctgaatttctgacgaatatatgtgcgtgtagagcagttaaccatgaagttggtattccctgatgagtttgcacgacccgtcaagaacagatatcgatcacaactcacaagcttttccggcccgtccaagaaatattgcagtctttccgttaagaataagaagaagaagaagaagaagaagaagaagaagaagaaatgttgcagtactgcagaaatcaccaagcacagcgtaaggattctgtctcaccgaactgtccgtccattttgcagtacaagactacatagtttgcagaaacggagaaaccaactggaccgctgccaccgaaaatggagaatctatgacataaatactctcaacagccagtttcgtagatcgtgcttgggtcatcgccatgcgctggcgcgtcagcaagaaggttaagtgcaactccatttgtggtacttatcatggatggtcctaatacagttctccatttaagggcttgttttgttgtgaacgcatcaattagcgacgcatgtgcttgaaatactttgctcatctattgcgttcatacgtacatcatcaacttaacaactgtaaccagacgcatttatcctcgaggttggtggaatggcgaccatcaccgtacctgtccctggagatgaagtactccgtacatcaaacgccagaagattcttctactccacggaagcttcaatcggcctcacacagtgctggatcagtagccttgccgtgcatgcaaccaggctagctttcacggttccatgagcaattgagcacgcaaaattagcccacgatgctgccatgcttaggatctcaattaccaggtcgcaagaaaaaaatcattctgagtaggcggtttcatgttgtcctggaagtacaaaaacaaaaacagaagagcaaaacgtgtttttcattctccaggagagcaacgatcgatcgagccacggtgtagacaatgtcccaaattaaaagagagttgcgtgacgtcctacgatttttccctggctcccaacaaacgcttgatccgtcattcaatcaattgcgtaatcacgctcgctcgggacctgaagtttgttgcgcgttggcgacgaggcacttgaccagcagcaggccacagcccacaggggcaagtccatgtccatccttcgccgcaaagcagagcaaaaggggagcagcagcagcagccagacagccagccagccaacagacaccgggaccggagagatcgaccgatcgatcgaccaggtcaggcgtggtgtgccccggccgacaagaggctctggctcggttcaccgctcggcaaacgcaagcccgggggcacgggccgccaccggcgcagtcagccaaaacgcacgcagaaacgcgatccaaccaccgcccgatcgaggcgcgcagaaaaggcggagcggatggcgaaacgagagggttacgcactagtacgcgcggctgcgtcctggagcgcgggtcaaccgtacgtgacgccgcactagctagcgagtgctcggctcatcatcacacgcgcccccaccagccaccacccaccacaccgccggtgaatgcgtgtgccacccatcgatcgggcgcgccgtctgccgttcacatccaccgcaccgcgagggccgcggctgacctgagcttaacgcctctcggggtgaggattatgcgcattaggcaagcttgttcccgaagcgacaggcaggtagcggacggcagcgtcctgggcgggccagtggtgccgaaatgcaagccatgattgcacacttcttgcgggtttctattgctttctggtgtgtgctggaaatgtatgcatgctgatttttatttttcgttgccaatgctaggctgcctcctttttatcgataaaggaagagagtttatttctagaaaaaaaaggggacttaagcatattccctcggcaataggtgatctataagcttccatgttctggacttctgaccaggcaccaaaatctgtgatcttcgttttatctttgctactatcacaataggatttataagttaaaagagtcgggcatttcgcacttttcaaatttactagctcaccatttggatcaacgagtgaagcgggctctttgaagctcaagtgtctgtgcaagggacactctcctcttatccaccatgctcattactctctgtgttttatattacaagacgtttaacttttttctagttaattttttctttaaatttaatcaagtttatagaaatgtatagtaatattttcaaaacaaagcaaaaatattatcaaaatatatttaatgctagatttaatgaagctaatttgatattttaaattttattgattttttctactaacttagttaaacttaataaaatttgaatatgaaaaaaattcaaacgacatataatattatgacagagggagtatgtcccgttgatctattcttaggtttactagcgcccacatcgctatcatcctccaaattctctgggagaaccgagtctcttccattctcatcctccaaaacagttgggagaagaagaagaaaagccttgattgtttgatcgtggttttatgagctgtgaaaaagctaacctacgcaataatgataatttatatacaaaattatattttaagcaaagaaagccaatgcagaaaaaataaatgaaagaaatcaacttaaatttaagttatacggggtaaaagtctaacttttgctgcaactgataatacgacaagcagatttccatgggaggcgtcattaaaaggacttactgctagcattttacataatcaaattgcgctccctccttccaaataaattactatgagaataggcttatttcatattttggttttttcaaataagttggccatatttgtagtttccatgtacttaagatttaaatgaaaagataaattaaatgtttaatcaaaacatgagaaatcatcttaatattcattggttgcatgcgtatatatgctatttaatttttgttatatgaaagatagattatttttttccttaatcctcagtataaaaataatatgtctaacccttttgatggggggagtactttgcaagtacggttgtggagagaacatatgcaggttgactttttacatattgcttgcacgaagagggttgacttggcaactgcccagtggcatggctcttttgctcttttgacatcatgattattagtactagtagtattcatagaacatactccttccgttctaaaaaagataaatctttggtttccgtgtccaacgtttaactgtcagtcttatatgaaatttttttataattagtattttcattgttgttagatgataaaacataattaatactttatgcgtgacttatctttttaattttttttataattttttttaaataagacatacggttaaacgttgtatacgaaaacccaggttttgattaatactttatacgtgacttatctttttatttttttatttttttttgatggagggagtagagtccgatagaaaaggcgaaatacgttgaaaacaaggagccgaaggcgaatcaaaactctgcctgcactgccgctacaattccagtgatgatgcaaagctcacgttagattagcaggagtaacattcaaaaaattatatatttttctaccggctccactggataatactactatatgatccagggctaattcaaacagagagaaaaatattagcacagcaattgaaaagtccaaccttctattttaattaacagaaagtgtaacgggtgatcttaacaagagtgagccacatctcccaaataatatatttgcttagtgaagtaggagtactagctactggtttgatgttgtttattagcagcaactcctgtactttggtatgttgatggtaccatgagcaaaaacaaaaggatgaatcctaccaaagagctggaagattggagtatataaagttaaacaaacaaataacttgttgcaccaggagaaagtaagaaaataatgcatgcaactaaagagctggagagagtgggacagcatgtaaagcacaaaatgtagcatcggagtgaatttctattcacaactttgcagttgcatgttataatttgtaccgaaaccttaagaggaatctatcaaaacacaaaatgttgcagtattaagctagctaggagaatccaaacactaaacagtgcatgttaacagttaacacgtcataatcagccaccagtcacaacactgcccacacgaatacaacatcatcatcatcacatatgcacatcgtgggcagcccacaagtcgccagcaagacctgaaatgacctgaaatgaatacaaagaatcataccaaatcatctaaatcgatatcaactttcgtataatcgaaggaaattatgctcgctaataacaggacgtactcataacgaatactatgtttgtttgtgtacatcttccaccgtgccatcaagaaaacgaatactacaatctcatgatgtttgtctattgtcacggtagtcaaggcctcaaatcagaatgtagttatcgcaatgattccactctctaacactgattaattgatttgaaagggatgaattaaagtggttgcatcgtgtcatgctagtagaggaatgcatgttctttcccccccccatcaagtttttctaagatttagcagcgtatttttggcctgtgcgcaccgtgttgcacagagcgcttcaaatatgttgttttttccccatctgtacgtggtaactgtgcaaaaaatggaatgagcagatactattaacttcggtatgcacaaagaggttgagaccatttaattagtatggtttggtgcaccagaaaagggagtaatggaggcagaggcagccatcgcccataaatacgctgcctgcctccatgtgaaagctctgaccaaatgaattgaattgatgctatttcatggagtattcatagaccattggatcagattcagaattcatttcagacacaaaacaatcaagaaccttcttttaatccctgtgcacaaagccacatacactcctatccccctctactcagatccctctcactcataaatccagcatttaatcctgtgtacaaacgacctgtaccgtgcagtccatgcacatcaacaagtccactcattcttaaacccaagcatcaaagaaaaaaaaaagaaactaaggttaattaacaattttgcaaatcaagattagacaactagctgtacaaacaaacaagcagctcttacagtaatggtcggctgacgagcagtagtaacctatatgtcaacgaagtggtttggagttgggagtataaaatcttatagagacttttcatggatggacaaaatgcgagtaagaaaggagaagaaaaatctaaaaaggatggtaattgggattaggtggtgataagcggtgaagagaagatgaaaaaggtgaaaaagaaaacgtgaaaagatcaccggaagcgtccgccgtcggcgagcttcctggagcggcaccgagtaatggaggcggcggaggagaggttgtggagcggcgatggccgtagctcgcaggagaaggtgcctgggtcgggcggatgggcgtggcggtggcggcgcccggggctgggccgcacgagagggctgaggcagacggcgaagcccgatggcatggtgctggtttggcgccgccggcatggggtcctccgcatcggtgaaggagatggctgccatgggggatcagtcggcgagctgctctcctcgtcgctgccgtcgcagtcccgctccggcgagagcccacggttgctgaccacgcggcaggagcgcctaggcgggggcgacgaggcggctgcggctgcggctggcgctggcggctgcttcttgcggcggcgcggcatgaacccggcgagccaagaacggtttctgctctccctgttgtcgcctcccttgtccttctcctccgatctgtgatggtggtggtggtggccgaagagcgtggcgatgacggagaacttccccgcgcgccgcttctcgtacccgatgtccccctcctcgagcccgccgctgctgccgtaggcggggccgacctgcggcgtccggaagaagaggaggctgggatgatgcttaagcgcgccgccgcccgaggaatccgacttcctgcgggacacgtacggcgacaccgacctcgggaacgccggcgccgccgcggccggtggcgcagccggaggaggaggcgacgacgacgccccgttctgcgcggcggcgagcgcgagcaggcggtcgttgaggcacgtggcgcagacgccgccgcccgcctggtacgggtgcttcttgcacctcatccccatctcatcgactcatctcgccgccgtcgccgccgccgccgccgcgcgctccggccacgaggaaggagcaatctacaacggcgcacgcgcacctgccttccttcttccccttcccttcccttgaaatttgggcgagttttttaaaacggagattggtgcgcgttttggcgaggggatttttttttcctcttttttttcggtccgcgacgctgcgtccgcgggcttaaataagcttcggcgaaacgaagggcttaccaagtgcaggggggacggagtaaatggtggccttgactacgcttttgggcgaattttggtttgattgcggttgcttttctattcgtgtttgtgagacttgcgagtagagtagaatagtagtagatgcagatgtatagtagtagtactagttgagatagatttggcacgggaccatgcttggatttggttgcggtggtgcggcggctgagcacacatgcacaccgttgagagcgagacatacatgttcgtttttatcggctaatctttgaaaagtgtattttgggtttggcctatctacacgagtcatcttaaagggattccttatcttaattaatccagggagatgctctactgttattgaacaaatgctgccactccactagctagcatcccacaaattgttgcttggccattcggcctacttttcaggttcttcctctctgaagcctataaacccaagccgtggacttcccagacctctcgattctcagccttgcttacggcccttttttccttgtcatgatctggtgtaggtgatttggtttatggttcaaccaaaagcgaagaattgtctcgttaaaccatacgctccagtgtgtcgctgaggtctagacacgtcggtatttatacaccatataatttacagttaattgcacagtgggccacttatgtttaccaaggttgcaacttggactagggagaagaaaatattttcactttgatttagataagtttgcaaaatgattcactttgtaccacttccctctccagctctctcatcactttcttctctacaatctaggaaacttggtgagctcgtgaaggcagcagcacgcggctcaaattcttaatgcatcagatcagcatgagcatgattcaactactaccaatacaggatctgctagctaggtgctcgcttcttgcgttgattatgggaactgggagcctgggagatccttgagcttcacgtcaggtagagggcacggcccggaggagatgctccttggcgatgagcagtaggcgctcgtcgtagcctccgcaaattggggacattccccggtgcagttcaccaaagcatcaactatgcttgctccaatgcttcacgatacgcagtgcatggcagaatgtgtaggtcgagcagagcgcgtacggcaccagcagaaatcgagctcgagcagcaatatatggacggcaacgtactagtggaggcatgcgttcttgaacattttgtgtgtgtatatccttctcatctccttcctccgttgagcctgctctcatctctgcttcctcgtcgaccacaagtagctggccgtgattagggaggagaggagaggaagaacactatttgatattgatgtgtgggccactggttaaaaatgcaaagttcagtaataaaacccggtcaaaagtgaaaagatctgctgatagctggtccaatttacaacttgggtaataaaacctgccctaaagtgcaattcactctataatttatcctcaagtgattacgttgctgactgtgatctctcaggtaaaaaaaaaaaggcccgaccaaaatccattcggagggcgtgaaatcgatagcaaattagcaagtactcgtactatacgtacttaataacgccttgcacgaaccgcatgcaccacacgtataaaccagctcgtcactttctcgggtaatatataatcgcgttccagaagacgtttgcgctcatcctgagccgtactatccattcatccactctcagctttggcacggatgcagtgcaccaaaagttatggaaaagagcaactttcaccgcacttaattagcacagtagaagcttcccgtttacactgatgcttagtcattagtcactcgagaaaggacccggtaaaacagaaagatctcaagacgtacgagcgcgactttgccggtgtcgatcggttttaatttggtcgctgatcgatcacgccgagatggcctctcgccgcgccatgacggagtgggacggagatggactgttcgttcgtctagagaaagagcacagggcgtagctactggtcggttgattgatcgcgcgatcgatggagaccgactcgagagaccgggccggcgcgcgagcgaggaggcaagcgaagcgcgcgcggatgcagccatcgatcggcgaccgcgcgcgcgcgcgtacgcgtcacgtcgcgctcgtggagaagctggcgctgctggcgatggcgctgtccgggtttcttgtgctcgcgccgcgcgggttcgtggaatcacggtgggattgcggcgtcacgagggaaaatatagtgaaaaacgcgcggttgattttgtcgcgggggggaactgtgcaagtgggtagaaagatcagaacggcgacaattctatcgtcttctggagggagaagtgtaaggatacgtccgtttctaacctgttcatggaagtggtcattgtcgagatggattgggattagtccatcctgcttaataataatgtaaaagaagctaacctacttgccattcagcaagcaaccaagtatcacacgcctcggatatattgctagtggtttcattagggtctatatgtttgattttattttttctgatctaaagcatttggctgcgtttgtccaactcacgtcgcaaaggaagctgacgagatagtggaagcgtcatcatcattgcacttaaactactcgtgtctggtttacttgtacactcacgatgaaaattaaggaaagataccgtcaggttcatcgttttcatctcatcgatatatatatatatatatgagatttcggcaatgctgtcgtacgtgtcgtgccgacgccacgcgtcgcagtcgcatctaattcacacagggctgattaacgattgaccaggtagcttcttgctgatcaaataccagaagcgacaggaagggcaacattatcttcttctgcttaatactcttagcttaaacgtcacgactcagcccgatcatctgtagcactatttctgctagtaattaacttttgctttctagtactattaaccatcatgatccgcgcccctttcgcggggtcaagcctgaaagctccacgtacgcgccgccaccgtgtgctagcttttttctctcccactcttccatatgcacctatatatccatttcccccttcacaagggcgccgtgaaaccgatgaatatacgaggacttgtcgtgccatcctgccaaatcgacgtccgccgcgggctcgcgccgcgcgcgggacggacgggacatcgcctcgcgcccgttcgccgcgttgcgcttgcgctttgctcgtgaaacggccgtgcggcagggtgggggcgcgcaggtgcaaagcggcccgtgggcggtgggctctctcgcatcggcaaaaaacgggtggcggctacgtcccttgtcccaggtggcccaactgaacggggagctagttttggacgagaaattgttcgagaggcttgggctcgcgataagatgggccgagacaccagtgctgcaagccggccacagccaggggccaatagcccactactgcggggaccgctaatgcgcgggtccacacccctctcccctatacgtctctctcctcccccttcctcctccccttatccaaattcatttgcacttaataaataccagcttctgccatagtggaacggaggcgcgtcgccatatatatacctcttgtaagccgccgtgcggcgttgtaacctcaccccagatatagtgaagatattttgctggctagcgtccgtggtttttctctcctactttgggagggttttccacgttaaaatctcgtgtcttctgtgattaatctattattctttatcttttgtttgcctatcatttcctaacaccttcttctcttccctactatagtacaccacaaaattattttgaaaaaacaaaagttagaaaaatttatgtaaagaaatattatatataaatatttgaatttaaatttaaatttgaatcaggtatgtaaacttttgacttataaactttggatctataaactttaggtgtataaactttagatgtatagaaatactatatattagaaaacatttgaattcaaattcaaaattaaatcagatataattcaaatttaaatttgaaacgggtatataaactttaggtttataaactttagatgtatagaaatactatatataaaaaatatttgaattcaaattcaaatttgaatcggatatataaacttttgacttataaatttttgctctctacactttagatgtgtaaacttgaggtgtataaactttatatgcataaatttactaaaatagaaaagtaatgtggtgaaaaaaaaagaaaccaggtgaagaaagatggaactgatcgcaaccagttggtcctgtcgatcgatcgcgaatcagcctttccgcactactactagcaatttgcagtttgatggcgctcggcaggcacacgcacaacaggaggactgaacaagtggtggctctctctacttctctagatgaaacgaaaagtttccagctcagtttgtagtgcccatcgtgtcgattggagttcctgccactgtgaagctttttattcgatcgcaactaggacgagtgtcaagctctgattgattgcagcaactaggagtataggacgagtgtcgatatttgattcgattgcaactaggaagtgccagtaacgtgccagcctctgaaccacacgaagctcagttgaatcagtcccaactccagtttcccatgacttggctctagatggttaccgaaaggtcgccagacaaaacttgattattacacactgatgctgtaagtacgtaccttgagagcaaaaaaaagttgcaactactcctgattcctgaaggatacgtaagtggtgacaacttgtgctcaaaccatgggtcaaatggatccaaaactgcttcgttaatagcacttggttgaagaaacatgcttatatactccatggtccccttcaataatggtaaaatgaggtccccacatcctcggatatgtatcaccatcgtcgataaagaattgaggctcaagatcatatgcctatgataatggcacattccatcaatcccgaaagcaaggagggcccctgttcattagtatgctacaaactgactgactagccaaataaatacaaattatcttttcagtcttaaaaatgtgcaatgggcaatgggacattgtagttgatctaagaacattttgataagagttatggatgtatgtactagtcattggttattggttagttcttacacaagtgatatggtataccctctaatattcaggaattcaagatttcaagtcccagtgccgacgtatactttcaacatcatcttctaaggaagaaaaaaagtatgacgagtactaatttaagtcaataatagcttccttagtcaatagagtagttgttaagtccgatgaagttatattgctggataatcaggtgacagtactagcagatcatgcaataatataatccaaagtgaaaaccattcgtatgtaccacctcatctcggttcttttaataacaacttccacatttagaacgtatataagggcataagaactgatcagcagcaaacagaacccaccatatcacaaccacgacttccctttcgagtaagcatactacctgcttatcatttatatgtcaggctcatttgaaaacatttcatttccttgatatagtttgttttaaattttgatgcatttcagttaatcttggaaagtatgcttttcttctatgttatgaaacacacaccgtcttgtggagtttgtgtgactacttgttttctgaaagaatatgctcagactggcatctagcagcatacatgtgttttctgactattttatgttcaaccatatgatacaaatgggaaaaggttcaaggctcaaatgataaaagctttaattactccatcctttgtattgtgagcatctctttaaatacgtagtgcattggatgcatagaatatactctacagataactctcaggaactagttattcttactgtctactctctccgtcctataatataagggattttaagattttgcttgcaacgtttgaccactcgtcttattcaaatttttttaaaattattatttattttatctgtgacttactttattatctacagtactttaagtgtgactttttgttttttatatttgcaaaaaaaatttaaataagacgagtggtcaaacgttgcaaataaaaactcaaaatcccttatattatgggacggagggagtaattatttgaatttgtgccgctcacagatttgaaccctcaaaagataattcaagccgtcagcaaatggggcaaacggtaaaatttggaagagttcctttcaaggttggcttctcacattcacagtcccgcccaaaggtgagcctttttgttcttttcaatgtcacgataaactcattcaaacagaaatacaattacagagacatcataatcaaaattcctggaatagttactgcttttaattagttcattggtcgatgataagagagatttaaagaaatataagcacgtaaggtagataatttactaatttaatgtaaatgattgatcatgcttcacagcaggaccgatggcaaggaaaatcgagcgagcaaagaagcatcgaatcatacaacaaaattccagaatttccaaattgtcacaagctagaggaaccagaggacaatcaacaaacagcactgcttctatctggatcccagaacctgtcttcccccgatatttttcagctgctatctgtggatgtatgtataccaacacaacttaattactctactatgcatttaacttttcaagaatcatttaacttaaagtacaggccatagtcatcctaactatttgtttgggatcattcatgctgatttagaccgattcagaaactgaataaatttttgacatatatttcatccattagatataatatacactccataataccagtgtactttaattaacagaacattatgcactaaagtactaatgatgtgcattatactgtacacatttcagtttgtatcatacctttaaaaatacatattgctgaaacatgtgcgtttcatttatttcaaaagtaactagctgggtggcctgcgcaattgcgcggctagcacccaaacaaaatcatatatttttcagtatgattttacttaagatttattaaatagctatacttgtatttctaattatatagtttttaaaagtcacaccagctgctaccctttacttctgtcatatccttcttttgtttcctcggtctaccactatttctattcattctccttgaaacctctaaaaattggatcttatagttttttgagtttattatctcgttgggtttcgtttttataatttctagaagtcccgtcaaacgctgccattatactcatctacgacccgtccattgtcttttctctttattgtcattgggattttacaaatcgaacataataatcgttcgggttcatttttttactttctataagtcccgccaaaccgtcagtggctttgccattgtactcctttatggttcgcccgctgcctcccttctttattgtcattgagattttaaaatgtatcatgattatcattgttttatttttactttttagaagttccgaaactttaaaaattggaccttgtagtttttagagtttattgtcttgttgggtttcattttttataatttttagaagtcccgtcaaacgatgccactatacacctctacagcccatcccccgcctattctttattttcattgggattctaaaatcgaatataactatcgttggaatttattttttattttctaaaagtcccgccaaccgtcggcggctctgcaactatactcctatacaccccgcgcacgctgcttctcctttttattctcattgagattttaaaaatcgaatgtgtttatcaatgttttttttttactttctagaagtcccggcaaccgtcttgcccgtccctccttttaatcatcattaggattctatttgatgttttactaacagtttttatatatcgtatcaactgccaccactattcctaattaaaatctttttttctttttctaatttatttttttaattaataccgtatagtgtttttttaatatttttattttttatcttttgaatttcagttgaactctcttttattttttattctgaattttaattaatctcatattggtttcttatatggattcttctttcactattgcttatttttaattccgaatttcagttgattttaagttgtattcctactttaacttttcttttctttttgctaatttcaatttttttatttttattccgaatattaactaatctcatattgggttcttatatgtactcttctctcaatattctttatttttaattccgaatttcagctatttttaaattgtattcttacttggactctccttttattttataatttcggattttattttatttttattttgaatttgtattaatctcgtattgggttgttatatggaaacttctttcaatatagcttatttttaattccgaatttcagctatttttagattgtatttctacttaaactctccttttctttttttctttttctccgattaatgtgggaatttctagccccccacagcgaacgtggtgtctccttttaaagctgttttaataataaaatagatatatcaaaatagcactattaatgcactatcacactaataataaaaagaaggaccgaacagagtctgactggaatagaattaattcattagatgtgatgtacatccttcatccatacgatctgtccatgggaaaagttgcacaaagtgagctatccatgtgggtttctgtagagtacaactgcatgcttcgggaatggtgcattcgatcagggcaaggatgcccaagggaaacatgaggagaacagcgtacacaatgtcaatcaagagatcaaacaaaccatggatggaatcagggtaaaacaaatacagtgcttacatgtagattatatgaatacagaattgatctaactggaaattctttccctactgcatgattttaatttcaagactctgctctccagtgaaaaggttcctcacacaacatatcagaaaatcaagactaggcacaaaacctgcgtaagaaaatggaatactctacaacattaaaccaagtttttcatgtgtagatgactgtggggggcgtggcagaattcttgaaaagtaaattagcaaacatggtacagaggggatgtggaaggaagagagaggacataagactccaaacagctcagatgcatgcagctctctcagttgcaagactagctacagcagttgcacgaatggttggtaattgccaatctgagtctaccaatgcaaacaacactatcatgactgccatagggaaagatgaacatagaaaaatgcatgttgcaattgcatctgccgcagcactggtggcagcctcatgctctgaggctgcaaagttaactggagctagcagagaacagatttcgacagtcattcacatgggcatggaaactaggtcgctaggggatttgctcatgctgactaccagcgcggcgacctgtaagaccaagaatagaaccagctcatatttctctatatattgtatactaagttacttgcatgaaacttggttcttttgctgcaggcttaaaaggagctaatgcctttaagatgcggaacagggcaataagcaattatgcctttgagaatctcatgagtaaccagaaagatgtccgacttcctattcgaacacctgatggtataatgcccaattaactcatcaatgacatgccacattcaattagattacttcattttccagggatacaagatgaatgcgaaaaaaaaaacactttcatttgtgtattcatgcagggaagatccatatcaggatggtttctgtgcactgcaagcatgacaagataatattgaacttaggaaaggagcatagtttgagaaccagtaaagaatgtgagcctcattttactatcctctttcttaagtgcaggaccattcaccataggcagtgcaaatctgaggtcttacctttgcttttaatatgtagctgtgctaaattgatttatccaattgtttaatcacccactttcttccagacataatttttgatgaacatggtgggacaacagacttcagctacccaacagatgaacatagctaccatgcaataaacctcgcaacatctggtggaaacatacagttattatttgaagaacatgaacaatacagcgcttggaagtcattcatcagatacctgataatcaacaagagatcaaggctatcctactgatacatgatgtacgaaaattcgacaatcagtagggactcatgctctacattccttacaaacccacacatttcttacgtgaacaataccaatgatcaacatcatgttatgggaagcaccatttgtgtggtggtggaacacatgactccatccacaaatatgattgtgtgtatccttagttggtgcagatcccggaagttatacttcctttgtccaaataaataaataataataatgtaatagaacttagtaatagttattccaccaaaatgcagtttattactaagatgtttggttgaatgatgagatccatcccctgaattatcatctcaacgtatttatgtatattttaagatcacagctagctggcaaaattcaactcagtaaacctgaactgagatgatcagacgggttccaaggccctacccctgccattctcacatattccattagcattaacatcacagcagtctttttacacatttgacaggacaattttggtgtgtttccaacttcagaactaaaaaaggcatgaattatttttgaaaggaagagtttctgtatttatttgaaacataagtatatttttgaaataagtatgtctgatttctatactttttagtggaagcaatagataaaacaattgcattcgctgtaaaccaccaacccatgagcaaaatcgtaagaaaaacaagcaattctacaagcagaataacatcacaagaccgacattaagaaggcaatagcacaaaaaaaaatcctacttacattttaatcaacgttgtaagctgaacttgcctaaacaaatataatgccgtgctccttaatggtgtcgatgacgatgccaagcttcccctcgatcctctcgttcttcttgggctcgtaggacatggcgaagacgtcggcgtccatggacctctcggcgatgaggcggccgatggtcctgcaggcgttgtcgtcgacgagggagggcagcgtggtcctgaggtccttggcgttggtgctggcgacggagatgaccttgctggtgcccctgtgcacgaccttggcgtggacgaagcgcttggagaagaagacgttgagcaggaacggccgcatgtacatgtccgtgcgctgcttccacgacttgcggttgggcctctcctccgcctccttccgcgaccgccgcgtccacgccgcgcgcaccaccagggacgcgcggttgctgggcacgggcggcggcgagagcgcgaggtgggcgatggaggcggaccacgagagcggcggcgacggccggagagagggcggaggtgcgcggcgcggggggagagtggcggcggtggggtacgcggcggcggcggccatgggagcgtgggggtttagacgaggtcgccttatcctgtacttacaccaattcttttaagagtaaatggcatatagggccacttctttttaccaatgtggtaagagtaaaagactaggaagtaggaacagccgagcagcccaacactttaaatttgaacccaaaaagattacatataagttttactttgggcaatttgcttcttccctatctttccctctcttccttgctctctgtcttcttgagcttgttgggttggtgtgaaagctcaaacagacagtaacatagagcctatggagtaccgccctccgtcgcactgctcgcatctcgtcaatttgctcctacaccacatagtccccaagctagagcagctctgcgcttgcgtcgattggaggcggccatctctacggtttatggtcgacgatgagcaggcctaggtccatccttcgttcattataggttaatagcattaggagggacatagcttgctcacgagctcattagtggtgatgagtgtggaagcgtaagcgtggatctggaagaagtgagtttcagtacgtttgaggacatggagaggagctcatcaagtggctaatgtatcaattagttccaatttgcaataaattgtaagtccatccggttcaaagtgaaaatatgagatgagatgagatctagttcattatacaactttggtaaagaaatcatgtccaaattacaattaactctttttttaattgcagaaaaagcatcataactatggcgaagcgatggcagttgagatattcaaatttgtcaagagtgtcagagtgacaacatgcagttttacaaattttcattaaaaaaatatagatcaaaggtacatgttatgaaatgcttttaccaaatttatcattatcctgccgcggattataatagcgtacattgtaaatgcagagtcatatgtgtagcgttatcccttatattaactgacgtaatgggtgcttttatcgtggagtattttacatccttataacaagtttaatagtatagcgaactattagctctaaatcatttatagtcaatctaatagcaggtacaatagcaagctataagccagctataaacatttttaaagagataaagaaagagagaaaagagcagcggactacagatctgtagccagctgcagcacagactccaagacgtaatatgtgtatgacagatgggaccaggtattaatagtatagtaagcaactattgtatgaattggctattacattgactatagatgatttggagctagtactgggctatactattaaacttgctctactatcattcatacaatagttacctataagcatataatacaccaatatatggtctcacccctcatacacataatgtattgaagtctgtgctgcagctgactataaatctgtagctcgctttccttctctctataagcatataatacaccaatatatggtctcacccctcatacacacacaatgtattgaagtctgtgctgcagttgactataaatctgtagctcgctttccttctctttctcttctctcctccagctagacacacaacatattgaagtctgtgctgcagctggctcttctcttctctcctccagctagagacacacaacgtattgaagtccgtgctgcagctggctataaatttgtagcccgctttccttctctctcttttcttctctcctcccgcttttcttctctccactctcttttcttctctcatccccgctttccttctctctcttttcttctctcctcccgctgttcttctctcctccatctagctataaatctttcttctctcctcccactattcttctatcctccactctccactctcttttcttctctcctccccgctttccttctctctcttttcttctctcctcccgctgttcttctctcctccatctggctataaatctttcttctctcctcccactattcttctctcctccagctggctataaatctaaatctttcttctctcctcccactattcttctctcctccagctggctataaatctgctgttcttctctcctccaattggctataaatctatagctctgtagcccgctcttcttcgcttttcttctctcttttcttctctcttctagaaatctgtagctcgctttacttcttctctctcttttctccacatgtgcttacaggtgacttgtagcctgttattgtactcgttcttactccacatgtgcgtgcttacagctaacttgtagcccgttattgtactcgctcttactgatacactccagttcaccccacccagttgcccacaatacaaaagaacaccgatgcacaaaatccataacacgactcaccaaaacattttatacagcgcgtagcatgcatgtacagatgtacctatatgtggtcttacctctcttggataccatggagtcaagacttcaggattacacaaacaaaataatttttcctccagtgaaattagaatatcgaatttcacgagggatttaaccgcgaatgtcatttctaaactcctgattttgatgaccaagtggggacaaccaccacgaaggtaaacatctgaaaaaaattcagtgccaaacaggcaactggtagccaaaaaggctggattgaacgggccaatgagcaacacacgagaaataatgatttgggtggtgccgagggccttcctcttttcccttctctgttggcatctgctaaacaaaatttccaagttacaaagtcttccctcaacataaatgagggaatacaattctacatctaaagagcctacgctaccaatatacatacatgtatagaaagtacccaatgcctccattagtgctaaccaaaccctccaagcttgtaaggtcattgtgaccacatcaagcaaatagcttcgctcccaccaatcgccatcaagcttgcatcaattctgtgtggcgagcgactcaatctgtgtatccttgggctcctaccgttgacaatctaatgtcctctttaaaagaaagggcatgacatccagagcaatatgttcatttgttctcatccgatgtctgtgaaatctgtaagaggatccaactcctcaatgccagaaaggacatcagagtcatactggtacggaacaaactctgtttcagcctcttgaggaagattatcaaagtaggtgaattcagaatcactgatgccaaggtcagatagggactgggtaatgtggaactctgctgagttatgcagaagttgccccggaatcctatgaaaattatttgtaaccggcacttcctgtggttcagtggtcctttgaattttggatttgggaggccttccagattctgatgatgctttgtgctttcctatggacttaggaccagatttatgccgaccggcatcgtatgtgtggaaagcagatgaggcccagtgagaaccttccccttcaaaacaagtttctgataccatcctgtgtaaatgaatgcaatgacacgttaggaagatcagaagcaaaaataaataaataaaaaatgcaaagcagaactgtatcatcatgaagaggatttttccggtgctaataaccactagctccaataaatacacaaaatatctgtgtcaacaattacctgaatctgttctcagcatgtctataagaaagtgtggacagtagtgagtgctccactggctccacagcatgttttaatggttccggttctagtatggacacgttaacaacagatggaaagtccgcctcataatcatctcgatctgtcaagaaatccaattccaattccaaaaagttacggcgggactcatgattgcttgttggaactaccattcttggacattgaacctgagcatctgcgagggctgtccttactagattaaagtttggtctgaagtttgtcatggaccagttctcgctgagtctgccaggtttctggagtgtgttagagtaactcataacacagtgggactcacaggcagacttcgatctccaaacagatgaaagaacagccatgaaatgtttctggagaagcaattcattgttaggaagctcgctgattacattgagcaacatctgagtttgatcctggaaaataagtcataaaaaatcaagttgtgcacacaataagttgaatataaatagtagatttgtttaaagcccacatatccaaaaaaaa

SEQ ID NO: 79615 - DNA, 41320 bp, Oryza sativa
atcggcgcagcagagcacccgcgcctccgccgcatcggccgtcggccgccacgcgctcgcccgcctgctccagccgctctccgctgccgccaccccgctccactccgcctccgtcgccgctctgctccgcttcgccagatgcgttccgctttgccggccgcgcgctcaccgcctcgctgcttcggacgcgcgcttgcccgacgccgttgccacccgctccactccggtggtcgccgcgcgctcgcccacctgctccggccgctctcggtttccgctacccgctccacaccgccgccgctgtcgccgctccgccaaccgcgctctctcgccgctgccgttccactttgccggccatgctctcgccgccgcgctgctccggacgcacactcccccgccatcgccgccacccggctccactctagcggtcgccgcgcgctcgcccgcctgttccagccgctcatggccgcccgctgtcgctccccctctatggcaaagataagaacgaaaagaggagagaggaaagaaaagagaaaagaggagaagatttagaaaaagaagatatgcgggtcccatatttttttttccttttcacttacatgtgggctccataacttttttattttttattttgttgactagaatgccacgtcagcgaaaccaaccatatatactgccatgggacaaactttgaatggtttgagtaagtttaggggtatacctttctggttttgtagttaaaggactaaaaaaatctcgtggttaagttgggggacctctggtgaacttattcccaaaaattaagcccagtcaatagtccaaagttccagtcagttaggttgggccgtctgcgcaattgctagcagaaactgagtaaactgggccgtgtaatctgtatgtccattcaaaatcaggcccactatatgttctataccgcagcaagacaatggtaagcgagtagcgacaggaaacgaccactcacgaaccaaaatctcctccactactggacattatccagccgaacattatccctggctactggctagattcttcattcttgatttgtgaataacacatcatcatcctgaacctgcagcatccgtgtctcggtgatagaatggctgcctggatggatggctagctcttcccccaacatgtcacacagccgatcagttcctgcatcgatcccgaatatgatgccaaaagcaaaaaccgtccttcagcattagcatcccccctgcaacatgctcgtgagcacggcatgtgttttgatgtcaacttaccacggcatccgtccgctagcgctagtatttatacgcctagttagtctccgcgatcttctccgatatatcgtgcacatccatatccacgcgcacacgcagccggctggaaggaagaaaaaatgctgcggttctggaggacgcagaggagcgtcacgtcgtcagacgccttgtctgtgagtaaaacatgtaaatgcaccgtcagaaggagatggagtactatacattttccatatgcatttctgagtgctgtttgtgtatgtgtgcctaagatcgtggagatgaacgtccacatggactgcgagggctgcgagaagcgcgtgaggaaggccatgtcccggctcgaaggtgccagtactgtttcgtgtgtgtaaagtatactccagtacgtgtgtgtttcgtgtgtaaaatgcgtgcgtgcgtgcaggcgtgagcacggtggagatcgacatggacacgcagaaggtgacggtgacggggtacgtggaccggcgggaggtgctccgggcggcgcggcggacggggagggcggcggagttctggccgtggccgtacgacggcgagtactacccgttcgcgatccagtacctggaggacgacacctacatggcgacgcacaagtactacgtccacggctacaacgccccggtgatcggctcctaccccaaccacgccttcacccacatcgtcgacgaccacgccctcgccttcttccacgacgacaacgtccacgcctgctccatcatgtgacctaaaatataatcttatttaaaatcctacatgccagcgacagatacatatctgaccaaatcgaacaagctaagtgacctaattagtggtgcaaaataagagatgaaaaaccaaatctaacttcgtcgatcatctagtaatggtcaagtagttgctcagcaatccaacgtgcaaagagtgtggtgatatgatagacaaattaacgaataggaattaaggtcgaactaagcttatcaatcgacaagttgttcttaattaattgcactatgcgaccctttttcttatgaacatgaattaaaaggaagggagcagtagaactggattgctaattaacccgctatccttttgaattgactattcgacgggcatctgcatggtatcgatgcttgctgttgacagcacaaggggaagaaaagggtggccctgaaaattttcaactgttgatgctagctagcggctgatctcgctgaggtatctgtgccagtaatttttgtctgcggataggacaacatggagaggatgactaggaaaaggagcactgttcaaactatccaaatgtctccaaccaaaagtgatgacccatccttgcatatgtgcgcatcagtgcatatgttcttatgctggtgtggggtgaagattctggtgtgaggggcaaacggtgacaacggaaaagaaggttcgaatataccctgttccctgattacaaatacagttatgagttctgaccattggattgtatacatatgacaaaaagagagtaaacttcagttcacacatcagaccaaattgagtacaggtgctaccagtatttggctttcgaagatattttacattgggacagcgagaggagtaagttcagttcacacatcagaccaagtttgatgcagctgctcaatgctctgtttgttcgttttgtcagggaatatgggctaacagtgacccaatctggattggattcctatcaataaataaacaaataaatctggattggattgtggaaatgataagaacacgcgtgcaatttgatccactttttatgcgatcaatttgggaggaaatgctctttcgtttcgctctcacaaacctgtgaacaatttccaccctctgaactttcagcattgttcttgtattccccacttcctgaagttcttaattctgtcaccaaacgacttggcatgcagaacaattcagtccctcacgagatacagaacaagaagatatattatcttataccccatgggccaggtaggtacaccagcaacaatgcaaatgccgtcgcatcgcatctcagatacttatgcccactaagcttgaccattatgttaacttggattaggggtaggctagagattgattggggcttatatgataacactacatatacacataaaccacaaaatcaagctatcaacattcctcatctcgttgatgccgacttatatctgccctgatagcgcctaattaacccgtgaacaacgtgtcttttcatcgtccaagtgcccaaccaacacatgacaaaagcaaaacgagtaaataaatttatttagctgccaataaacaaaggaaactggacctgcccgtgtcgaatcaaatgctaataactcgaatctggaacaaaattaacgccaaaaacaacacaaaaaacgactctttttttttctccaaactcgactcggctttgagagttctaatcttagccaggctccaccccaacctgtgctgccctgttcgagcgaagaacgaaagcgacacgagccgtccatataaatccacgccgtcgccgccgaatctcgcgaaaaagctcgcaaatttctactcggggaagaagaagagccctctccaaaggatctcctcgcccggccggcggcgatggcggccgcggcgccgatgccggttgccggagcggggtggtgggatctcgtgaacggctcgacggcgtggcaggacgggatcttcctctccctcgccgctctctacggcctcgtcgccgcatcctccttcgtaagcatctcgccgcagtgctcatctcctcctcctcctcctcctgagtcctcctgactgatactatactctagttatgcttatgcgaaagcactgggggaaagattctttcagaattttgtgtcaagatggattaaggggtaaaaggaataacaatacacgtactccaactgggttggtgacttgagttcatggcaggagaataaagacttgatttttggtgcttgtttgatgggaataccgcagatttgcgatatcaccatcagcgagtttaattgggaataaagacggttttgtattagctttgtgctttgagcataccagtgttttgcatctgaaacttgtaaaagctgataatgaggacgaatattttacagaactttagatcaatcaatatgaaaaacctgcgatttgaaatagagatagctggacaaggacttgtgattatctgccatgcttatctttctgatatccggaaatcctgctggatgcctggatagacagtacaaaggacaataatgtgtatttatgccttggtatctgaataatgagtagttactacattagtgtgggaagtatgaactgcagatccagttcctatgcttacagatatggtgcacatgtgaatgctcgctgttaaatgattaaatttacttgaggaagacaaggcatacttaattacttatcatgtgatatgcagatccaagttgttaggatacagtacagagttcctgaatatggatggacaacacaaaaggtctttcaattacttaatttcattgtgaatggaggtatttgttcaatttcacttgtagtacaagttacatgctcaactccctttgtgcttttgagtttaatgtgatttcaatctgcagcgaggtgttctatctttgcagtccgccgccaagtccaacaagtgaaccctgaggtctggacatctttgctattttctgtcttgtaattgttatgtttcacccaattggccagagttatattcttcattcatttttattccagatctttcagcatgttattcttgatcttccggggcttgcattcttcacaacgtatgcaatgttggcacttttctgggctgagatatcttatcaagcacgtggtctagagactgaagggcttagatcaggtttctacactattaatggtgtaatatatgtgatacaggtaaagcaagttatctctaaaagtctgtattgattagtgattgctatttatcagattttgtataattccgttagcattgcaataatcaatagtacaccctattgcacaagttgcggtgatcagatattttctttggaactgtgaatttcaagaaatttgttatagaccatgaaaagctgtgatgcgcttatccatttttccctgaaaagaaaagatatactgttgctagtatgcactgatgtgaaacaatgagatactggatgaaagtagaagggaataactttagctgttattgtgccacttatcttgtgatggttcagtgcttgcttagtataaaacttccgctaggctgcgtatctcaaaatactcactcaagtttatttcttcaggttctgctgtgggcgttgttgtggcacaatccaaacccatctatgatagtcctttcgaagttgttcattgcaggcctatccttttctgcagccttgggttttctgctatatggagggaggtaggactaagagtattactgaatgactcttaaccaagtttcatcaatcatagacagccaaattggctggctagactagctgcaaactatgtaaccttgaaccatttagtctactaataacttatacgtagaacagtatttcaagaaaatgtccacttattcagtgcttcatctagcatttgacattaacattcatttgccctgttttgattggcaggcttttcttcatgctgaagcgttttcctattgagtcaaaagggaggcagaaaaaactgagggaagttgggagagttgccactatatgcttcctttgtttcttggcacgatgcattatggtaaggttttcagttctctgatccttggatgagtttttgagtttcagtgttccatttcttacttgagcggttttgacactgcccaatttgttttgcagatgtgctttgatgcatttgacaaaaaagctgaccttgatgtgcttgaccatccaattcttaatttcatctattacctggtacgcatgaatcctgcgaccatattgtttacctcagtgaaatcaactttttttccccgttatcagttctagctagaaattgatttccattatcaataccagctaaatatattctgtacttgttcttatcccctgtttggctgtacttgcagatcgttgaaattcttccttcatctcttgtcctgtttattctgaggagaatcccttcgaagctacggctcgcccagtatcatcccctcaacagtggctaggggatgaaaacggatgaaaacatgaaagctaaaaatatggagaggcctgcaaagtgacacggctgcaagcccaggacatgaaaaaaaaggatgacccatggtctaaaatctctaacccttgttcaaaatgtgtatagatagggatctgaaatctgaagttttcccacaaccttcacctcctgtagctaaccttggtggttcaaggtgctgatgatttcgtgtaaccaattgttcctttgtaacaatggaagcaagtgtcctcgctcttttgagcgagcaagccaatgtttgtcttgaaaaattcttgggtaatccattggtaattgcttactactgataatatccgctttgctaattgctagcacaactcgaatgtgctggatcaaatggtaatccagacatccagtatcaacgaaatttttgaagttttgcagagtagcagcgtgatgcagaggtttctaccaactccgcttcgtcagaagcgaacgccgccacctaccaaacgcatgaatcatacgaaatttcaaaattgaagtcttgaccctaccaaactccgccattcttctgttctggtctgcaaatatttttttctctttttttttttcgataactactcgaggcttggaaatctccgagccgcgagcaaaccctagccgccgccatggccttcctcgccgctgcctcgacccgcgcgccgttcgccgtcgcggcgtcctcctcccggcgccgcaccgtcctcgccgcggccgtcaaggccaccggcggctccaacccggccgccccgcaccccgtcctctcctccctccgcctcgccgcctccgccgccgtcatcctcgccgccacctccccggcggccatcgcgtgcaccccggcaccgccccctcctcccccggaggtaaccgtcgcggcctcgcccgacgatcccgtcaccgacgacccccaccccttcgagaagctaatcgtcgagaccgccgcgctcgccagcttcggcggcgcggaggccgcgcgggcccgcctctccgccgccgccgccgccgccgccggagtcgtcggcggccgcgagcaatacgcccgcctcctcgccgcgcaggagctcttcgtggacggcaaggtggacgacgcgatcgccgccttcgaggagctcgcccgggaggaccccggcgactaccgccccgtgttctgccaatgcgtgctctactccgttctgggcagggccgccgagtcggaatcgatgctccggcgctgccgcgagctcgccggcgaagaatccgtcgccgatttcgtaatgccggtctcgccgttgccggtcgattcgtcggaggcggaagcggagccggattcgccggaggcagagacggagaagctgtgaccggaatggccggtgtcacggttggaataaaggtattcacttgactcgcgatacaaatgtagggagatattaaatggcgatgatttgataatttttcatgcaattttagatttcaaatactacatgattttacatgtcctccaaataaaatgaagcgatcatgagaatttgatcgtattgataaaacagtttccacgatgatcgcattgcttagaattgagtcatttgcaggaatatcttatttattcctcaatcctgatggtggttaatccaccgtcgcagtgaaatttgttggaatcgaccgatcaactaagctcatcttcactctttgctcgtctctggactctggtagctgatctaagaacgtatacaatcaacatgtatcgcagcgacaaatgatcatcgtttcagcactagcaggttaggcagagcagccacaaatttcaagacaacgttgttttacgctgtaggactccatgctaatgccagtgctcaatgctgatacccggtcacattatttgtccccattctgagcgaacacggtgaaatcatgtattgctgctgtctgtgttgatgttgagggaagttatctgtggatcacgtaatgcggctgctagtaacagaaatatctcctagatagcattgttggcctgctggggtaatgacttccaactgatgaatgtacaaatggcatgtaaaatgacggcaaactagccctcgtgctctctaccaggaaaagagagttgtctcttcctacttcccatgggattgtcttgtgctgcatagctatccaggcggtctcaactcttctgcttgctataggaccagatgagttctttctttttgccaaccaaattcaggacgagttgggctgttggagtttggccggagcaaaacacgttacgagattgttgccatgaggtgcaaggtggtctaacgtgcaagcatgtttgcagtcagcaacgtacaatttttcatttttttttcttcagcttttgatgtgtgcttaatctccttctattaatataacgccaagcaacctgtttggccctttgaaaaaaaaaaaaacacactgacgagacaacgactcaataaccatccctggtagttagaaactcgacttgctttgctggtaaaaggagcattcaacataaaaaagacaaccatttattatgccattcaaatacttcttatcttgattttgaaacatcagttgcatcaccaaacataaataaaaacacaatatttggttttcccgggcttcaccgtggtcaaagaaataacttggcccatgttagcaatcccgagcaacgttttggccgatcgagcaagttgccatggcaacgaagccatgcatgcaacacaagatgcagagaaagaaaaccagacgaaaataaagttgctaatgcatctgcataagcatgacacacttgaggacttgaacaattgacccacgacctcgatcaatcaatactggcggtggcggatcagcgacatccgggagcctcgcagcttctcctccacgacgtcgtcgagcctccgcgccatctccggcgacatgtgctccttccagtctccgacctcacccttcctgaagaaggccgagttcttgaacgacgaccaggtagccccgtgctcgccgtctcgatttgcctccacgtttctcatcctttccatactgcagagctccacgatagtttcggggacgccaccggcaagctcctcgccggtgaacgggcagccgaggaagccggcgagccgcctcacgctccccacgccgtcctccttgaggctctcgtaccggaggaacacgacctcctccggccgcgccaggctctccttccagtactcggcggcgtggtcccacataggcccgtacggcgagacgccgtcgcagagcagctcgaaggcctcgtcgaacggcgtcatggtggatccctctggtttgatctcgtcgaggtaatgccggagcgagacgaacgcgtccttggggtcgcggcacaggtagacgacgcggcacccggacgccttgaccgacgcgggcaggctcgagagcggttcgtgcactgccaggatgcgcggcgacggcatggcatcgaggcgatggcctggcgcgacgcggcagctgcggctgatctcgtagatggagtgcaggaatggcacgaggtcgtgcgggctggagtggaggagcgggtgctgcccggcggccggcgcgtggcggccgcggtgcacgacgcagaaggcgagcgccttgagccacgtcgagccggacttgggcatggtggcgaggatgacgtcgctggggcgggccacgaacgtgtcccgcgcggccagcgtcgccggcatcaggtgcgccgggtaccagaatccgccgtacctgcggtacggggcgctcccgagaccatggcaagacggtagggaggacgcgagcgcctcgtacttggcgagggcgttgcaccagccttccccgtcgccggcgctcatgtcgtcgcctgcgcctgcgcgcggcgagagcaggtgctcggtcactccggcggtggccatggcattcctgggtcttggaggaccaacgcctctatctatagatggccatgcatgccaatctgtatttactactccctccatcctaaaatatttgacgccgttgaccttttttaaaaatatttgaccgttcgtcttattaaaaaaatttaagtaattattaattcttttcctatcatttgatttattgttaaatatacttttatatatacatatagttttacatatttcacaaaagtttttgaataagacgaacggtcaaatatgtttaaaaaagtcaatggtgtcaaacatttagggaagtaggaagtacaaaatagtactccatccattccaaattgatctacatatttcataggtacatcaagactaagaaaaactaataattctctcatactatatttactctagcaacaaacttaatacatgcatcatccccactatttcctagccaatagcaaatcaatatattgcatgtgggttataaatacatgtgtgcatggatgcatgcatcaatgtctatttactccaatgcagaaataacgaatagacctaataaatgaacacaaatatgcagatcaatttgaaacggatggagtaattaactgggggtgcagaacttgtgcgtgttaaaaaattattgcaagatacacatcaaaaggtacgattatcaatctttttgcactaatgcgccatcgcctatttgactcttccagtctaccgacacttgttaataactagtgccaaatctctacttgcctctccaaatctgcatacaaaataaaacaggtgccaagcctaatatactactctttgtacgactgattgaatcatttccaatgccacggccacgccagcatgaggtttttttttagccatagtgtagtattttactagactagaaccaatctgatgagggtacaagatgtttgctgatcgacttgcacaaaagttggtgcctcttgtccgcctaaaccaagttgcaaattctgaccatacttttcaaattatttctatccagctagcagagtttctacttcgaaattctaacgcatggagagagtaagatacttcgcaaatcatggatagaatcatagagagccatgcctttcatcatatcaatatctcatcagaacttcagtacatatggttgagaactatattggatacatgcatatagctactagtatatatatgctttagttgaaagattccacatccgggagcagttcgatgacacaccggcgagtagaggatggattctaatctctcgggtggacgtccacccgtttcttacatgtcacctaaatgattatgaaaaaaatcaaaaaaaaattacaaggtaggttaatatataatatatcacttcacaaacatgtaagttcaaatttgacttttacgagtctatttcgccttcagtagtctatttcgccttggatttctggaaagagtaacggcggttagttactgtaaggaacggttactgctcaagcctcaaggccttagccaaacacagaattcagaaaggcgttaagctagctttctttcgcattaactaattaatttcactgcccaaatatgctgcatgatatgaaagagcacggaagaggacacgatcaaatggtaaagaaaataaatgtttaaaatgtcaggtttaaacgtaccccaaatcgcgagccgctaagacgcagggagtccatctcgagcaggtcgtcgacttcgtccagctcgatgacggccctaattatcgcattgttgagttctttatcctcgctcgcgttaaagaggcagcctctgttctttgcatcagccactatctcacgccaaatggtctttgctactcgctagagtatttgcattgccaagaatccaaagacagtgcctgcaaaaacaaaaacaacaatggatcaaacaacaaaatcggagtgaaatcaactctctgtgcgactgacgtaattggccgggaggatcgaggcaacctacttggcccgggtcagcgcgacgttggtgcggttgacgttggagaggaacccgaccgatccggtggtgttgctgcgcacggcggagaagatgatgatgtcctcctcggcgccctggaacccgtccacggatcgcaccttcacggtgaagcccccgtgcgtctcgtacgccttcccgagcctctcctggatggcgcggacctgccccttgtacggcgacaccacgcccacgcacagcttcctcccggtgtcaaccgactctgcacaaaccaagctatctgagctcagcgatgccatgccagaatgcaagggcatgatgcaatgtgtacctttgaacaatctctgaacgatccgggtcacggcggcgacctcgatggggttcatgaggctcttgtcgtgcttgcccttgctctccttgccggcatcgacgttgatgaaggagtaggagccgtacattggcccggcaaggggcttcctctcgtagtccctgtgtaatacgttctcgccgtcagatatcttgttctcgtagaagcttgagaccgggaacttgctgatccctgggtgcatcctgtactgcacatccaggaggtgcttcgggtgtcccagcgaactcagcctctcaaacaggctccttccaaactcagcatcttcacaaacctgtgaagaaacaaacagacaattgttacatagcatagtaatagagattgtgaatgttctactaatagagatggtgagagcttaccctgcttttgacaagtgccggcagctgaaattcatagccgatgagaacggcgtgacgaacgccagggagctggagaggtatcagtgactcgcactccttcagctgtgctgcctcgtcgacgacaaggagatcaaacgggcttgcttctggcaggtagtgcagacgggatgagctagaagctgtgcagagtatgcttttggcgttccggactaggaaatcttctatcgaacgcttgtcgaaaacgttcggaagttcaaagtgatcagataggtgttttagcttctgaagacactgagctctagcatccttcagctctgtactcacactatcttgcacatatgtcacgaagttctgaaacagtgagctgatgctgccatcggggctgagtttgaacagggttttcaggctctgttctgatttgggctccacaagtttaccaaaaaattttagcatgtgcagggcctgggtcatgtaactgaaattctctgcagttgtagctgacctggggagataatcacagaaagtcttgacacaaacattaagatcattctcaagccgtttgtaattacttatgaagtattccttgaactaggaagatagcccgcgcattcgcgcgggcatgtattgtgggctgcatgtttcaaaaacttataagaacataatattaaccgaatagcactgtcacacttcgaagtatgttttctccacaaatattattcgttggtatttgttattttccacaaacgtgttatctaacaacttaaaagtgtttcacattgttgtaatgtaagcaacatgttgttaatcatatggtttaaaaatctttgtggcttttcctaaatatttatggctgaccaatagctagtctccaaaatatgctctaaagtaatttatttcttttacttgttaaatatagttaatttggatttcgactcatgaaagtttactgcaaataatctaatgaggtgcactaataaaaaaatagtttagatggtatagttgtttaaaaatttctatcacgaaatatgttttctatctaactaataagcatgaaaatagggcaatgggagagaaggaaaagaggaggcgaggttgtgctcgtgcatgaggggggagggcgcagacatgcacatgtacggacataacataataggacagctagacaggagggatgggattgggccttttctctttttgtctatctattaagataaatctaatggtaaaaaaataatgagaccatggtaaaaggcatatttcatataaattatgagtatatgtgattttttttaattatttcatattttattaagtcaatttagatgacatgtaaaaaaagtagggatgttgtctcttgacaaaacactatttaatagtcgagtttctaatttttgtttgacattgtagttttaatttacatatgaatgtttctagaataatgtggatgagaggaatggggaggaaggggaaaagatgtttttttatttaaaagtttaatagagatagatttaatgttaaaaataataggtttatcgatttaaatagaaatcattgattaaatgtttcttccgcagtatttgtagtactttttataatttattagatgtgccatgtgatgagctagaaacactataaaggatgtataatggaccattattatataatggatagatctgtatgatattttatggggatctgcttaatgaatctttataatataataagcattatatagtaattatttatatactaagctgctagctagaaaatatggataataaagtgagtaaggagagagggtagatcatttacaatggcatgatatgtattagtatttagttatcatataaaggatatgagtttatatccaaatggtctatttcttatatgtatatacacaccaacacatggcataattgaaatcaaatatattataagaaattataattatttaatattaatattttaatataaaaaatttgctacctataaataaatggagaaaaaagagagaaggtgggggacgtacgtacgtggtttttttttacaagcgtacgtacatagtttggtgtatgtacgtgatggagcggatacgaatgggttttgagattttttttccttgatataagatggatctaatggtgtgaaacgatgggtccaccatgttaagttgtagcgcccgtttcgtcgtggcgcctagtgggaaaactatctcttaaaaatcctaaatgcgaaaattttctccttgtttgttgtccagtgtccgtgccattccagatctcaattccccaatccattgtcgaaatccaaaccctaatctcaaatccgtcccaaatcaaatcctctcgaaaagtctattttgcctccctcgagttcgtgggccaatctcttctccccggcccatttcctcctcagcccaactctcctctcccctccatccttgcccgcacatgtgaggcacgtgcgccgctcgggcgctgagcgagagagagactctctctctctctttcacttctccctccctctctgctctcgttgccacttcccgccgatgccgctcaaatcgccgcgccacccgttgcttcccgcgcgcgcgcgccaaggtggccgaccggcaagtcgccgccgccatcagcgcctgctgcgcctgagcccgcgtctgccgccctgtagccgcgcccttccaaaccgccccaccgtcatcgccgtcgtcatcgacccggccccgctactccgcgcgctagcttccaagggatggaggcagagctcctcctcctgcctcgtcgccctctctccctccttcttttcccaaagaagcaaggggcaagccccctttcttccttcctttttcccttttctcttccaccaccggcgtcatcctccctgtcgctgttttggccgctagccgggacgccagctcgctggcttgaccgcccaaggtcggttttcgaaccgacataaccgcccaataaacccgagcccctcccctaaacccatctccctcgctttcgccttccgccattgtcgcctcgccccgtgccctgttcgtcgtcgcccttcgctgtcgcgtgcgccggaggagccggtgcgcgctaggatcggaaggggactccgggcactcgtcttcttcctcttccccggcccgaggccggagagatcactcccgtgccgtcggcctctcgtcacagcgccccgtctcgtctcggtagaacacctccctgttctccctcctcgctcttcctcctccccttagactcgagcagtagcttgtgtagcctccccgtagctagcctgcgtcgccccgaccgctgccgccgctcgcagtaggctcaccgccgtcaccgccgtgctcggtagtagccgcctgtcgccggccttcctcggcgatgttccgtccaatccgacgctagaaacggattcccggagtcgcgtagatgctctagctcgcccgaatcgatctcccgtcacgccatcgctgatttccccctttctcgccgccggttgctgccgccgcaatccgccgccgtcgagccccctccggcgaatccgagccgttggctcgctccctctcttttccccttgtcattctagtgtacacctcgtcgccctcgtcgtcgcacagcgtcccggagaaaccgtcgcctcccgccgtccattcgcggccggcgccttcgtctttctcccgccggcccgcgtggcagccacgaaggcgccacatcggcgctagctcggccggaacgggtcaagccgaccccggtcagccgctccctccgtccccgctcgcgtgcgcgcggcccacggagagctgagaggctgcgcgtgggccacttgcgcgccgcgtccaccgcaagccacacgcgtgcaccgcacccaccccaaccctagcgccgcgccacatgcacctcactcacggtgagccgagccgccgacaagcgagtcccactcgggaccacgcgaggtggacccggcccaccggttcccctccctctctccccgtgcgtgcctttgggccgccttctcgagcccgccggcccattagctcggccgagccgcgccccttctctcgggccgcaccctagccgcccgagggaagtctgttcctcctccctctttcttttctttttcaaagggtttaattaaatccgtattcctttagaccaaaaatccaataatcttagaaattcaatatcttctcaaccgtacatccgtttgactccgctcaacttccaaaaatcctcaaatctcgagatctacccaatggcacgcttagaggtcaataatagggctttaatttcgctgtttgttgagtcgtctcgttcgcgtgtagcttccgagctcgaagacccagagtgcgcggatttcgaggatcaagcttaagatctcgagcaaggcaagtcacctttgatcatcttgcacctataatttaaatctaagtatttcttttccgcaaataatacatggataggattaacacaagaaatttggccgcggcttgcgagatagcctaccggcccccatcctaattgctgcaattagcctccttgaattattgaacacttaaacctcctttgtcgactgttgtacttcgatgtacgggccttcgggcacgcacgtcggagtcctcccctcaaatttaaaatatccaacgatgggtaaaacttgggttttacaaaagacttggaaaaacccgacgcctgggtcgatgcttgcgaactaaatgaatttccaaaaatcgcagaccgggggacgtgccgggagcacggtttcctgctcttgcacttaaggaccgattcctttggaatttcatctgaacatataacaagtacgaccacatgggtggaatgggacacccctggctgagtaattagctaatcaggggagccttgatgccgggagacaagtggattcgccagggtggtgtcggggaggacccctgggcttcctggcatagtatggtctaggacctaacctgttgttggtctgggacccctctcgtcggcatatggtaaacctgtgtcggctctcgaaatgccttgtcatgaaagccttaaggtcaccagacgtggctgttctccatgggctgggtgatccgggttagtaatgtcgtgtgggtaaagtgtgccccctctgcagaggttattaaactgttcgaacagccgtgcccacggtcatgggccgatgtaaggtgattccttagtgtagttttgttcgactagtgcttggtgaaattgctgttgggaatttgggttcgatgtttggaacatctgtagctgacgggatcagctaggcccgggtggccatttgaaagttgtggccgggtgccaatcttgaatcaatcaaagactgatacattgcacatactctgaccggacgagatgtactgtctcatccgtgtcgtttgagaagcactcacttagttgttttaaaaatgagtttaactaaaaatcaattgtaaaaacaacagcctttcctttgaagccttcattaaacacataattcccatgacttgctaagtactcctgtattcacccttgctctatataaataatccccccagtggctgaagaagatgagatggaccccgctgacgaggagttcttcaggagcaagtcggctatgatgagttttggggtttcgatctggttcccaagtcgcgcctgtgatgttaggttcaagtcttggcttctgctttcctcttttgtaatgcagttgtgagctcggggtctgtccgcagcccaacatgactgtactcctactctataataaagagacctctgttgctgtgatattctgtcttcctgtgataccagctctatttcctgggattggtatcggttaacaggttaatttggagcgtcacaggctggttccgttcggggctagttcggggcgtgacataagtgaaaactgatggttggatttttattttttcctcataatttctataatttgttagagtgccacatgacgatataggagtgttcgtaggagccacatggcggtttaggagcgtttgtaggaagtttaatggacttttagtatataatagatagatggcattattggtatgaccttaggaacatcctcctttacctgctttttatcattctccttgttcttgtttttgttccttttcttctcagcaagatcctcttctatctccctttcaatttgctccacatatgaatcatactgaaccagaggttgctcaagaatccgtatcatggagctcagactgtgcacccaccctgaacctggactcaggcacttctgcagtcggcgagcgcgcttctccaagaagatctttgtcaggtttccgtccacgttcatccgatcctcatttccgaacagcacaacatcactcaaaaaacaggcttttccactgccagcagaaggatcctcgaggagattgaggacccgagatgcgacctcgacgacggcggtgttcgtcggagcgcaggtcagtgtcctgtggttcttgaccagcattgcccacaggagcgtgctgatggtcttcgtcttccctgtcccgggaggaccccagatcaggcgcacggaagagctccgctgctgcatcgctgacacacagtctagtactgccaccttttgcgacttgttgagcttgaaatcttcaaggccaccaagtgctctgtccggtagatgtaaaggcagttctgaagaatatgaacattcttggccgacctgccgtaagaattaaagaacatgcataagcaccaaattgcatgcaatggagcagatatattacatggtaatgcatacctttggattgcaatttactatcatccgaatgatgtcagtgttcctgacactagcaaccaccgcatccagttcactccatatgcgattgtacgtcgtcatgttgatcaggaacaccgcgaagagagacgattccaatccaaactgctgctcaacatgcttacttgacagcctgacgacggtgttgccttcagcatcctcggctttgagcaccgaggcaatcaccaagggcttctcaccgcgtcccaggtcagagatgtgcctcggtttccgatccgtcagcaacagtgtatccgcctcctttggggcgtaaacttcctgaaaaatgtccttgggatcagctttattggcgaaaaaactgtatatgagctgctcgtctgagcaaagcttaatcctggtcacttcagctgctggcgcatgcttgatgccttccagtgcagagcagagatcagcacgagtctcttcgatcagcggcacggtgaatgatcccatgtactctttcagcgaggagaaaattgtgggtattttcttaacctgcatcaaggcaagatcatccgcgagataatactcagattacagcgagagaacaagctggataatgcgatgtacgctaccattacagtggaagagattgtgtgcaaactgcagttcatgggataaatagttattccctccatttcatattacaggtcatgcaatctttttaagttgagtaaattttacaaaactacacgttttgtagtccaagttgcagaaaaccacaaacattttgacacttggcacttaagtacatatattttgatagtgtagtttcacaaaaccacactatcaatgaatagattcacccgtgagatgacgtgactgtttcatataggacgaggacatgtcatcctattaacagccatcgcacgaaattaataggatgccacgtcttcatcctaaatggaacgaccatttcatctcacgggtgaatccattcatcgatagtgtggttttgtgaaactaaactaccaaaatatatgtacttaaatgccaagtgtcaaaatgtttgtggttttctgcaacttgaaccataaaacatgtagttttgtgaaatttattcttttaagtttgatcaaacttatactacctccaacacaaaacatatatactaataaaatatatttaatgttgtatttaatgaaactaatttgatgtaaaagatgttaaatttttatataaatttgatcaaacctaaaaaggtttacttataataagaaacggaggaagtaacaatctactgcttggttacctttttcttgagtaagtctttgttgagcacatctttgagggaccaagagaacatctgcttctccaactcgctctgcgaccacgaactgtacctgccatcttttgcccttgcggatctcgtccccgccccctgctgcaccagcacgacgtcgtcgtcgtcgctgtcgtagtagtagctcatcgctaccagcacgacgtcgtcgtccgtccggcgagcgaaaacgtttctggctccggttggaagctttgcaagtgtaggtgatgatctgattctactttctaggctgcagcaatgcgtcgaggatttgtagaggcacaagaccggtgggattccgtctgcgaattaatgtttgagttggggtgtgtagggtcgatccacccttccgtctctcagtgtgagtgtgtgacccatcgttctgagaagagaagcgcatgcggttgcattcgctagtgaaaaggtgagagggtgtttggtttactaggagcccaacaagtgaaatgcaatttactgattgttcaactgatcgtctgagggttgtttttctttatctattataaaagtttaagatgtttttactagaattttggtacgtcatctgtgtttaaaacggttttagttttatgtttcggtttaatctatatctctacgacaagaaatttccgacttctgtaaaaaagaaagaaaaagaagtccgactcaaaaaaaggtaaataaagaaagaaaagaaagtccaacttaacgagcgattttaaaaagaagcttacatcgtcacttaactagcgattaaaaaaaaagcttccgtcgtcgtcagtaaaaaaaaacatctcttgactatgtagaaaaaggaaaaaaaatctcccagtaaaaaacaaaaatgttcgtttggtttttttggcaccgatatttttttccttttttctttgcacgcaaaagagttttttatatgcacacattaaggtttttggtttttttttcctttttttaatccgatctattcaccgcgcgcctctcgggtactcttagtttttttggtcaatcttttttatcgccggtttttttctcccatgcgctagctttttgtttttctcatccggttttataatctcatctgttcaccgcacgccttccgaggtgaaccctagcgctacgccaccgccatatcgattgtatgttttctcctccaatttgattgaaaaatcgattcctcactcctctcatcattttctccatgattttccctttgattcggctttaattgtcggatttaatcactgttctacaggtgccgatgatgacggcgatcttccttggtcatttttatccgagttttacgctttgatttttgggtaaaaagagtagatcgagtggattaaaaaccctcgaccaattttggtttaccaagaaagattcggctggatttgattgggagatttgctctagcaaacgtgtgtgcacaggattatcttcgagaggttgaagatggtaatcacatttgaaagttgaagatggtagggtcggaaaccggtagcaaatacagaaacattaaattataaaaacatatatttaactttacataagtatgttatatgtatacataaattcaaacttatactatataaattataaattaactccattttagtcatgcacaaaagttagagatttgattgaagagtcaatcaatatgtaagctatgggtcaagtagagacatgccctataaatatcgacatatttagaatacggtaattaccatattacaagaaacgataatttccacaagaatacggtaaatacggaaatgatcagtataacagcaaaaccatttctgttttcatttccatattttttaccatttccatttttgtttcggtcgattaccatttccatatggctcggccggtagaaagtcgaaaacgaacgccggtcggccgggaattaccgttaccgttttcacccctaatgtaaggtcatgtaaaggctgtgttcgattgtggggttcccaacccctctcccgcagcacacaaaacgaagcggaagtttagcgtataattaattaaatattagctaatgatctataaaataaattaatatttctatagaatattttataaaaaaaatacatcgtgtagcagtttgaaaaatgtacgcgtgaaaaacaagtaactaaagttggaattcaccaaagaacacagagctagagactaaccaagcactatcatattcccaaattttaatagcatagtaggtggatctaggaaggataaatttgtcttttcctaactcagagcttcagatctatttttgaatttggaactctacgatacaggccctaattcactcatatgtcttgcacttcacattgactttttcacaaagagttaggacctcatcttttcacttatgcttatacttatgagccaaaacttgaattttccaactttaaaattgaagctgatttaaggttttttcatcgaagtttatttttcagcttttacttttagatcactaagaacacatatataaaaattttattcacaaactacttttcatttgcaaatatgccgtttctcttaaaatctacgaataagcgaaatgatgggaccgttaattttctcgttctgtgtgtgtttggtgtcctcaatgtcagcctctcacctttactattctctccgtttcaggttataagacgttttgactttaatcaaagtcaaactgttttaagtttgaccaagtttgtagaaaaaagtagtaacattttcaacccaagataaatttattatgaaaatatattcaattattgatttgatgaaactaatttagtgttatatattactatatttatctataaacttggtttaacttgaaattgactttaaccaaattcaaaacgtcttataatggggtatattatatggcaatgctatagggtggctaaaagctaaaagtttcaaattttatttttctacacacatggcttatgataaattaatggctgttgtttaaacttaattgctcatttggaacgtaggatttgaaaattgtagcaataagaaaattataggattagaataccacgtatggacaaatcctgcaggaattgaaaatataggaatctagcacatatcacgtttggacggttcacaagaatataacgctaggtatctaatggaattaagagagaaaaatagataaagagagaagaacaagcattggacttcttaaaggaaaaaaaaggtttgagctcttggtaaaatttcctatagaattagtgcataggatggtaatccatatgaaactgatatactaaaaaattctgtttcaaacaaaacatatagaaaaaagttcctaagatttaaaatcatttgaatttccttcaatccaaagttgactaaaaacttttaaagaccaaagtatgtcttaaaaatatcaattgcggatgtcagtgtaggatctgccatggagatcgtaaggttccaagcactagtaccgatattgcaaccatatgagcaatcattgagtctccattaattttttctgtcatatactatctctattataaaatatagcaacctctaaaaatacgaatctggacatgaagatttgtagtctaggataggtcttatcccatcgtttaagttgctacattctagaacgaagggaatatctattagaagggggctatagttttgtatagtttgtcggtccgtcttatcctatatacctatacaagtcatccccactaagtgcaattaaaactaattttttgttctgagagtaagccacgtcaccttgattcattccagccatcggattgcacataaacgtttggatagcaatcaatcaatcaactggggatagcaatcaaaataaacatttagcaacaactaattaaagaggcccacctagccatctcttaatttcgaaacatacagttggaataccaacagcaacacatgtagtagcccagcagttataagctctttaatcttccattgaagttattttatctcctgtaaccggtgaatcagatgaacagtcggtcttcatgcctttatatactctctataattcactgggactttgttctcgattgatcatctgtgcttggcagtctttccatgcatctagttgatttatttgcccactcctctgctcatgctgatgcttcaacagatcaacatgcacaatccgctttggtcatctctctcttgcttgcttgctcatggatttatttttctttttcttactaatatcatttgttgtttagttgtagaatctgaagagaagaaaagaagtagtagtttcaaatatttcttaactttctgttctttgtgaaggttgcagatcttatagagagaattgaagggttggtgcattactatattcacataccggttgaaataataagaacaatttttttttcagttggttaaaataaataagaatacctttttgtttcagtaggttattgacatcttcgactgaacttttgaaagtttctacttcattaaaactatagtttggaataagcaattacatagcatctttgtgtaatcacgatgacgtatattgtctaccatttttctgtcttgctacatagcatagaacaatctatgttagttttttttttgtaataatagaacaatctatgttagtaccattcaatttattgcatctgtgttcaattggccttagttctagtaaaaggaattggcctttcactagacaatcagcgtattctgttatgattcaaatttcagttgcttattattataacattggtgaagtgttcagtgtataacaatacaatcattcatacctaattttttatctttatattactcttgtatttccgcagcaacgcgcggggtgtcatctagttagatattcttggatccgctcgtaactgcgtttgaattgatgatggaagtttcaaagtactagtgttatggatcagatcattaacatgtattaacccatattggtacactcgtgcacacacgatgggccctgtcttaaactatgcgaccaggatgtatcaagacaagcagttagcttaaccactaagcttagctttgaactcatcgatggcgatgagaacttcaagtcttcggtcgtcaagtcacactcaagagtctcacgttatacgacagaaaacacgctttcaaacatggaaaacctccatctcccctcgggcactcgaaacacaccaaaaactcccaaattccccctacttcaaacgcgtcgatacccaaagagagaaaaataaagaggggaaattcaaaacctcccccaaaaccctcgccccaccgccgccgcccccgccgccatggacagggcaccgccgcgcggcgccccgcgcgacgccgtcggccagcggtggctcgccgtcttcgtcttccaggccgcgctctcagccgcggcctccgcgctctacctcgccgcgtccccgcgccgccgccacgcccgcctcggcgtgccccggggcctcctcctcgcgctccacccgttcctctccctggccgccacggggctcctcgcgctcgccttcctcgtctccgcgtcgccccacccgcgcgctccccccgtgccgcgccgcgccctcgcggcgtccctcctcgccgccgccggggcgctctgcgtgggcgccgccgcgtcgctggtacccgaggactccgggtgggcggctgttgctgggatggagttccgcggcgctgtgttgggagccgtgttcgccgcgcactatttcgggcgtcggaggtggttgctccagttccccgttgtgcaggtcagtgaagtggggaaaagtagggttctcatctagaatggcgttccgaatcttatcaaattgccaaatggctgtagctcctaatagaggtattgcgactatagagatcggaattttaggtttaaagttagcttgttacgattttagattacctacttaggtatgattgatggtgctggtgattttttgttattgaatctaagcatggatgtttttgataactgtggcttgtattattggtatgttgggtctaagattctttgtgatttgttccgagtttaactggttcccacttcccactagagagcttcatgaattgatcaaatgattagggaatagctgctagcacctctgtaatattcaggttgatatacattggacatacatgtgctattctcagatgagaaatttgattatcatgtttgataagacactatagcgctgttttataattctccagaatatacgatattcagaatccacatgcatgagctgtagtttgctttgatagttattgatagagaagtttttatccatctagatcttttttggggagacatggtttatattgatctaaattatatgtgcaattctctgatatctatagctctgtttggttaatttttttgcccttgcgattttttaggcttgcatgttgtttacttgcaatccttcagcacttcccaccaattttgccaattgtcttacttgctttcttaatttgttttttgtccagcgacctccgttctatggtttgaaaatggggcttctgccatctggaaaaagggctctgaaggtgtcacttcaggccttcttcctttcctttatcttgattttcgttcttcctcagcaattcagaatcagaggatccattggaagccaaattatcgcccaaatcggtatttttataatgagcactgccgttgccttctgttgggaaataagtcatcattttgtccaggtttgttcttcacaatccaacttcaaaggaaaaaagatgttatatgatgtacttgttgtattgcctggaatgcggagattgacgtcatttcctgaaactttatagttcataaccataattcaactgctttcaacaaatttcaggttgtgcatacaagaaggtgcagtttcgctccaccacagagcactgctgctgcagagactaatcctactgagtatatcctagaaacattggaactgagtgatccaagatcactaatgcagtatcttgcataccaagatttgtgtgctgtatctgaatgtaacttagaaccatggcgtcgagcggccttctttgaggaatctggtgagacttacaaaagaattgtgacagcttgtttgaagccgcttgaggagttcacgtcaaaaattgctgaagctcttgaagggttttctagtgagaaaccagaattgttgtcacaacagttcaaacttgctgctgcatttaatgattcacaggtaagttactcatcagtttcttctatctgttttacctcttatgttgtgttcggctgttttcctgtttttttttccaaattgttaatcatgtttgcatttgtgttgatatagaacatgaaatggttcctttgtttaggagttaagaccaaaaacagttggatcttactgtagaatcagttcggtgtttactgtttgttttttgctttgtcactcatgacagattatctagagttgaattaaatgtacgtactataatcttaactgcaccacattggttagtgatacacatacataatgactagatctgcatccaggaagatctgcttgtaaaggttagtatcatagtttgaagtgttcagacttcagacatcttaggagttcattttgagattgatagcttgtgagtgctgatgtctactttatttataaccagtctaatttgtggcaacacatttagttctagtggatgataattggatatttagtgagtgttaactatcatcatgtgagattgtggtctctaaaaaaaattgcccagcactgcaacagacaatagcatatgcactctcctgcagcaattttggacatttgggcgtgtgggatgtcttggtattactgtcatacattggtctcacgtggatgtcctgtattctatttcattggtatagtggaagtgaataatccatttatgcttcttattttagctttacaattgagcaagtttaagtttggtggttttggtctttagcaggtgaccattaacttaggaagcatgttttgcttcagaaaacaggctagtaattgtggtaggaagacattgttttatttgacaaaatcataacagtacctttgcaactacttctgtagttggaatattttttggtatttacaacataattgaacattttgtccgttatggctagaacacgtagcaccctgactatggctgaaatggaggctgccagcaggtatgttgggttgctatctggaaccatgcaaaatagcattccatttgttagctgctccagctttttctgtatgttgggtcaattaggtcatgctttacccatatttttagtttagcatcagatggccgttcatacagattataaactccctcctgtcaagaaactagaccgtttggagattatcgttttgttcacaaaagcaagacatctggaaagatttggggtcatttggccacctatgccccttattaaatgactttatgcatgctaagttgaaatttctagaggaagttaattgcgacagtattatgacaagtcactgattaatcattccttggtagatgcaaacaagccccaaacattttcctttgctgactgaagggagtattgtttccacaaatttgtgattttggtagcattccgaatggttgaattgtcaacagtgttgaccacgtccagactagttcctcaaatgtttctatgtttgataattcctgatgaaaagttaatgtgtggcttgttacatgtagatatgcacatggtgcgctcggacattgtcatctttaactgcacggtcacgccaagaagatcggtatggagttgctcaactcacaggctgcaatgctgctgtgatgtctactttgctgtctgcgctagttgccgttgaggcctgtttggggaagaaaactaacccacaacctgcgcactcactgggtccagcaagcattaagtgggctaacttttccaccgggagaaaaggcaatgtaactgccattgcaagcacgcaaagaggtggtcttcacactaaagctttttccatggccgatgttattcgaacttcgatctatcagatggtttcagcctttgagcatgacatgcgggcaaatgctaaagcatcaagtttggagaagaactggatcagtgaaggaagaaaacctgtatttggttcacaggctgtgttggttcagaagctgagcctgtttattgagtaccgtgctgtctgaacttggcatcctgtaccaaatccttaccggccatttaaattattcttggatgaaggttatttcgttttggatttggatgggagagtttgtttgactatgaatctttcgaacagattatgactctcattcaggttcagggggccaatattttatatcaagaacgacttggatagtggcattttctgctcataatcgtcaggatgtaagaaagacatgaattgttatacctatggagagcttttcaaaagataattacatttctccactgggaaaaagccacgctggttttgaaaaactatgccggtgaacctgctgtatactacttttcattttctcaccctggagttgtaatctgtatgttgtcatgggagaaggaaaccagagctgtgctgaactcaataggcttattggaattttcgttctcacaatgtaacttgtttgttagtcttacccacttaacagcttcacctgaagttctagtcaaattctaatgctttcattgatttacgtgatgttgtcgcctaatcttacattttcattttgggttacttgttacagctttgagccatttgaaatttgagttggcaaaactcccttgtgctttttctatgacagtttcatgatttcatcttggatcaaaactcagaaggcacatcctggaagaggcgtactttctaattgagcattctaactatccacctcatcaatcgtggatttatgttacaacaagctcacccaacaaattaccacggacagtggaaatggaccaccaaacagcgaaaatgccggtcattcagagtacttatgtacagacgggtaaacacgttgcttcgactgcaactatcaccaaactttctactacctagttaacgacgagaaacttagctgccaccccctccggcctcgccggcgcggccagcggcggccgcctcggcgaggcggcgagcatcgagagggcggccctcgcggtcgccttcttggcgccggcgacgacggccttggggcaatgccggcgcggcgacaggacgcgcccgcggtgcgcgtccaggcctcccccgcagctctgcgacggcttgaggcgcttcctcggcggcttcgccaggtcctccagcgaggcgaccgccgccagcgacgcgaacgactgcgactttccgtcgaagaacctcgacaaccccctcctgcaaacgaaaaaaatgaaaaaaaaaaacactccggtgtcagctcagctagctcaaggatcatcaaagatcaagaagaacgcgaccagctagagcaaacggcacgcacttgaacgggagctgcgtcatgaggtcggacatctcgaagcggcgctccgccgagctggaggaggaggaggagctcgcgtcgtcggcgagctccgaggacgaccccgacgaccgcgccgagctccccgccgacgtggacggcgacccgatatcctcctcctgctcctcgcaatccgccgcgccgccgcgccggcaccacgcgtacgcgtccatgtatatatccccaactcttgactctccccgaccaacgccgatctcagatcaaggcaagcgaacgcagctcagatcgatcaaagcaacaaccgagccgtgtcgtcgtcgactggtggaaagaaggcagctggtacaaattataaaggtgtggaggaggaggaggagaccgtggccgtggtggcgaggtgagtcactgctggcagaggaggataagaacgagcgagaactgaagtagtagcggagagcgtacgcgaggcgagcggatgagataaaagaagaaaaaaaacaccggtcgtttatttgtttatcgcgtgtgcggcgcggtagggaagggaaggagtaaaaactaaaaaatagattcggcgttatcgcttttcttttgggttttttatccgctgggttcggcgttcgaattcttgctctccgttttttttttctttttccggagaacggggggagggggagagagtggataaggcctccacatgcgtatacgtgtgttcccgcgcgcgcgggcgcatcggaggccacacgcgacgcgatgctgctgcgtgcggctgaggctataggctagcggagtggagtagtagtagcgagtgggcgttgcttgtgattgggggaaacggaggagggccacacgctttacagccacatctttttaacctaagctaatgcttagtactcctatcagttaaaatttttttttaaccaatttaaggttattttatcgaaatttactttctaaattttttgcttttagattcttaagaacaatacgtaaatgtttattcataaattatttttaattttcttttgtaaatactacctccgtcccaaaataagtgcagccgtgaatatccgtgcccaacatttgaccgtccgtcttatttaaaaaatttatgaaaaatttaaaaatatttagtcaaacataaaatactattcatattttatcatctaatagcaataaaaatactaatcataaaaaaaatttaaataagacaaacggtaaacgtgaatagtgtaaaaccgtatttattttggaacggagggagtatgttattttgtttattcatgtataaaccaaacaatggtgccattaattcccgcctgcgccacgcgggtttgtgcagtccacctgctacggattttacttggatagtgcgggctgtgcggctactactacaaatgtgtgtttcgatttaccttgcgcgcgtggcgttcccatcttgttcttccgctgttgctcgtatagtggagtggactgctcgtacttgtggagtactgctctcttatatttaaaggatatatcttaaaatgtgtatgagctttgccctaaagcccattacaaaaatttgattatcaaacaaactaaacgcacaacgagcaacggcatgtgttcattaatcattatgttagtactttttagctagaagcctagaaccgcatcaaagtggcaagatggctttagcctttagttgtccaacagcagtagtatcgatggtacgtaagcttaataggacaaagacagaccatatgtggcatccatttccttttgtctaaaatatgtccccttttgctaaagaacaaatgtacatttgcaacctttctcaaaacataattaaaaaaatgcatgctatttgtcattgtatgatggaatatgccagatccggtaatctgcgactattataagtgtggaacaaacaacttgctactcctttgcaccactgttaccctcctgacagtgaaagaaacacaaagaaagctgcagctagctgagatgagactgtctctaatttaagaagagattattgacatagtctccaaaaaaaagagttaaatgaggatgattctctgtgtacttatcgcgcttcattacgagatgccgattgtgcaaagctgactcagctgacctggtaattgcccccctgaccactaactcgtggtccaatcttcacttttggtcttcgttgtatatcctttcaacaatatggggtacttatcctttcctacgacttgaatttataagctatatggtgatggttacattgggtatgaaatggatatgataatgaaagttggctctataatgagtccatggttttgtttggaggtgaggtgtgaatacactaagttttttactttctccgcttcatattataagaatttataacattacccacattcatatatatattaataaatctagacatatatttgtgtctagatttattaacatctatatgaaggtggacaatgctagaaagtcttataaactaaaacggaggtagtagcttctaacttctaattcattttcttaattttataattacatctttactcctttaaatgtatcttatggttgtgctggtgagtctgtctcaccaccaccacccaatatttggccccacataaatagtattcttaaaatcttgaggatttatattaggagtcggaaattctaaaacaagtagagccgctatggcaagggggaaaaatgtactactggtagagtctacttgtgattaattaaagtaggaaagcaggattagtgcgctaatcgattaagtcttatccgccgctaagtcaacagagtactacactactaatgaacttgcctgtgataacaaaggtacgaatccattcgttcgttctcctagtcacacacaagaggtagtataagaaaggcgaaagcaagtcctttttttgcgacagggttgtaatcttcgggcccaaacccgggaatgccatcattctgatttctggggggcaacattgacgacaccatgacgggttaattaggtaataaaataaactcgaggagttcgcaagcgaaagcatcgatcagaagacgatgacaatttatttaccctttgcctgacggtaatcaacgccgatcaactgtagtatactgaaaaaaatagagagaacattttgacacccaacgcgcgggaacaaatcgaaatgaagtagtatgaaactgtgcagcactcacggaccaatcaccaatttgagtctccgcgagaaacaaacaatcaccaatttgaagatttgtgtattttggatggatttcgggcatggtgcagcgagccaagctgtttttagggtgggcgcttgggccgtactgcacatttcatacatacgggccaggctgaaaaggcaagcctagttctgggctgaaacaagcccaccattgcttgcaacaaattcagctcaacatctcagaacaaagaacgttcatatttcaaaatccgaatcactccagcaacgaaatgagaaatacaggagacaaatttaattttcgcaaggattagaatcacatcatttcatctacggaaatgagcaagactgacaagtgagtgagtgacaacatggagtaataaaccgagtttctaagcatcaaactgaagattgtgtgggcttgtggcaatttatttgccttcagctaacagtagcaacaccaaccaagcatggtaaatacgtacgttttgactgccatttcccacaaacaaatcagcacgaaatcacattagcattcaagaaccaatcgccaattcgaaactttgttgtgttttttttctgcagcatagttcgaacttcgtatacagagatactaccactattctgttgcttttagatgattctctcaactactgtacgtgcttcaacaacagcttaccccttgttgcaaattcagatcagcattcacatctcaaatcacagcagcaacgggatcagaaatgcaggaaacaaataattttgctacgattgaaatcgtaatgtcattacatctatggaaatgagcaaatcacaaccaggagttgggatactactaatcctactactaaaaacccacccgtggcacatccgggtctctctacaccagcaaagcaaaaggacacaacaagagctaaaacaccagcaacagccagtccaggaggcggcggcggcagaggcggccagcgcgagggcgagggaggaccggagggctcagccgccgaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatgagcccggagatgcgcttcacgccccccctcctcgccagcctccggatcgccggcttggtgatcccctggatgttgtcgcggagcaccttgcggtggcgcttcgccccgcccttgcccagccccttgcctcccttgccgcgcccagacatcgccggagaccgagacgagaccgagacgaatccgagatggaagaagagagaagtctactacttggggagatctgaaatcgctgtggctcttggtgagatggatttggatttgggggtggttttatagaattttggggggattttgagtttgtgtttgggcgggagaatttttggggatagatttgcgcttttggtgggtgggtttgggacgttggattggtggtggacgggcgcgatgggttggggtgtgtttccgtggattgatgacgtggtgggaggcgcggggatggatccgtgggtggggggaggattgccgttggattgaatcggatggtggggaagctcgtcgttgcgagtggagcggatcggtgacgtggcaatggttctgtggccaggcgaggaacgtgggctgggccgggccgccggttttagctcggtctcctgatcagtcacgaggcccgtagcgtcaagtcaccggcccaccaccaccgtccggcgaataaacccgccgcctctcgtttcgccgccgccgccgtcgtcgccgtcgccgtcgccatctccaggtgggtgctatagcgataggctatggctttcgcgccgtccgcgcggagggtctcggccgtgctgtaccactacccgtgcccggacggcgcgttcgcggcgctcgccgcgcacctctacttctccgccgccgcgctccccgtctgcttcttccccaacaccgtctacgaccccatcaggtaaatcttctgtaacttaagagatcgacctttgggccttcgaactactagtttctgcttccaatgttcttctcctccataggttcgtttgaagagatgtgaaatcggcaggaagctgcaagcgagtacaactcttcctttacaatgtctaactgtagtttcagttcgtttagaccgaccaacatctgtggagctgctcaatgttcactttggcattgctttgcgcttattaagctttccctttgtattttagtgggagaaaattgcatctagttggcattctgacaagtccctttttggaggggaaagattatgctttggggtttctattctgtagtgacgtttggtatagtcaggcctaggtgaaatatacatttttttcccggatttcaatatttcatgaattatgaaaatgatgaatgggaggtcaaaattgaacaaagctgtttgatgattttgtcatgatatgagcctctgcacagcagatacagtgatgctcaagtgtttctctttactatagcattattcttactgttaccctctctgtaggagtgatgctcttccatttgatgaaatcaaagatgtttatctcctagactttgtcgggcctcctggttttgtcactgatattgccccaaaagtcgagaggtttgtaagcatttatctactgctatttgctttaagttttgttctgtgtgtgttagtttcatgtgcattatgctgttaatcttggattcttagaaataagattcagcctatgttcattctgtcattcatttaatatacagattcgatttccgtacacttcatgagtagattcagtatattctgtaaaatattttggggaaacacattgtggccatcaactgttctgaatattgctgaactgtagattgtagaagttatgcatcaatatttctatacattctgaattgttttgtagaatattctatccctaatgctaggacaattctaatgtttttatcttgttcagtgtcacaatcttggatcatcataaaactgcctttgaaagtttatgcgggaaccccacactcggagaaaatgtcaataaggtgattgacatgcaacgcagtggagcaacaatcgcatttgatttctttagcaacaaactcttgacaataggtagtagtttatggaatcatagaagtggcaattcttttaatggggtgaaatatctacctgataacaagcttgaaaccgtacacaagcttttcaagtttatagaggatggggatctgtggagatggaccattccgaatagcaaggccttcagcagtggcctgaaagatttggacattgagtttgatgtcaatatcaacagaaagttgtttgatcaggcaagtaacttggtactagtgttctgctacagtagcatatcctcattaaaaattcatggtacaaatctagcaccaccacttttgcatcactaaacctatatattgctagcctaattgttggttaaaaacaaagtctagatcttaaaatacattagtgccttctatacttggacagaatgattattgatgttgtcctactatacgagagctgttacaaaacattgaaatcaccgagctagccatcataccaaaatgctttttcatccaaagcttgtattgttttggtccaataacttcctgtgaagtggtattgttgcagttactggaactggatcctgaggaagtcatttctcgtggacaagcaacattgtcacacaagcaaaaattaattgatgaatgtctggagaaatcctatgaaattgcattaggatgtggcaggttcggtaattgtctggtaaatacctgcaggttttccttttctcttgattattttgtatgttcattaatattctattcatgttttgtcaacattctattatgtgaaggtgaatcgtccctacattcgtctataaattctgttatactacttgtttgatggggctgttgttgcaatttatgatggtccatgagctatatgtttgatccaaattagcacatttccagtaaactggatcagtagctatatttcgtgaccagggattaaaatttgacatattacaagaaaaaatcctgtggtcttttttggtacacgtagctttccagttccaggttctggaaccatctggtgtgcaactccactatccttacataaccaggacgtatcttttttccattagttctgcatgttttttttatttgtgcaatcattcccacctgaatttcaagatagcttacttatggtagctttatggttcgccgccatcgaatttgaggttctcttattatagcttaatactttactgatgcagaggcatgcaaccattcctacagcctaatgtctcagtatccgtaatactttttactctctttgtttgcattttaccaacattacaggctctgctgaattatatttttattgacccttaggctgtcaacgctgatgcaatttcaaatttgagaagcgaacttggaaatcagctagctgacaagagtcgtaatttaaatctgaggcaagttttctgttcaacctctccatgttgatgaacaatccatattgtttcttcaaagcgctatgttgttctaacacgaaccaatggtaccttctccagaagtattggcgctgtagtgtacaaagtacctgagttgaataatgacaatatgctgaaaataagtcttagaagtttgaacgaggaagacactacttctatctctaaggtacttcatcctccgatcaaatctataaggctgtaaagtagcatctgaaaatgatctattttaaggctgttgatttgttggcgtttgactctttttgtaggaatacggtggtggggggcatcggaatgcaagctcatttttgttgagcgttactgagttcgacaggtggaaggttggagctgaaccttgcaacactaaaatgtaagaacttcatcaacaaattgaatggttcataaagaaggaaatgcaggatgttacacaaaagcacaaaatggaaaaaacatcaagtcctaggccctgttcttttgttttcttagctaggaccagccgtgtctagctatctaggcacatgcacatccggtcagtggcgtgcctgtggttcatgaacatgagcccccagtatcattgtaagaaaaaaaaaactgtcagggtcgttttgaacatttttgttggagaagccaattgttagggactgactaggcgttgatcggctgatcgctattaaaggtgttttgaacgattagttgtcacaagcaagtactccctctatcaaaaaaaaattaagctaggagatcctagtagaacgaatttgtattaggagaaatctcctaggttgagttttttttaagacggagggagtagaccggatgcgacggtatgattcatgacatgaactgagcatgaagggaacaggcttggggcatgatcggatggctcatagggcgttcaaagtgcaaggacgtggccttcagccccatagaaaaaaacgaatattcagcgccacatcagcggtacgcgaagccaaacgaggttctcgtagccaaacatggatgctcgttcttcgttcgtcgaacgacttgcggagggcgaagaaagggtgaactgccgcgttgtggagggcggagcctcgcgggcgtggcttcgcatcagcgagggaaataacccccctttcccgcgctcacctcaccagagagaggagcggcgccgccaacggggagagaggagagcgtcgcggggctcatcgcggcccccgcctttgcgacggcctccgctggctacccctcgatctgcgcccactggagtttgtcggccacgctgccccgaccgcgataacctgcgcttgctgccggccgcaccgcccctcgatctgcacccgccggagctcgccggccacgccgccccccgatccgcgacgacctccgcttgctgtcggtcgcgccgcccctcgatctgcacccgccgcagctcatcggccacaccgcccctcgatccgcgacgacctccgctcactgctggccgcgctaccccttgatccgcggtggtcgaaagaagaggggaggtgctcgagccaccccgctgcccagacgccgttgagctcccgtcgtcctctgctatcgcgccgccgagctcccgcagtcccccactactgcgccgccgaccttgccgttgttgcaccggcaagcgccaagccctgccgctgctctgcccggtgatgtcgctgcttgggccgcttgggccgctcgggccgtcgccatctccgcccggcatgctctctgctgtgggaattttttttatttataatttttcttattaaaagttttacaaaaataattttccattttgaaaattgacggaaatagtcgcctaccgcc

SEQ ID NO: 79616 - DNA, 769 bp, Oryza sativa
  unsure (1)..(769): unsure at all n locations
cgcgtgtacgtaatgacgactacttagggccaacncgagctcggtacccaaacaaaatcctagtccaaatctaaatcggaatcatcaaaaaacatccagaatattaacacgagatgacgagaggagagggaggggcgagccagaggccgccacgcgctgctccttgccacctcaccttcggccgaatctggtaaggagtggggcggcgaccactgcccgatgaggagagaaggagccgacgccggatctggcaaggagccaccaccaccgccgctcgtggtgggggagggcgccgccacagccactcgccgcgagggaggctgccgcgtccgccgcttgcgggagggcaaggcattgctgccgccgtcgccgatgctcgcaggaggaagggcgctgccgttgctcgggggagaaggttgccgtcaccactgccgctgctcggtggggaaggctgctaccgtcgccatccgttgggcaccgccggtggggaggggcacgaagaggtgcgccggtggggagagaggcggcctgcgtggaggggaggaaggggaaaactggaattaggattagggcttatttggtccgggggttttgatggattaggagccgatctgagccgtccataacaatgaacggcttaaaaccgctccccggtcggggccagaatccattaattgggccgaataactgcttaggccgggcctcgttcaattagccgcatgtatgtttggtgttaacgcccccgaacctagtcctgacccggaactat

SEQ ID NO: 79617 - DNA, 909 bp, Oryza sativa
cgctgcgcacgtaggacttctgctcatacgggcgaattcgagctcggtacccaggtgttgttccgagctgataaatcgacacttttatgcggattgagccaatcttatccaatcgaatcaaacgaaccttttttttcgccacccttactttttttgtctcccttatctcctccttttcttcacccacacatctttgtcttttcgcctctctttttctccgccttctctctctccaccggcatggaggcggcggctgctccccctacccggtgttgcggcagcggctgctgctgctccccctccctggcgtggcggtggctggtgctgcttcctccctccccctccccccagcgtggcgatggcagctgctactgctctcccttcccggcggtgctgctcccccccttccctgacatggagccgacggtggttctcaccagcatggcaacaatttgatttgtgaatattttgtggggattttatgatttgggatgttgattcagtaaccactgaaggaaaggaattgcttcctatgatttgcctatggccaattcctgcatccaaaggcatgaacagtaaaacatcctatgggatttgcaatcctatcttgttccatcaaaaaaggaccttggttgaaaatggcatcttaattctccattctctggctctatatttgtgaagtcacgtattcacgaaaatgtcatcaggggcttcttttgaacaatgggaaactaaggaattttggagaactagattcctatggaaaaatttggtatgtgctcctttggaacaaaagaatatgtcttccaaatcatttaaagtccctatgaaatgggccatttcatatgtaggaatttcgaaagaaaactagcattatcatattttcttattcctatggcacaaagttaa

SEQ ID NO: 79618 - DNA, 510 bp, Oryza sativa
tattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaag

SEQ ID NO: 79619 - DNA, 8294 bp, Oryza sativa
catctcatgattcccactatagaaataactatgaaactgtttatctaaatcggcccagctataaacagaattataaggcagtgaagaaaaccattgaaatgtcgatccagactaggtcaaaggaaacaatctgacccataaagcatcaacagccgatgcctcaccacattgagccaaaaatcggctgacatgctcataagttgatacattgtcctgccctgagaattttgaaaagtctaggactttgtatcggtttggcaatggaaccctctcaaaccactcaggttaggggtgccgatacaaatttccagtatccttcggttttagcccaaactgctccttcatcacatatgcaatcatgtcagcccagggcttttggtgagacgctccttgcatctgctgttgaattggatcgaactagttgaactgaggcagaagctgaggttgaggtgatccccctagttggtaccgaacctgaggtgaatgaggccgatactgaaaattcaaattaccaccaagatagttctgaggcggttgttgcacattatgcatttgttgttcagggataaattgagctccaacaggttgaggtggcttgaacattgctgcaatctgttcctgagtcaaccgattgatgttctgcctagcgtgttgaggttgttctctggtcagcaaataaggattaaccggtggcctttgtgccgatgaagatacacctggtctagaagccgaagccgacgccatcggctgccctggaggtacattggtagcaggctgttggttgccggtcactaaattcctgtactgcggaaacacgccttctggcagaaagactggtcccttagcctgatgctcagcaattgtgccatcaaccacaaacttgatcatatttttcaaagtattgacaagcactcctgattggttgattagagcttgatgaacagtgtactcgacttggtcctagaagttattgaactccaagggctcttctcccccagtttcatcatccttaggttcatcatctttgtcacctttatcaccttgccatccttggatgtacttgattctggatcatcggcagaaaccacctttaccttgtacctctggataactgtgcctgaatgcatctgcttgaatgagtgcaagtactgagtcttcaaattgttaatcatctgctcatactctgccacttgttctggcgtcagcttatctagtgttattgggatgatgttctcagggatgacttctgccgtcggcggtggtttagaggacgggggtttagaagtttgcttgctatccaccatgttgaagaattgttacaactcggtcctaccgggcgtgccaaaagcgtgttgatgcgaaaaacacacactggcctggaagatctgcttaactcctgtgcaggtccaaaatcttgtttttaggttcaaaggtgtgccaattgatttgatcctacaatcaacaagaagaaaagacaagaaaaaggaggttaaatctataaacgatagccgatcggctaggagccgatgacatatgatcaatcattgagccgatgttattggcattagaccagcaatgaagaataaagcaatataaaactaaatctactcgattggctgtagatatcaacaatatttaatccttctctcaatgtatatttaaattttgtgattgggatagattgaacagtatgtcgagacagtataaatcacttaagtgaaaagatacattcagataatgattatacgaacgtttatagcatagccgatcagatagatctagcatgtatcggctaatactccgataccactctatattaagatattagaacagacaagatatattaaacagaaagcctaatatactttaactcaataagatcttaatataaagggcatatttagcataacaatcaagcatatgagacaaaagtagctactctctaagagatggtagatatgtgctaacgaccaaatttggtaatccaaggatcggatgtgaaggaggattcaagacggagttcgagatagagactgtcccggaaacagagtgaggatcggctggagtccgaatcggctacgactaagatcggcagagtttgagtcggacagggttagccgattgagacgaatccgacaatatgacacggcatatgttgtcgggttaggatgacgtgcttcatgatgattgccacacatggatagagtcgtaagaaggcaattgtatctattaagtaggatattttatgtaatttccatagagatttgtttgggcaaaagtctgccgcaaagacttatggtatcttagagtttgttagagacaagaaacatgtccgatatggacatattttgtaatttttgggtataaatagacctgagccccatgtaatcaaactaacactcgttcaatacaatctcggcgcattgctaccctttttacttccgttttgtttcgacgggttcttgctttcaggttgagctgcatcggtttcgatcttcaactagaggtaaaacttattacggcggcttgcgttctcgggattagtgattccatctttatgatactctaatcttgtttctgtaattcgtcgagttatcatatatcttatataatctctggcaatatcgctatctaacctctaatcggctaacgtctgttactagaaggcagccgattaggttaaatatcaacgctgacttagattgtataggacatctaccactctatgaaacatccaacggcttgattgtctagatattgtccttcttgtcatacttatagctgtatcagttgagtttgatcttatgagtcatgattagaatctcaatctctagcctgcctttggtcgctgattagggtaacgtcggggtttcagccgatcttacctgatttaactacctttttctcatatgcttaattgacatgttaaatctgccctttatattaagatcttgttgcatttaagtatattaggcttttgtttggtgtattctacttgccttaatatcttgatatagagtggtatcgagtattagccgattgtaataccctgaaattaaaaataaaataacatgtttggaattgggccgaatcaatttgggccaagtcgcagcagtccagcccacctcccccacctaataccctagggagaggcgactcccaccttcccagccgacgccgccacacctccccctcggcacctatggaacttacatattcctttctcccctgttagccctactccatggatctccaagaaccatagccctaatcaagaatctgattggaaaaacggatcgaggaagaggagaggagcaggaagagtggtgagttggttttcccatcatattctctcaagttctccaaaccctaggtgaggcttaactctcctgtgcagaggttgtaggttattttagggttgtaattcggcgttattcgaaggttagaggatgggattaggtgttgtgttttggattagtgtttctaggccctgtcagctttgttgtgtctctgtatttcgctaattagaggatcaaaatgattttgctgcgaaagtttataactaggaagttgtagagtttttccttagctttccatattggtaaagtacactttgattggcgagtagaactccagatatggctgttttaagtgtggcagtctgaattcttgggcagattctgaagcttgtcttgatttgagctttaggccatctaaatggcagaataaaaatatgggttctacacgaaagttgtaggtctcattctgtagatttccaaaatgtatttatttgcagtcatacaatttttatatttcgagatataaaggtttgaagcaacagtattgtttatagtccaagcggcgtttcttgtttttgcgttttgaggtcttgaggccgtagatgcatgttatttactgttatatattcatatttgagagtgtttgctgaggctttgattgtgattaggtggtggtccttcagatcgtgtatgataccaacccttcattggaggcaagtgaatgtagctgtggtttgctacggttttatcatgttattttttccaacctccaccttgacactttaatacctacaatcactataattccatatgtgcaaatgattattttatgtatcttgctctgagctatctccgctcggctaactatggttaatgtggtatgcttttagtgagagtaattattatatgtgatatcattggaaggatttgtggatgtgttatctttcctctattattgtattgcattgcatttcatatgcatttcatttgaagttatgtcgtgaacctatggtcgcgaccgtaccgatacagcatcgtgtattgtcgtaacacgatgcagcttcacaccttgttgggtgtgaaggcaggaatatcattgcatttgcatcgcattgcactttggtattttggggtatggaagttatatactctattgagttcatgagagggcttctttctcctgaagtctttgcagatgtggtttatcctccttactcttgaacctatgaacactagatgtttgcctttatatttaatgttatgttcctttgttttcttataaatatattttaatgatttggtaggttaaataacttgataaaacaattctcttgctgagatttattctcacacccctacagtgttttcaggtgcttaaagtgatatgctcgcttgggggaaacaggagtagaagcacaactgcattccacactgccaccttaatctttcaagttgtcatgattttgataataaaggaactgtacccttgttaagttgcactagatgaatctgagagttgaaattagtttatttcatccctgaatgttcctttctccttgtttttttgtggatggctacttgcaatgctatacttatatttgacgcttccgcaatgcttatgttttaaaggagttgcagtcgaaatttctccttctttgttaaatgtatgtctatttagtagcatcccggtgtcattgtagtttctggggtgttacaccgatacatgctagatctatctgatcggctatgctatgaacatatatagtctcattgttaacatatacttcgatctaagtgatttatattgtctcggcatggcgaccgatctatcacaatcacttgatttaagtatgtatcgacataaggattatatattgttaatatctacagccgatcgagtagatttagttctttcttacttattcatgattgccgatcgatccacatatgacatcagcttcaagataaataatacgtcatcggcatttagtttatggatttaaccgcggtttctttatctttgtttcttgttgattgcaggatcaaatcaactggcacgctcatacacctaaaggcaagcttctggacctgcactggagttaagcagatctcccaggccttgtgtttttacatcaacacgcttttggcacgcccggtgggaccgattagaagttagaatcacaacagcgttctctcatggctgagaaactaccagcatcgccgtcctcagctagcaaagagggtcctcccaaatctaggatccctaagcttggtgggtctgaagttaatgagagcaatatcgtgcccatcactttggacaagttgacacccgaacagaagaaggatcttgaggtaatgatgcagcagacacagaggtaatgatgaaattctttaacccatttatggagactcgccaaggaacaatcgttcagaggtacaagatgaaactagttgctgatgttgctgggacaagttcttccaaggatggagaaatacaacaggtctcagatagtacgactcaatcaggtgataaaggtgctgcagatggttctcaaggagttcaaggtgatggttctcaaagagctcaaggtgatggttcttagggatttcaaggtgagtgaaagggtcaattaggcctagaggggggtgaatagactaatttaaaactttatgcggaagctaaaactgagttagggtcggaaagtctgattcacagtcagactatccgaaaatatcagatagtctgatgttggatcagattgtctgatccactaaaagaacactacaagtagatcaagtgcacaaacaagagtatggcgcaaacagcgactagatttatagcggcacaaaaaacaaagctaaataatgggagaagagatatcaccaaaaatgaagttcactgagttgttcccggagttcaaatccttgaggggatctactctccgttgaggagctcactaagagccgggtctttgctaacccttttctcaagaggttgcactaagcactcctccttccactaaggggtatctctttccttgtggaggcgagatccggccttcacaaacttctcccggccaaccacatgtagatcggtggctcgggagtgacacctagccgtctaggagtcctcaacctccaagcgtaacaaacaccacacaactcttggtcaaccctagtgctcaagatcgagtgaaacacacactaggccctcaaaccccaaatccacaaccaccaagatccaccacacaaagaacaagaggggatttgagagagggagagagagctcaaagatccaaagcaccttagcaccaagctcaacccaaagtgaatgtgaatgaatgagttgggtaaccctagaaaagggttaggtggggggtattcatagaagcccccaaaatgtggccgttgggagagaatcttttcatcccacctcggaaagtccgaggtgacatcggatagtccgatgtttttgacccccaagcaggccagagacagagaacgaaattctggagaatttcggacaatccgatcgatcggatagtccgatgtcatatcggatattccgttatttttgaaccaaaaatttcaaaaggaataaaaagcaattcaaaacagagagtgaagttctgagaaatttcagatagtctgacgtatcggatagtccgaccttatatcggatagtccgatatattttagccaacactcagacccaagacagtgagcaaagttctgtgaaatttcggatagtctgatcaacatcggatagtccgacagacataaaacaggaacacttcaaataaatgattttgagtactagtggttttcccattaaaaggaagtggcaattctttttattgtaaggcatcctaatactcaagaacacaagatatacatggattagaagacaattaccacaaaagatgctgcaatacttattgtgttgacatccactcctttttctccttgcatacatctcaacaaaaagcattagttaccctctaattatgttgtcattaacaccaaaataaatgtggggtcctagatgcactttcaatctccccctttttggtgattgatgacaacacacttagaagtaataaaagattaggattttggtggagctccccctaaagatatgctagaaatgaaataggagagctccccctcaatctatgcactagattagaaatgacaatataacctcatgcatatgccaatgacaagatatttcacacatttgagcatggataatagataattgcacataacaagacacaaaagcccaaggttcgactagccatcaagaaaggagatagattagagatttttgttgataggtggttctccccctttggcatcaaggcaccaaaagggaaaaagaggatcactcatcctcattagaatcctcgccctcctcacttgactccttagcatagtcaccttcctcctcctcttcttcttcctccataggagccttgccacgatccgcacgagaggagcttgcctcagctgcaaacgggtcctcaatcacatcctccccactgtcctcaacctcagaaccatcgggggaacacggcaaatgggcgttgcgaaggaggttcttgatccgtcgagtgtccttcttccttgctctgcgttccttggcttgccaagctaagatggtcttgcataagttgaagatggacttgaagaacctcaaggacgagttggaatccggcttggtgacggtagcggagggaccggcacgagaagaagcacgagtggtttgtccagccggcacagcagcagccttgatgggacggacatggtaaccggtatgtgccacctccttgtgaaacttcttcttggacataatctcaatcatcttcataatgtaaggcccatagccaagtcctcgcttagggcttaggcatcatggagataagccggatttcttcaaagatgaagtcaaaggcgtcaaagagctgtgggtgagccttcatcttgtaaagc

SEQ ID NO: 79620 - DNA, 703 bp, Oryza sativa
agtttttgtgggtaaacgggtgaaccatgcccgtatacccgttgggtataggttttgacccaataaaaaacccatgggtactaaatggagaacaaatccaactctattagtgtcgacgttttatgtcgtgattccggtatttgcatagtatggggatcgttggtactaggatatacgcgagactgaggtaaaagagatggagacggggatttttatacaggttcgggctcctgaattgtcaggtaataaccctacatcctgttggccgaagccggtattgctcttattcaccataatcataccagtacaatatttggggtagcctatctaactgttgtcgacatggcggtttgaaggtctgactcatagtcgacaatagggtagtcttcctcctcgagtttgtgctcggcgagatcagagatagcgcctttcgtctctcctgacagtatccggaagacaccgtaggggactagccgtgcctatctctgaagtcaatatccggcgtcttgtctttgcgtatgttagcttgtatgttgaatctttggcttgacctattgttcccgtgtatgttgattgtgggtggctttcatggggggtggtctcccctcttctcctagggggcccttgttttatacccataggtgttccctttgtccagttggaattagggaaaccaaatatggatccaatccgagtagtcctg

SEQ ID NO: 79621 - DNA, 774 bp, Oryza sativa
  unsure (1)..(774): unsure at all n locations
gtgaccccnnttggattgtatacgactcactatagggcgaattcgttctgttacccacacatttgcataaaatttttgaataagatgaatggtcaaacatgtgagaaaaagtcaacttttattgtctattaaaaaacgaaggtaggtaatcacaggttttcgcatcatggtctagcttgccacaactagatatagaagtgagtcgaatcaataaacccatttataaaccaaattacccgcgagacaatctgcagattatccactaattttacctatataacgggttggcccgcttgcattcctaattgggcctgcctgacccaacgagtagagcccgtccagtgccctgacagataccgcagcccaagtagggcccataaaacaacccgtgggcccgtctcttgtccgaccgttgctgcgttgctggcaggtggggcccacaaccagcagcggcccaactcccaaccccgttccgttccgttccccatctgctcctccttccttccgttccagcttgaccccgacgcgtacccgacccattcactctctctcctctctctctctcctctcgcccgcatcggccgccatgcgcgaggaggtgcggagctcgtcggcggcgccgcccgacccgccgccgcgctcggcctcgccgcccgccacccccgtcgccaggtaacctcccctccctctcgctgctctctccgtctctgtgcgggggactcccgctgtgctgctggtgatgatggtgcgcttccgaatcgaatcgggggggag

SEQ ID NO: 79622 - DNA, 2736 bp, Oryza sativa
  unsure (1)..(2736): unsure at all n locations
tttatgtactcctatattcagcccactnaggtaaattaaaccngctccctgcaggtcgactctagaggatccccgacagtttgtttacatttttacaattcagcattgttcagtgacatctgtaattgtaatttacatctgttctttgtgttcttgataggttttggatcatgcaagttcctggcatccgagtaagttcagtccataattgtttcagatgttcttctttctccttattacatatgactggtaaattaattaaattttgctggattggtgcaggacatctgctgcatcagcactgactcgaggaagcatgtggatgatcttcgcagctgcgtctatgatgtttcttcatctgagagttttccaatccgtgtgaattgggtcgatgctaccaaagtaattagtacctgtggtggtttggttctctttgtagtatattacttatgtaagaagcaaggaacagtgctagttttttcgtgtaaaattgtgaagattatatattactacctccatcccaaaatgtttgacgccgttgacttttttttaaaatgtttgactgttcgtcttattcaaaaaatttaagtaattgttaattctttttctatcatttgatttattgttaaatatacttttatgtatacatatagttttacacatatcacaaaagtttttgaataaaacgaacggtcaaacatgtttaaaaaagtcaacggtgtcaaacatttagggaaggagggagtatgatttaggtcgtgtttttcactctgtaataataatgaagtaaatagttagcaagagtttgtggagggttaatgcatggttaattctttgaattttgtttcagaaagctctcgcttgcatagccgtagaggtggagtaggtcacaagcgtacacaaacacaatagccaattacgagccatatggcccaatatggtgaggcccacaaggcccaaggtgacaaagccccgcatagtcagatccgatccgtaggttgaaatctggacggtcggcacgtcacgcacggacgcgcgcgcttattttagtaccacctcgagaattcgatcggagaagcaccagcttatatacccgcccgcgctagcctggtcatctcttcggagacatccgataaaattggaacgatacagagaagattagcatggcccctgcgcaaggatgacacgcacaaatcgagaaatggtccaaatttttttgagaattctgcccaggtccctggagcttatactttttatcgcagttatgccctcggttctttctttctgccccttctgctgaatctttttcttccgttctcgtccttcgtgtatgaaggcatagttaagttgtctgcacttcagcccctgaagattttttatcttataaatagaccctcatctgtttccttctttagtgctgcccattgttttcttagcagttatgccctcggctctttctttttgccccttccaagttttttcttgcgctatcgtcgtccatggcttcatcgatggaggctcatacttaagttgtctgcacttcacttcagcccctgagattgttttctcttacaaacaagttgctgtatatttcttctctgcttcactttttaataccaatcaggtcctattatatattgtgcattgctgataataatttgtttagtgcacctctttttttgttaggcaccctgtaatctactagtagtactttggagccataaggccaatcttataacagctcatatcaacatcacgtcctctcttttaactatttctttggctccaacaaacgccaatcatatcgtccacaaccacaagcatacgcagtgacgaaccaataacaaaagctaccaacattctatacatattaattatctaattattggttaatatattaattattaacatgatataaattagctggaactaaataatctacccggggtccgtgaccccgagatagtgaacgtagccacgtctgtacgccactaagcatatgctaaaactcagttcaagattttttaattaattaacaataagaatgcatttaaatgcaattaagaatctttcacccttgtattttcaccaattagacctcacatacgcggcataacttttttacattcctattttaaactgaattaatgccactagttatgcttaaaacatacatgtttttttaaggaaagctttttagtgccttttttatggcacttttttaatctacgatccttctacctaataacaatcaagcatatcatcacaatttaggatctccagagagctcgagacaggacgctgttcgctctagcgtccgcgcctggacgttagtcctagtagcgtccttactattttcataatttgcactagtacctctcacttactaaatatttaatttcaggataattaattattataggattaaaaacccggtatattcttagataaaaagaaataaaattcagcttactctattttagatccaactttcaaattatgcaactgcatgtcgcgtgaatattaattcctggtggcgatgacggacacattcagccccttttttcttgttcggaggtttgatccaactcatacctacgttgaggactttgtgtcacacacgaaccagggatgacgagcgtattaacagattctgaacacatcacgacgtgataataatgggcatacgactaacattattggtaggctagagaagagtgtttgggccttttcggc

SEQ ID NO: 79623 - DNA, 30881 bp, Oryza sativa
ccttctccactaactcggctgcggcgaggaggaagaggagcaccacgctccacattagccacttgagctgcttggtcagaggcttgagcttgcgcgtcaatggtatctttgcgggattcagacatacgccgtatagcatgacgagccttggaagagggagagcgacctcgagaactcattgacccacggcgagagtaaacttgattcttgaactgatccttgatcatgaggatacactgatttagaacagaggataatgattaagaagaagtggaagaagaatatttaaatgtgaagcaaggagaaatttggactgggccaaaaggaggtcggatagtctgatttgacgtcggactatctgatgtacattggactatccggcggcatattagacaatccgacggccttttgccctagaccaacaaatctcgattcacacaaaaatatccaatggaatcaaaggatcttctaggtactagatctaggcactaaaacaagaagattcaccgaaggaaatcttgaaataatataccatgagggagatagaggaaaaacaaggaaatacctcaagaaccaccaagagaatcactggggaacaagtgatttggaaggagttgagggagggaaaccaccctaaagagaaggaatagcaatcagagactctgaaacgaagatttttggtggcctagaactagggttttgagaggagaagaggggtggagagagaaacgactgagacaaatgactgaaggggtaaaaaaaaagagttacccccggggaggttaagtccccttgcccttggccccacgtcggatagtccgatttgaaatcggactgtccgattgtggccggatagtctgacttgatgtcagacagtccgacatcctttgtggcagagacaataaaggatggctcaaggaagattttttttttcaacaacatttttataggatgaactcggctagactattacttggacaaatgcagcaaaagaaagaaaactaggcaccctcaagagagggaatgtacgaatctataggaaattgtgcaaggaccaagattcattagagaatgagatccccgtacacatagattcaagttatcctcatagattatgactagtgtttattcatgaattgaatgttcactttgtcatgatgtggcaagcaaacctattctagtaaatgaaaaacaaatgcatgcaaaagatcaagccacattccgagaatccaagatatttagctcacttctcaactcacaaaacctagcttcatctagaggcttggtgaagatatccaccaattgtttgtcggttcttacatgttggatgtctatgtcgcctcttgtggaatggtctcttaagaaatggtggcgaatatctatatgcttggttcgggaatgttggacggggttattggctaacttaatggcgctctcattgtcacataggagtgggattttggacacatttaggccatagtctctcaaggtttgcttcatccaaagaagttgagcacaacaactccccgccgaaacgtattccgcttcggcggtggatagggcgacggagttttgcttcttggaagatcaagaaacaagggacctacccaagaattggcaagtacccgatgtgcttttcctatccactttgcacccggcataatccgcatcggcataaccaatgagatcaaacctcgctcccttaggataccaaagactaagattaggtgtgtgcactaaatatctaagaattctcttcacggccacaaggtgacacaccttcggagcggcttgaaatcttgcacacatgcacacactaagcataatatcgggcctagatgcacaaaggtaaaggagtgagccaatgatggaacggtataccttttggtcgacgtctttaccttgctcgttgaggtcgaggtggccatttgatggcatgggagtgtgaattggcttcgcattctccattccaaacttcttgagcatgtccttcaaatactttgtttggcaaatgaaagttccttccttgagttgcttgatttgaaggccgaggaagaacttcaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatttcaaagccgttcttcacaagaaaattgcgaagacactcataccaagctctaggggcttgcttaagcacgtagagtgccttgtggagtttgtacacgtggttgggatacttcggatcctcgaagccaggtggttgctccacgtataccaactcgttgataggcccgttgaggaaggcgcttttgacatccatttgatatagcttaaaattgaggttagtagcaaaagcaagcaatatgcgaatcgactcaagtctagctaccggcgcaaaagtttcaccgaaatctaatccttcgatttgggtgaacccttgcgccactaacctcgccttgttccttattatgaccccggcctcgtcttgcttgttgcggaagatccactttgtgccaatcacattttgccgaggtcgctccaccaaagtccacacttcattacgggtgaaattgttcaactcctcttgcattgccatcacccaatccggatcatttagagcttcttccacccttagaggttcaagagaagacacaaacgagtaatgctcacaaaaatttgcaatacgagaacgagtggatactcccttgttgatgtctcctaagatgttgtcggtgggatgatctctttggatactttggtggattcttgggcgagctaagttgatcggtgagggtggcacttgctcgccttcttcaccttgatccatgcttgaggtagagggaacgtcggcttgggttgatgtaggtggctccacttgtgttgaggaagaggcttggctccctaggacgcacgttcccaagagccaatcttttgattgcttcgcttggatcctcctcttcacctaacacatgtgagtcaacttgctctacttgagagccattagtttcgtcaaatgtcacatcacgcgcgatttcaacaataccggaggttttgttgaaaacacggtatgcgcattcatttgacccatacccaagcaagaatccctcatccactttgggagcgaacttagaggatctagccttcttattaagaatgtaacacttactaccgataacacgaaagtaagagacatttggtttattaccggtaagaagctcatagggagtcttcttaagaaggcggtgaagataaaggcggttgatggcgtggcatgcggtgttggcggcttcggcccaaaaacggtccgatgtcttgtactcatccaacatggtcctcgccatctcaatgagagtcctattcttcctctcagccactccattttgttgaggtgaatatggagccgagaactcatgcttgatgccttcttcatcaaggaaactctcgatgcacgtgttcttgaactccttgccattgtcgcttcgaatgttcttgatcttgaggtcgaactcgttttgtgctcttcttgcaaacttcttgaagatagcttgtgtctcactcttgtcatgcaaaaagaacacccacgtgaagcgtaaaaagtcatcaacaataacaagaccatatttgttacctccaatgcttagataagcaattggtccgaagaggtccatgtggagaagctccaatggtcttgtagtggtcatcacattcttgacggggtgatgtgctccaatttgtttgccggcttgacatgcgctatacaccctatctttctcaaattgaacatttgttagtccaaggatgtgattgtgctttagaagcttgtgaagattcctcataccaacatgggctagcctccgatgccaaagccaccccgtgttggacttagccactaagcatgtctcatgtttggctttacttgaggaaaattcacaaggtaaagctttcccttgagaacacacttaaagactaccgaggaatcattccttctatagacggtcacatcaacatcggtaaaaagacaattgtaacccatagaacataattgagaaacggacaaaagattgtagtttagagattttaccaagagaacgttggcaatagaaagatcattagagattgcaatcttacccaatcccataacgtttccctttccatcgtccccgaagactatgttatcttgtgaagtgccatttggatcaagagatgaaaacattgattcttctccggtcatgtgattggtgcatccactatcaatcacccaacttcttccaccagtgacatattcctacaagggatcaatttctagttttaggtacccatacttgcttgggtcctctcatgttagtaacaagtgccttaggcacccaaagaactctcttgatagaaatattcttgccccttgggcctacatacttagcaacaacacgaccactagcattcttcctaagaacataagatgcatcaaaagaacaatgtgaagcacaatcattaggaaggatacttttggccctaacaaagttgctaagaccttggggcctcttgatcatcacactcttgtccacctttccttttggtggaggaacatacccaagaccctcatggttgaagttgtccctttgatagcctaggtactcttttagggccttactacccatatggcacttaagtaggccattgtgaaggagtcccataagcttctcattttgcttttgcaaagcactcaaggaaatagagttagtagcacaagcttcaatatcaatatctttgcatcttgcacaaggttcattgcttggggcaattttggagcatgatgccttgctagggagagagacactattctttaaggtttcaaacttctcttcaagagagaggtaagctttatccaagccatccactctctcttgaagttgagcgtttgccacctcaagattagcatgagactctttggtttgcttgtaaagccgtaccaaagcctcatttttctctctccttagcaagttcgcacttgagttcatgagatcgctctttctcatgaatgagcaattcctcttgcctctcaagtgttgcatattgatcctcaattctcccaagcaactcactcaagtgtggtatggattctgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaatacccttcgcacaacacaactcaaaacagtgcaccgttcctggatcataatcacccccttataaacaaggcatggactccccagcgacccccatggacttctcgccacttctcagtctggcgcactataatgaatcatgctatacaaaagataaagccgttgcccatgctggcttgtggttggtacggttaatgtttcacaacagtagctcgcgaaccggtccttaattgtcaggagcacgactctcaaaaccatgtgctcacaacccaccattatgaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaatatgctcaaaggattgtgtttaggatctgtgtgacttgccttgcaataatcggccttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacgggaaaaagaaaaaccgatgacgtcatgctgacgtcatcaatggcagccgactcggatggcaagctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcactggagatggccggcggcggctgtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggaatatttcccctcaacaaaattggagaaaaagagcaacggggaggcgagatttggaaggaagaggcggcggcactgtgcacggcacggctggctcgggctctgcctgagttggaagatgaacagtagcgcagggagggaaaatagacttttccggctaggctgagaggagaggaggcggctcaggttgggccggcggaagagagaggaaggaaaggaaggaatgggctgaaaatggcccaagctgaggaggaggattttattactttcccaattaaaataatcacttaaatgatctttaaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatctgagaaaattccagagagtataattaaccatgaagaatttaataaaaattaaatccatccatgctttatatttaggaaattttatttcccacatttaacttcacttgtaaattaatgaacatttaatataaattctgataataatttattaaataatttataaatcctgaaacaaaaatcagggtgtgacagattccttggttatggatttaagcaactcatcatccataacttcatcctcaacctcatcctcctcgtcactaataaaatcaacattaaatgacttgagaggagaaggtaccttaggctcctttgccatgaggcaaatgggagcatcctcatcactttagtagtcgaagagtcttggtggtgatgaaggcttgacggcgaacgtggcgactccttctccatcacttgagcttgactcggagtcggagctgaaaatcatcccaaggtgagcttggccataatgttcccgcttgctatgcttatacttctccttcttctcatccttcttcttatcttccttgatgtgggaaccatccttgaggtgagggcaatccgcaatgaagtgcccgggctctttgcacacgtagcacactcttgcggaatgtcttccacttgacttgctggagtgatgcttggaagaatttcccttgaagaagccgcttcgcctcatgaacttgccgaacttcttgacgaagagaaccatttcttcatcatcgatctcctccttgctcttgctcttgtggctctcttcttcttcttcctttgccttcaatgccaagtcttccttcttgatgcttgtcgttgagctttggttgatgtattggatgacctccttggactcttgcacaagaatgtcatgggcaagaatgcgtccgagcaaatcatgaggtgtgagagtcttatagtccggacgctcacgaatgatggtaaccaaggtagagttccttggagtgattgctcgaaccatcttcttgaccacaacctcatcggtcatgtccttggagccaagtcccttgatctcattgacgatcttgctcaaccggtcatacatgtcacttgggctctcaccatccaacatcacaaatctctcaaattgccccttgaagatctccaccttggactcacgaacactatccgtgccttcatgcaagttccgaagcgtgtcccaaatcactttggcactctcaatgccatccacacggttgaactcacttccactcaaggcactaagtattgcattggcggcttgagcgttcttgtgcttattctcgtcgtcctccttggtgggatcttcgggattctgcaaaacatagcctttttcgactattctccaaatagatgggttaatagacttcaaatgcatcttcatcttatgcttccaagcggcatagtccgtaccattgaagtacggagctttgctgctataggtactcacataagatgtggatgtagttggatagtgataaggaaacttagctcccttatcaccatctttgccttcccccatttggcccgacatgatccctccaagcggttaagcctaatttggagattaggctctgataccaattgaaaaggtcaattaggcctagagggggggtgaataggctaatttaaaactttatgccgaagctaaaactgatagtctgatccacagtcagactatccgaaaatatcagatagtctgatgttggatcagactgtctgatccactaaaagaacactacaagtagatctagtgcacaaacaagagtatggcccaaacagcgactagatttatagcggcacaaaaaacaaagctaaataatggaagaagagatatcaccaacaatgaagttcaccgagttcttcccggagttcaaatccttgaggggattctactctccgttgaggagctcactaagagccgggtctttgctaaccctttcctcaagaggttgcactaagcactcctccttccactaaggggtatctctttccttgtggaggcgagatccggccttcacaaacttctcccggccaaccacacgtagatcggtggctcgggagtgacacctagccgtctaggagtcctcaacctccaagagtaacaaacatcacacaactcttggtcaaccctagtgctcaagatcgagtgaaacacacactaggccctcaaaccccaaatccacaaccaccaagatcgaccacacaaagaacaagaggggatttgagagagggagagagagctcaaagatccaaagcaccttagcaccaagctcaacccaaagtgaatgtgaatgaatgagttgggtaaccctagaaaagggttaggtggggggtattcatagaagcccccaaaatgtggccgttgggagagaatcttttcatcccacctcggaaagtctgaggtgacatcggatagtccgatgtttttgacccccaagcaggccagagacagagaacgaaattctagagaatttcggacaatccaatcgatcggatagtctgatgtcatatcggatattccgttatttttgaaccaagaatttcatcctctcacagagactcaagttccattgaatttcttagtctctggatcattagatactccgatcatatcggatagtctgatttaaaactcactcaaaaggaataaaaagcaattcaaaacagagagtgaagttctgagaaatttcagatagtccgacgtatcggatagtccgaccttatatcggatagtccgatattttttagccaacactcagacccaagacagtgagcaaagttctgtgaaatttcggatagtctaatcaacatcggatagtccgacagacataaaacaggaacacttcaaataaatgattttgagcactagtgttctaccaattatatgcatgtggcattcctcttaatagtacggcatcctaatactcaagaacacaagatatgcatggattagaagacaattaccacaaaagatgccgcaatacttattgtgttgacatccactactttttcatccttgcatacgtctcaacaaaaagcattagttaccctctaattgtgttgtcattaacaccaaaataaatgaggggtcctagatgcactttcagtgagaatcataatcaagatggcaacacggcacagctacaatttaacaacttccaggataggattgactatgccgtgcaacatgctttaattaatcaatcttgggtgttagtcaatactttgtcaaacatggtgaagtcgatggttgattgctcgatagctgagtatcaggctacaggaccggtttatttgccaggaggtgttttcccaaactatcggcccttggtcactaataatcagccagctgttcagccaattcctcacagtgcaccatcggctcaaccgacagcaccagtctcggctcctgcaccggctgcaccatcatcggcaccaggtcaactaattaatccttggttgttggtgagagaacagccatagcataatggacaaaatgtgaatcggctaactcaagaccaagttgctgctatgttcttaccagctcagcctactgttgacacaatctagcaacaaccgattcagcagatgccaccaagacagcaggttgtgtagccgattcagcagacaagaccgaggcaacaggttgttcagccgattcagcatcaaggtttggtgaatgcatcggctgggttcggaacacctgacaattagctaagacagcacgctgcgaatcaagttgtcccagagcatttggttcataatgtgcaaccagataaaatggtggtacctcaagttattcccgaacatttggtgcgtaatatacaactaaactttcagaattatcaagggggcaatttgaattatcagtatcagcctccatcaccacaagttcaatatcagtaaggggggtcgactcagccccagttcgctcctcaatacaatcaattcgagccaatgccacaacaagcgcagggagtgcctcagcaaagaccatgggccgatatgattgcagatgtgatgagagagcagtttgggctcaagccgaaggatgctggaaacctgtatcggcatccgtacgctgagtggtttgagagggttccattgcctaaccgattcaaggtttcatatttttcaaaattctcaggacaggacagcgtttcaacctatgagcacgttagccgattcttagctcagtgtggtgaagcatcggctgtggatgctctgagggttaggttgtttccattgtctttgtctggatcggcttttacttggtgttcttctttgccatgtggatcaatcaacagttgggccgatttggagaagcattttcatagctatttttatagtggggttcatgagatgaaattgtctgatttaacagcgattcggcaaaggcatgatgagcctgtgcaggactacattcagacgttcataaagatgaggaataagtgctacagcttgagcttaactgatgctcagttagccgatttggcttttcagggcagctccaatcaggaaaaagttctcatccaaggactttgatagtttgtcacatcttgtacagaaggtaaccttgcatgagcagatgtttgcagaagccaggaaaagctttaagaaggtcaatcatgtatgtccctatatgtatggatctgatgatgatgatgatgatgatgattctgagatagcagcagccgaatgggttagaagcaagaaggttataccatgccaatgggtgaagagttctggaaaagaagaaagatatgactttgatatcacaaaggctgataagatctttgattttctacttctggagaaacagattcagcttcctgctgggcacacaatcccatcggctgaggagttaggcaagaggaggtattgcaagtggcataattctgggtctcattctaccaatgattgtaatgtctttagatagcagatccaagcagctattaaaggaggcaaaatcaagtttgatgactccaagaggccgatgaagatcgattgcaatccttttcccatcaatatggtacacattgctggacgaactgccgatgcaggaagagctagaggttttcaagtgaattcgactaagattatcgataagtattagaagaaatatgacaagcagcaggtgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccgaagccttcatcctccaggaactcctcttctgggtttgggaaaaattgagcaagactgagtacaaccaccgtactcaacaagacacacccacaagtgcagaataaatgcaaaggagtacaaaggagttacactataaagggttagggttgcagtaaacagcatttaaagacattagttgctcagggctattttgcaaacacgattctagtactatgcaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccattccatagtgtccaggtgatatgaatattcccaaagtctagagttgtaaaaccgcctaatgttacctaattaaaagcgaagcatctacctaaaatcatactagtgataccatgagtagagtgtccactagttggggttttgtttattctagggtgaacaaggaaataataacaataacaataataataaggtcataacaaaggtaaataggcatggctaaataaaacagtgataacgcgggaatttaaataaagcgataatgcaataagttaaatcaacataattttacaaactgggattcaatatgttcaaagatgatgtgacttgccttgcccgctttcccaaacgtcggcttcaacttccacgaagagcggatcttccgaagctgcagcgtctacacgaccaacggaaaagaaacggcttttactctactaaactccatataacaagcagaaacaaagcacaaaaatgggttcttgacttcttaaggaaaaattagagacttgaacggtccaattccgagttcaaatggcgaagttatggccatttgaagtttatatgctctttaaatggatatttacgaatttcttcatttaaattttaatttaaaattggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcgacgcacccgcaccccgatggtcgccgccggcgaccaccggcgcggcggagcggcgctcgagagaggggagggaagggggaagtgaaatggcggtccacggctcaccccgggtcgatggcgacgacgggaacggcgaccggagcggaggaaggcggcggcgcggctcgggtcgacgaggacggcggcgttccggcggtcggcgggcgaaacggaggggtggacgaggtcggcgaggttgcggcgaacccgaagaaggcgacgccgaaacgggagagggtccggggcgacgacggcggcggaccggagctcggcggcgacggcggagagagagagcgacggcgcgagctcgattccgacggggagagagagcggcgagggtcggaaacggcggagggaggcacggggagcgtttatatagggttgggagggggagagagcggccggatgagggggaatcggccacggaagatccggccgccattgatgcgccggcgaagttagggggaaactttccgaacgaatccgagggagagagagagggaaaagtggggggaaagagggagggaatcatggggagtgatttccccctctttattgcgcgcggggacggcgggaggcggcgggattcgcggcggcggcggcgctagggcacgggcgaggcggcgggagcggcgggaggaaggggatgacgggtgggccccacccgtcagcgagggtggcgtgcgggcccgcccgtcagcggcacgcgcgcgcggggagggggccggatgggccgcgggggagaggagagagagggagggaggtgggccgcgccggcccaagagggagagggggagggaaaagaaactttttagggtttttcttttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttacttattctatgcatagttttgaggatgtattttagagtcgttttgggacgcgacagcaggagaggcgttatgaagaagatgatggcggttttggtcctcattggggttgtgagttctttagattttgctggaatgaaggtatgaggctgccatctattgaagactgtcctgggtgtagcaatgttgcagaaagttcaagccaatcgtataatagaggcaatcggctaaggcaaacaagagttcctgttcatcaaagattgagtccagtgaaccaagactgtgaccaagaggacagtgaagacaggaagacccaatggtgtccttctggtatttttacaaataatcagaagagaagggttcaaaggttgaggaatagggaacgtttttaggaggttgagcaagagatcaaccatcggctgaagaaaacgaattcgaagcaggaatggcgcattaagaaacaagttcctacagccgatgaagtaaagagattggctagaggaaaaagtgttgtgactgcctcggttaacatggattttatactacctgcggaatttgggatcaagcaagccgatgttgatgaaattgaggaagaatcggctagattgattttatcaccagaacaagcagtctttgagaaactggaagggacagagaatcggcatcttaagccattgtatgtaaacggctatgtcaatgggaagcctatgtctaaaatgatggtcgatggtggggctgcagtgaatttgatgccttatgctacatttaggaagctaggcaggaatgctgaggatctcatcaagacaaacatggtgctcaaagactatggtggcaatccatcagaaaccaaaggagttttgaatgtagagctaacggtcagcagcaagactatccctacaacattttttgttatcgatgggaagggttcctacagcttgttgcttggaagggattggattgatgccaattgttgtattccttcaaccatgcatcaatgcttgattcaatggcaaggcgacaagattgaaatcgtgccagccgacaggtcagtcaacgttgccagtgccgatttagctctttgggagatggatggtttcgattgcttatctggaaaagtttgggatggagaatttctaaaagtatccgattgtgatatacagccaattgaagatggagagcccaagttattattttgagggcatcgtggagggttcaaacgtctataacaaggatacagtagatcatctcgatgacaagtaagaacagggtttcttgttggccgatgatttggaagaaattgacataggtccaggtgatcgaccaaggccgacatttatcagtaagaacttatctccagaatttagaaccaagttgacagagctcttaaaggaattcaaagattgctttgcttgggagtattataagatgccaggactcagccgatcgattgttgaacatcggctacctatcaaaccaggggttagaccacaccagcaacctccgagaagatgcaaagccgatatgctcgaacctgtcaaggctgagattaaacgtttatatgatgctggttttattcatccttgccgatatgccgagtgggtttctagtatagttcctgttatcaagaaaaatggcaaggttagggtgtgcattgatttcagagatttaaacaaagctaccccaaaggatgagtatccaatgccagtagccgatcagttggttgacgctgcttcagggcacaaaatattgagtttcatggatggaaatgcaggatacaatcagatcttcatggccgaagaagatatccatcagacagcttttaggtgtcatggtgcaatcggcttgtttgagtgggttgtaatgacttttggcttgaaaagtgctggagctacatatcaacgggctatgaattatatataccatgatttgatcggctggttggttgaggtctacattgacgatgtggttgttaagtctaaagagatagaggaccacatagccaatttgaggaagtttttcgagagaactaggaaatatggccaaaagatgaacccaacaaagtgtgctttcggtgtatcggctggccagtttttgggatttcttgttcatgagaggggaattgacataactcaaaggagtgttattgcaatcaagaaaattcagcctccagagaacaagacggagttacaggagatgatcggcaagataaatttcgctagaagatttatttctaatttgtctggaacattagagccttttatgccattgttaagattgaaagctgatcaaaagtttacttgggggctgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggagcatggctgtgcgctgacgatatggtcagtgtcagaccggtcgcaaatcggtcattcttgtccaccgcgtgtaatcttggcaacgtgcatgtttgcccttcttcacacaacattttgcttgtaatggttaggatgaagcctggcatatatcgatcggggctaacgtgtcatctctaagagataacacgcttaacgccggcttgagacgagtgcctagaggctttcgtcttgacgggatggggcatggcgtgcgtcagaccgccagtcgccacctaacccgtgatctgaccggtctgtgactggtcacagaccggataaagggacgcgccgtgctgcactgcgtgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcggcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagagtcgcccggggaaaaaatctgccccaggagggggtcgtgcttctgggccccgcgtcgggggctcggggagcagccgccctgccgacgccccggggaagaggaagctgggaggaacacctcccccatctcctccccgagggggcggggcagtgcgtaccagcggtcggcgcccggagggggctgcgccgacgtcacagcccgagggggagcgcaagaagaagcggctccgcaagatgggggagacggaaccagcccggggaaacctaatttcccctccaaggtggtcattcaaccgaccccctcgcaggttcgtctcattctcattgcgaccacctttctcccaaagagaagttttttcttacccattttgttcgtcttttggttttttcttctgcttcagcgatgtcccgtcgcattcctcccgccgccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaggctgctcgggaggaggccgcccgggctcgccaagccgaagaagctgcccaggaggaggccgcccgggctcgccaggctgaggcggcagctgctgctggcgcgtcactcgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggcttttctcctcttctctcgtcgccccagtgagcgccgagcccattatgcaggccttggccgccgcaaacaccgcggtgctagatggatttagcgcccaggtggaggccttgcaagcggaacgagcggagctcgaggccgcatgggcgcgtgtcgaggaggggcggcgctcggtggacgccatggtggaggtgggccgtaaggcccaccgccgccacatctcggagctcgaagcccgcaaggcggcgctggcggagatcgcccgggaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggccctcgaggcccgtgccatggcgctggaagaacatgccggcgccgtggagaggagcttgatggaccgcgaggccgccactgctctccgggaggcgacgctggcggcgcacgaggccgcctgcgccgaggaggagtccgcgctccgccttcgcgaggatgcactcgccgagcgggagcgggctctcgaggaggccgaggccacgacgcaacggctggcggacagcctctccctccgcgaggcggcgcaggaggagcaggcgcgccgcaaccttgaaagcgtccgcgccgagagagccgcgctggagcagcgggctgctggcctcgaggcgcgggagaaggagctagacgcgagggcgcctatcagcggggcggccgcgggcgaaagcgacttagccgctcgcctcgcggctgccgaacacaccgtcgctgacatgcagcgcgcgctggactcctccaccggggaggccgaggcccttcgcttggcgggcgagatcgggcccgacatgctctgggatgcggtctcccgcatgaagcgcgccggtcggcaagcgggcctctggggaggccagacgtcggtgccccccaccaatctggaaggcctcgctccgcacctcaacaggatggcttgggttctcgagcgactccccgaggagcttgagaagaccatcaaggcatcctcgagggacctcgcccggggggcggttgaactcgtgctggcgagttaccaggcccgggatcccaacttctccccctggatggcgctggaggagttccctcccgggaccgaggacgacgcgcgcgcgcgggtcggggacgctgccgaccacatcgtcaacagcttcgagggctcggcccctcggctcgcgttcgcccccagctccgacgaggagggcgacgccagcagcgaggacggcggtggcgacgaggccggcgacccgggcgcatatgaatgagcccccaggcccccgccactcttatcttttttcttgttctttcttctaaggccttcatgcctcttttttgtacaatctaacttaatctgcaatgagaaatgatgaaaaatttttgtgttagttttattttgctatatatatgagttgaggatgatctgtgccatggtccttttgcgccttagcttgaaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttaggaaattgaaactgcttctattgaaatgctgaaaggaatatatatgcatgtgtggtagcccccggctaaccctgcacacccgagggggggtgcggggttagcccgagccaaaacctgacacccgacccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacactctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcgaaagtcgagacggaccaaatatctgaggacgtctccgttcggagaggtcaacgtgacccctgcaccggcgccctgaagagacagagaaccgtcgaattgcatcacccagtgggcggcgtgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttccttgaggccatcagaatagcgtaaagcatcttctgggcctgtgggtatcgggtcttggcgtcccggagggcctcactaacaaagtagacaggccgctgcacctttcggcggggccgatcctcctcgttaggggccgtacccccggggcgttcttcgtccaagtggcccctcggggcgaactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcctgggtcgagtcagcacagggttagcctcggggccaaagggctttaagtgcagccttccctcagtggccttggggccttcctgagggtcgggggcacccagcaccgtttgacaagcgggtggagggccgactccggtcgtcgggggccttaggccaccgttcgactcgggggcctctcctccctgcctgctcccgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctgagatacgccttcaactgggcgagggcattttcagcttcctccgtccaagtgaacggccctgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttacccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattctttaacccgaagggcatttatgtataacaataggttcctacgggggtaatgaacgcagttttttcctcatcctccctagccatgcgaatctgatggtaaccagagtatgcatctagaaaacacaaaaggtcgcactccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccaccacatcgaagctcacccgctccgtgcggaagttggcgggtccaccgaaggtgaccggtaggtcgatgtgacctaacggccacgtgtgccccggcgtcacaccgatgatcggttgtgacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggtcagaagctctcgcttcatagccttgaagctccggcgagagacgtgagcacatgctcctccatcgacggtggcaatggtggctccaggttcttggaaacctagatcatcatcaccatcatcaatgtcaacagcgggggccttcttcttggcctcacttcgccgtttgtcggaaggaaccgccggggacttgccgtcacggcgttcctgcctcctgtcctcctcccacttcctcgttcgctcagccaagtttttgactgcacgacagtccgcgagatcgtggagggaggtgttgtggacggagcaccacctgccggcggggcgctccctgccgggagtaccagcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggagcatggctgtgcgctgacgatatggtcagtgtcagaccggtcgcaaatcggtcattcttgtccaccgcgtgtaatcttggcaacgtgcatgtttgcccttcttcacacaacattttgcttgtaatg

SEQ ID NO: 79624 - DNA, 846 bp, Oryza sativa
  unsure (1)..(846): unsure at all n locations
agtttggggcgtgttccgggcttaaaggaatgactgggacgatagcagattgcctgatgacgggcaacgagatgccagctgacatcactgccggagccatgaggttaggagaggatggagaaaagggttgatagtgggggtaaaattgtcgactagttaggatgggtggggtagagnacgatggtggagaaagtagacaatgaagtggtggcagcggcaactctaaccactagaggtgagggagaggttggggatggggccaatagaggagacagtaatgcggcaaaaatctaacatggtcagcggttgaatcggagaggtcaactgtgggattgtcagagaggagtataaggcttgtttggttgataccctgataggggcggacgaaaagctcgaggctcgttagctcgctcgactcggctcgtttcattttcctaacgagccgagctggcattttagctcgttagagataacgagccagctcgcgagctgcttgtgagccttaacgagccctcagcaatctgccaggccacaaagcccataggcccatttatttagaaggcccaatagacaatagtgagcactaaaagtgaaaaccctaggtcattcccttatcccttcccttccctgttccctttggctggcggctgagttctgtaggatcgaaacgcaagaactaagccaaccagaggggggggggagggtgaatggttggtatgcccaaaaacaaaaacttttagcagaaataaaagttaccctcaaattcacgagattggtctgaccgaagatgggtaccgagctcgaattcgcctatagtagtcgatgccaaaagacggtgcaagccgg

SEQ ID NO: 79625 - DNA, 10866 bp, Oryza sativa
gatggagatcgccgcccggccctcccctgttcgtcttggcggcagcgcaaggagcggaggagacaacgagatcgagacagttgatttctttttcttttacacgatatactcgactactccgccctttatctcaatatcaataattttttttgctactctcactgttctaaaataagagttgttttgcacttttcacatccaatttttgaccgtttgtcttatttgaactttttttttataatttgtatttttattgttattacttcctctggttcaggttataagactttttagcattgtccacattcatatagaatttcaggttataagattttctagcattgtccacattcatatatctatatcaggttagaaagtcttataacctgacatggaggtaatagatgataaaatatgaatagtattttacgtgtgactaatttattttaatttttcataaacttttcaaataaagagaattgcatgccattactttcaccccctgacacgaaatagccatttataaaattatgaattgcaaatttaccactgaaaacaattgggcagcgttaggctgcagcgcggtggctgcggcaggtgtcgacatcgactgtggtgcttgcggtggcttgtggcgatagctgcagcgggctgcatcaaagcaggtacaatagcaggttattttctttcttttgaggaaagtccacgggagatttggctggcagggatgtaatcatcgtttcaacctcctagacgaaaaccttgcatcctgccagattggtagaacttgtcttgacaaaatttgtacggggagatgtgttgagtagattggagcaacgtctacttctcctttttaaaaactttgcatcctgtaggagagtgaaggttggttttttggatgggataccattgcttctggatcttgtttctataccttatttgttgatctgcgggcctcggctgctagtagacgagtagttaaaagaggcggtgaaataacgaggactagaaaggtgatgcttccgacttgaaagaagatgaatgtcggctgggttgggcctcccaagccaatcttcattggagaaaccacctcctgtggtaatctcggcgaaacctccaagcaccaagtcccttatctgacatgctgctatcgatgggttagagctctaggatatgttacactagatacaagaggggagcaagctaatttagcataccacgatataactaatctggcgacttgtagtaagtggctaactttagtgcatcctcctggttggtccttgatgtggcttgtggctatagcttgcgattcaaagaaaattcaaggaaaaaaatatatgtaaccatatatgtagtggaaactatcattggattaaaaaatgaacgcctgagtaagattttactcatggttgactttgagaataatttttttacttttggtgatatggacaaatctcagacgtctatttttaagatccaacagtaatttctaagttttcactatatttgtggtttgcaatatatatttacccataattcaatacctttccctcgtaatttccactacatatatagtatttttacatgcagatgaccaatcaagtaaaacttggagactgtaagtgaggtacgagcagataagaagatcggagtcaaacatcttctcttaacggggaatgaatttccatcttatcggtaaaagtaccattccgtaaaaaactagttacatggttttcagctgttacaaatacaaataaatgaggtatatcttatcagttacactgaaaatattattatatttttaaacatatttgatatatgacctgaattgaattaaagcttatttgaacggatggttagaaaattatcatttccactgccacgaaaaatgttatgcagtagtaatactaatctactccaatggcatgctcagattagcaagatggtaatattgttaaaattttgacatgatttttatgtatttactaaatttgacgataaactaaatatatgtatttttataactttattagaaaatggtatgattgaaaatgacattaatcatatgccctaaatttactgacgtcttgtttggcaacttgagggaaggggattgggagtttacacggaattgatggtgagattaagatgtgaatttgatttttcatcctagtctcttgtttggtagaggtggtggaaattgatagggagtttagttaaagattagatcattaatgaaaacggatggctgagatttgcttagacgaagtaaaggaggaattccctcccaattatctgcccctacccaggtattgaaaaggagggagtttattcctcaattccccatcccatcccaccaaaattcccatatctcccaaccaaacaaaacagttaatagccttatccctctaaactaccaatcccttctgaaaactccctccaaccaaaaagaccgtaaaaagaaaaccaaccaaacagaccgtaaaaagaaaagaaaaggagagagagaaagaaaagggataacgcacggcgcacttcgaaacccctcctaaaccacgcgtgacccaatcgcaatggcgacgccgccggaatccctctcaccggctgcagcggcggtggaggatgattgggaggaggcgcgggggctgctgtacgaggcctacaacgagctgcagggcctggcggcggagctgggcggcgcggcggcgcccgcgccagcggtggtggtcgtcggccaccagacggacggcaagagcgcgctggtcgaggcgctgatggggttccagttcaaccacgtcggcggaggcaccaagacgcgccgccccgtcgcgctccacctccgcttcaacccgcgctgccacgccccgcgctgccgcctcctcgccggctcgggcgcgggggacgacgaggacgaagaggccggtgtcgccggccgcgcaatgccgctcgccgacatccaggtaccgtgcgcacacgtgttcgtggaaatgccagtgtcgtgtgttgcgcctatccgttccaatctgatggcatctctattatgacagcattattcatgtaattgctggtgtcatatgctagcaggaggttttgtggtgctaggaaatgatttatttgcgaaattggtgaaatataaaactcgtttaagaagaaccaggaaggggggaaatgagggcatgaggtgtatgaatgtaatgtaacgcacttcatttgtttgtgtgattatcctttctgtagctatgttatgctgtactaggctagcttaactaactctatctgtctactatgaattcaatgttgtggtttcggctagtatgatatcggtattaggtaacttaatgaatgagatcgaagggagggagccgtgttactgatattttcttaagaaaagaggattctagcctctatgggctagtacaccaactatgctgataaccgctagatgccaggagtctaacctttgccgattaaatgatgaatagatgctatattcactataaagggtagttatgtcaatactcaatataaatagttttgacgccaaactgatacgagaattttcccagttgttaattatttattattgtcaacctgaaacatcaatattttattttagctgtttcatttgtaagaaacaaatgttcacttgttgatttcattattatcaacttacagcttagaactcagagaagattcaagttattggactgttcttgcattaggtgattgacattttataggaatatttactttcaggcatacatagaagccgaaaacatgaggctggagaatgatccttcccaattttcagaaaaagaaattataataaggatagaatacaagcattgccctaatctcaccattattgacactccaggcctcatcctaccagctcctggccgtaaaaaccgagttttgcaggtatttccccctattcttgcttgctgtcagttaaggctgattcttttcagcctttaaggtcttttgtttccactgaaacttcactttctatgaccctactatgaactcctttttattatattaatatttaataaggttatccattggtaatcttgcgacctgcagagccaagcttgtgctgtagagacccttgttcgtgcgaaaataaagcataaggaaaccataatactttgccttgaagattgtagtgactggagcaatgcaactacaaggagagtggtgatgcaggtttgcactttaaaactagcttttcttatcaaaaggtgctcaatgacattctcatggtctcttgtgattccacattagttgtaccttatttactgggttactatgtttaaacaaaaggcgtgcttactatatcaagttcaaacttcaaacgttcaacacacaattattttgttaacctgtaagcagtgccagtaagctatgttttgtgtttccctttttcatactgcaggttgatcctgatcttgcaaggactgttctagtctccacaaaactggacactaaaattttacagtttgcacgagcctctgatgttgaagtctttcttcaccccccgacctgtgctctagatggttccttactgggggattatccctttttcacatcagtgccttcggggagagttggctcctgccatgaagctgtattcagatcaaatgaagagttcaagaaggtgagacatcacgtgccagtatcacttaacatagagatttatgttctgccaaagtgttcgaataattttcttttgctggcaagtttgatgggtgttactttgttaagtcactgtgagttttgtaagcaatatgtgggcaagccaattggtcatctggtcctatttgctgtgaaatttttacattatcaaggaagattacctgattattaaatgataaattagaaacaattattaatttgttttatatggatgcaaatctacattttaagtattgtaggttccagaatttaaaatttgcaggtaacttttagaatatagttatatatgtgaaaaacccatgtaggtttaaatatttttgtaggcagttgggttttactccgtagttaactattctggagttacactatatgtttcatgatagcttgtggatcttgtaatacatggaaatacccgatacttcccaaactctataaatggctacccttaaatatgctcccatatttctgcgcacttttatatgatcaagacatcacaggaagaaagtgttacaaacacataatcctacttcactactgcttatttcttagtttcagtaatgtaaatagactgatcacccttaaatattactgttcgggaaggacatttgaaatgtgacgaataacttctttgttgaacataaatgctgccagcattcttctctgttgtcacctgtttagtcagtttcagtatgctttttcgctgatatgaactctactaatctggtaacttctgtcttaccttcatccttgaattgcctctaatggttactttcattctgcaggccatctcattgagagagttggaagatgtcgcatctcttgaggacaagttgggaaggggacttacaaaggaggagaaaaacagaataggagtgagtaacttgagactatttttggaagaattgctgaggaagaggtatccttgctcattatagagctggcatgtgtatgttttttaattattcttcgtatcattgctttgaagtaatgcatactaatatggccaaggtacattgagagtgttccattaattattccacttcttgagaaggaacatcgtggtgcaacaaggaagctgcgtgaagtcaatcaagaaatcaggtgattcatgatgcctatcattcatagcacacttaaaaggatggattaatttcctccttaaattacttgtatttgtttccatataataaatttttctttggtgaagttgaaagcttataacgaaaacaaggctcaaatgttttattcttactgggaaaatcgctgccaactactagcacctaattgcaaataactgtcctggtggactatattagttgacattctagtaggctagtagcaccctcataaagattcaagaaccatcacgctaccatggtttatgttatctttcttcagtcccaatgcagtgctatcagatgcaaccttgaggccgggagctgcaacagtgcaacctccaattccttggcttctatgctatgcttcgccaaaacattcaatcatgagccaattacaagtgaaaattattccttgctttccagattgaccaagtgtagcagcagtaaatttattcactacttatttctggaatcacttacaaagttgagtgacagcctcaaaatctcaaccaatttatctccggaatagatccgatttatctgaaatctcatgctaaattatttgagcaatgccagaaccaaagaacaaatgatgaatattacacgggatattacaacaagaacatcaactgaagattggaaatttgttagccatacaatgccaaattgaaatttaactttgtactaagccttgccctgatgggtttgtttgagtcttcttagattcttttccttcttaatataatgatgcgcagctctcttgcacatttgattaaaaaaaaaagatccatcccaggcatcagcaataaatctttactgttcactgagtgaaatttaagcctcctaatattgaatggcaaggctggaagaagcaaaccaatgaccctcccagaataaaactcaaacatgttatttatttttcctttttccccttgtgtgcctttacacggttccaccatatatttatccctgttgttaaacatgcctgatataccctgctgatggtatatgtatctggacagtgatttggatgaagcaaaaatgaaggagaaagctcgcctgttccatgattcattcttgtcgaaggtgcttactactctgaaacatatattattgttgatgcagatagttggatactgaaacttttgcaatgaagaaaagttcatgcgttgtcacacatatgcagccaatgcccactggatctattgctcagcagctggttgaaataaacctgaatactgatttactgtttcttgtttcagttatctttgctattgaaaggcatggtggtggcaccgcctgatagatttggtgggtgttttatcttgtgcggctcggtaccagaaaacttgaggttcttcttagttggctgactttctgattttgtcaataatttattgaaactgttattggagtgtaggagaaactttaattaacgagaggataaatggaggaacttttactggaagtgagaatttcctgatcccaaacaaattgatgcctgtaagttctgtttttttcctctgtattgaagatgccctactattttctgtaggttcttattttgagcctttaaacaggatgtaatgattcttcactgtagataaacattttaatagattgtatctaaattggtggttcttgacgagcctaaagtttgttagcagtgacagattgatttatgtagcagtagagtcatttttctttcagataaagacaaaaagtctaccatatctatcgtcttttcagcctgttaaaacaaaattatccactgagtgtttgacacactgtcttttgaatatgcactcattataccttttcttttcttagaatgctggaatgcgtctctacggtggcgcacaataccatcgggcaatggctgaatttcgtctggttgttggaagtattagatgccctccaattactagggaggaaattgtcaatgcttgtggtgtggaagatattcatgatgggacaaactactccaggtagtctcattccatatatcaggcatactttgactatatttatatagcacatttactcattttcaactttttttgttaggactgcttgtgtgttagctgtggcaaaagcacgtgacacatttgagccttatcttcaccaggttggttagcttacctcatgggtgggcacattaataatcacatttagatggtcctgttcagctttcatgattgttattccacacttgagctactggaatagtacttgcttttgtgtgattatgtcaataaaatcatcaaccgatttttttcatgcacgtcccatcattttttggatcaagttcagaactagagtgtgccagggttccacagaaaatgtgtgaaatcaataaaaaatgtaacatgatgtataaacaaatttagtaattgaattaatttgttgtggtctgtatgaggggtgatatttcctctgcttaatccctttctgcgattaaaatctatccttaattatgtgcagctgggttttaggttattatacataatgaagagactgattccgatatctgcttttctgttggaggtactaattaatcctgaagttattcagttcaactagtattctgctcttttcttttgtaataccgtgatagaattccaacagaaagatggtgagaactgtagcagccatgatgtacttgtgaagcgtgtcaaagctgcatttgataggtttgctgaatctactgagcaatcatgtcgtgaaaggtaatactgtaagagcatccttgatttcaatacctttataattgtttcccttctagtgtacaactcttgttcaagtggtcttgcaaactcagttcaacaaactctttgatatcaaatgaaatgcatttccctagttgattattgtgctatcaggcatacagtattttatggtgttggcaaactagttagtttttttttaatagtggttctacttagaaatgtatcagctgaattataatatcattgaataataaagtgcaaatgaagtgaactgaatgagttatccgtatctttgtcatgtcttccctcctttttgatctcatggcattaaattttgtgcgttccagagcatattcatatttgaaaaatgtgattttagtggtttgtctcatgtaaatatgacacagaatttagtgttgtgtcaaagtaaaactttctgttattgtccagatttctcctgaatcttcatggcatgatgcattcatgcatattgtttgtacctgatggttcatggcatgatgcattcatgcatattgtttgtacctgatggcatgatttatctgcatgttgaaatgtgtaatgcagatgtatggaggatttggtgagcaccactcgttatgtcacttggtcccttcacaataaggtacagttattaatattaatcagaactagtatctttcgagggattcgtcgcattcctaatgatttgctacattgtatagaaccgtgccggattgagacacttctttgattcctttgttgcacaagagcaattatccgtgaacacacttactgcccactcgactgggctgcatgagcaatcctttggcttgaatgacaataagcaggataggccaaagggagacttcaaatcaagtaattcttcagaagcaaattcacccactgttgcatcagagactaggcttgttgatctcttggacagcacactatggaacagaaggctggcaccctcatctgaaagacttgtgtatgcactggttcaccagattttccatgggatcaaagagcattttcttgtcaccacagagcttaaggtctccctgcagtaaatcctgcactccttaacgagtatatgaagtttattgtttatatcttgttttgctcatcaaaattgcagttcaattgctttctcctcatgccgattgttgacaaattaccggcgcttctaagagaagaccttgaatcagccttcgaagatgatcttgacagcatatttgatgttactcagctgcgccattcacttgggcagaggaagagagatctggagatcgaattgaagcgggtactagtcttttgcgtattttttttttgcacatcaagcattactacctcagtattcttatttgcaaatttgctggtttcagatcaaacgcttaaaggagaaattcgcagagataaacaagaagctgaattctctccaggttagacagtaagctactctaggagaagcagagcaactagctactctagtcgagttagattatttctatgctgtaataataataatcccttagtgtgtaataataatagtctagtgtgattatgacttctttgttggatcttttcatgtgtaaatatacatatattaacccttccaatgtcgtttcccttccttgcaaaccgactaacaaagaacttttacgtgatgtttactgttcaattattacccttactttgctgtgagatgggttcactcaagctgaagcaaatgcaaatgaaaagctgcttatggtcacatcacatgcatggtagcgactgtttcaacccaaatccatcaccaaaaagcagcaactcttcttccccttgctcgcaacctctcaacccatcaccctaaacataggtattacccaacaccacccctctctctcccgcgcaaaccatggtggcttgctccccgcattggacaccgccaagaacgcggcgtcgtcgacgacatgaccggcggtgacaaggaccaccgccgcggcggcagcggcggcgggaaggagaccttcctacgcagcctcgaccgcgtgccgtccggcctgcacatcgacgccgacttcccctccgacgacgatgacgacgacgacgacgaggaggtccgcgtcttcttcgcctccaccatgggcgaccacaagatgtacagcttccgccaccatcaggccgccgtgctggaggaggaggaggaggacgacgacgacgacgagttctccaagtatgacatggacgaggacatgtcgatacaggagcggcgccgccgtcttcaccaggggctcggcctcgccagcagccgggacctcgcgctccggcgacat

SEQ ID NO: 79626 - DNA, 93003 bp, Oryza sativa
cggcgaagcccatcacgcggcgccggtccgacggctgcctctccgcgcgggacggcggctcctgtggaaagccaccccgccgtcgtcgccgtcggtgcgtcgtgttcgatccttgccggcccggcacgccggctgcgacgatgtctccctcgtcgagaagtttcgaaacgccatggctaaacgtgatctccccaccgccgccgtgcccccgacgacgccgccgccggcggcggcagcggttgcggcagcgccggtggataaaggccgcaccgacgacggcggcggcaaggaccgcgacgacgcgaccaagaaccaggagagcagcaaggaggtcgccgtcgtcgcggcgcccaaggatgccgcccccgcgtcgaacacccagaccggcgtgcagctggggctagaggagatcgagaagttcatcggcaacacccccatcgtgaagcacctgatgcggcgcggccagagccagcatcacagcggccagctcgcgtcgccctccggcggcgcgccgcccaaggccgagaagccggcgggcggcaagaagaagggaggctggctcaagaacatcaagtccgtcgccatcggcttcatcgacagcggcggcaacagcaagtcgaccacatccacgaccacctcctccgccggcgccaacgccacctcgtcgtcgtcatcctcggcgtcgtcgacggagcggctcaaggtgcaccaatccggcaagtcgtgcaaggagctcaccgggctgtacatgtgccaggagatcatggcgcacgaggggtcgatctggagcatcaagttcagcaccgacggccggtggctggccagcgccggcgaggaccacgtggtgcgcatctggcaggtggtggaggcgaactccccggcgtgcctgccgaacgacggccactcgggccccctcccgccgcatccccccggcgccgcgccggcggacgggacgtcgtcgtcgtcgacgccagcgctgtcccagctgtccaagaagtcggtgaaggggaagagcggcagggacacgctgccggagcacctcgtcgtccccgacaaggtgttcgcgctcgccgaccagccggcgtgcgtcctcgagggccaccaggacgacgtgctcgacctcacctggtccaagaccgaccagcttctctcctcctccatggacaagacggtgaggctttgggacaccaccaccaaggcctgcctcaaggtgttcgcccacaacgactacggtcagcgtcgccattgattcgtttctttgtttcgaaatcgatatctcttgacaataatccatctcaagaattgaattgaattgatttgatcgatcttgcagtgacttgcatccagttcaacccggcggacgacaggttcttcatcagtggatcgctggacgccaaggtgcggctatggagtatccctgatcggcaggtcgtcgactggaccgacctcaacgagatggtcaccgccgcctcctacacccccgatggccaggtatctactctcgctagtctaatataaagtgaattgtccgttttttctcatcagcttaagctttttaagttgaactagttggtgcatacaactcaatattcactgtcatttcatcttccatagctcaacaattccgtatccattttacttctctttttttctctgaattctgatgtgtgaacaattcgaatcaagggcgccatcatcggctcgcacaagggtagctgccggttctacaagacaacaggtagtacagtacattctctgttcttcattgactcatcagatgatcagactgacatccagttgcactgaagtgatcaatttgattgcggatttttttgggttttgttgcagattgcaagctggatcaggaggcgcagatcgacatcgagacgaagaagcgcaagtcgcaggcgaagaagatcaccggcttccaggtacatgaacacaatgcatcacactttgactagctgctgaaatttaagagcttggcaagaacatggcctaattgttcatcttggccatggccatggacacctcagtttgctccggggaacccctccgaggtgctggtcacctccgccgactcgcagatccgcgtcttcgacggcgtcaccatggtccaaaaattcagaggtgcgctggcggcggccatggatgagaaaatctcagctctaattgaaaatcagagagatcaattaatggtggtggtgtccgtggtggatgtcaggtttcaagaacacgagcagccagatctcggcggcgtacacgtcggacgggcggtacgtggtgtgcccgagcgaggactcgcacgtctacctgtggcgcgcggcgcgcggcgcgccgccggcggcggcggccatcggcagcatcggcggcatcggcatgaagcccaagacgtggtgcaccatccgctccttcgagaacttctactgcaaggacgtctccgccgccgtgccgtggccgctggccccctccggcgccggcggcgacgggtcgacctccggcagctcgccgtcgcggcggcagggcggcgtgtcgtgcaccgacgacgtgtgcagcatgccggcgaagagcggcgagctgggcagcgccgggacgccgctgacgcactccggccagctaggctcgccggcgccagaaggcggcaagggcggcgccgacggcaatgcgtggggattggtggtggtgacggcgagcttacagggcgagattagggtttatcaaaactttggaatgccgttcaggataagaggccagggtaacctgttctactgactactgaacaaatgctgccatgcgtatgaacatttttgatgattttattttttttcgtaatttttttatccattttcagaactgagaagtgtgtgtgcttagatctagtacatgtgcaatatgttcagttgactaccatatgtaggtagtagaattatggattaatttcgccatgtaacaagttagtgaattagtgggatgtacatccaactctacaaaatgaaattcattacatttgtctttgtaccaaatttgcactacacacaccataattatatagcacatgatactgctgtgtaaaaacaactagattagcaatatacttatatatttttagaaatatcttaaatcgtttaaaatctctgatggctggttgacattggccattccattcttcaacatcttcctaaaatcctagtggccgccatcggtttcctcttgaccttgtcaatgccgataaacataaactttcctcatggttaaaggggagttgagagaaaagagaggaggagagcagtggctttccagtttccccactaaacaacaacgctatccgaattcaaatcctattttccaaattcaacaagaattatactacgttagattgttttgaccaagacgtgtttattttaggctttcattcacttttatattttatcaataaaatacttcccattggccaccaaatgtgtggcaggggagaaggaaaaaaattaatgagggcaagattgaaatgtgtaccccgggacttaaggggatctatgttatgggggaaacaaatcctccaacttaactgcacgctgcagttgagtcactgacatgtcgatcccatttttctatagcccacatgtcatggtttaactgcacaacagttataggatcccttcccaatctacattatagtggggagctactagtaacgataaaatcagtttgtgattcaatagcatgaacattgcatctgaaagagtcattcacaatgcatcaaatgcatcaacttggtatgttggtgcaatttggtacaagaatttaaaaaatgtgcgctctagctagcgcaacaaggtgtgtgcaatttagtgtaggaactttataagttagcgtacaagtgcaacaacttgcaatgtgtgtgtgttttctatacaacaagttaagaagtcatgcgataacttaattatttcaaagaattttttgtaatatacattgtcagggctatggataccacatacccaatagtaattgactaagctcggcggaacccaccatataccaagtcttatatggaattatacttcgtatatagaaggagatctggataaggcatggcaaaaaagagttctacatggaaactataaagactactcggattgtatccatattggtctccttagttctacttgaatagggggacatatatgggtataaatacaagaccccctagggaggggaagacaagtccagacaaatcaagaagctcagttagaatagacacaaatacacaccgccagacatcgacatcaaagatcagcctaaacaaacccaatctggtgcgatcagtggccaacaaaagggatctagcgctatctccgatctcgtcgagtatgtattcgaggaggaagactaccccatcatcgactacgagttggtgttccatgccgccaagtcaacgatgactagataagttatcccaaatattgtacttgtttgattatgatgaataagagcaataccggctccggtcaataggagtagggttattaccttccggtgaaggagcccgaacttatataaaaatcatttgtctctatcacttttaccttaatctcgcatataccatggtaccaacaatccccataccatgcaaatactgtaattgtgatctaaaacgtcaacaacactgattgtatttagcttattttggattgtaagtactacttcagtgaaatccagaagcaagtaaaacacttgtttctcttagctagaagaacatctccggtccacctccaccatcaccggcaacagcttgcacctgcggcacaaggtgacaaagaagagacgccatggatggatggcgagctcagctcagctctgaatgggggaaatggcgaaagaatgtggtatgtagtgaccttttcttgagcttggagaaaaaatggtcggcgtggaggaggtcgtatgatctagggtaggtgctgaaggactcgcaccagtcatggtacatgccgaacagccctcgctcgtagatgatcggcagcgtgtccggcgagtccaccgacaccacgttcatcacccacacattcatgtccttcaacgctgccgcgaacctgatcaaggaagaagatgacaatgccattgatgcgatgcgagatgagatgtttggatgagagtggattttaaactgtcgagggaatgtccccttatttactttttttcttataaattcaatgcaaatagttgtaaaacattataaattttttttgataataatatagaatataacaacatctatcagtacataaaaatcaagttaaatgcaacctacagataaaaaattcgggtgtaatatctcgatgagtgagctgagtttggatttaaaattttgtgaagtgatatatctatatatcctgtatgggtgttgtcaaaaaaattttaagatttttttttataatcgtttgaatggttttttaaaataaactggagggatcaagatagtttccaatcgtgtagtggtgtcgtacccgccgtagacggctagcttgtccatgacgttcctgacgttgctccagtcgatgctgacgccagcgaggtacgagctattgacgacgtggccccagtgccacatcccataaccacggagtccggcagggcgtaccttcctccagcctactacactctctcgaaagaagagaagattcatttgctgacatgtctgagtggtataaaggttccatctagttactcatcaaaaattaggaggtttgtttcacttcaagaccttaaattgatagtaatgaagtcgcatgattgccacgttcttatcacacagcttttggtgggcaggcggtgcatgcacgcccgcagcgtgatgttccacgtggcgtcggggtcatcgtcggcgtcgcagagcggcagctccgtctgctgtagcgaattctgtccaattcaaaaaaaaaagaattatatgtgacgcggtaaaaaaaatcgaatcctattatatgtgacacagtactatatatctctatcctctctatctctttctcttctctactacttaaaaaattgaaacgtttccgtcagccgtaataacgaaaaaatgacgaaaaaaactttaaaacaaagaaaaaagaaagtccgattcaatttacttccgtcgtccgtgaaaatcttatcttatcttaatctcaatctttccgaggggaccgagcggcgccctccgttcctgcctgcgcgatgaaacgccggccaaagcaaaaaaaaaaacaaaattgagcaaaggaataaactagattgaagttcccaaaattaaaagaggataaacaatattgaaactccccaaactcaaaaagagggaataaaataaattgaaatttcccgacaaaattccccaaattcgaagggccctaatttcaggtaagaaccctaagagtcaaaatccaaatcaattaagataagggtttgggttacttgccggacttgaagcccctaagctcaccggagctttccgggaagggcaccaccgcaccttcaccctcctcacagtcgcgtcgggttccccgtgcgcgcgctatcctggagcaccccttcaccgtcccttgccgaagacgggaagcgtcggcttggcgttgcccctcccgccgatgaggtccaggccgctcggcgctcgtcgccatttgcgtgcccgcctagcaggactgccaacgccatggcaccaatttgcgccgccctcgggtgcgcccccagctggcgaagcaggagccgctcggcggtcgtcaccgcacgcacgcaccagctcaccggaccgccatcgccgccttcgccgtcgttccgctcgctggtccccggagagaaattggatcaggagagagggatttgggagctagggttttgcccctctctcctggtcggcgcttcatccagcgcggggacgatcggagctgtgcattagatcggatggcttagattcgcccaacgtcgagctgccgtcgccgctgattacgctacgcccaatgggccgtggaagtgcattgagccgtcctcacatatgtgggctgcgctcagctgctcggcttgcgggccgtcgaattaacttggctcgccgaagatgggctcgttgaagtttgggccagcttgggaagatccgggccaaaagaaaatttgatcaaccaatgtggctcagatttttttaaattaaagtccgtcggataaacttctaagtaggctcgaaaaaataaatctaaaactaaatcctaaatcctatactaattcatcaaattagactcggttctacctatttgttcatatatcaaattagacttgatttttaccgatttgaggttttcaaggtgtcacactatcaaaatggtgtttttcccgttgcaacgcatgggcactattgctagcagagtataaaactaaaaatagtttgaaaataattatctataagcaacgatgacgaagaaagtttgtggagaattcgtacttttgaagcatggcaggtgttattaggttgatattacatatttatatgtttgtcaaatacaacccacaatgcataccacacacattcctgaaggttatatttctagttactatgaataaggtaatggcagaggtgactattgatataatcatgcaatcttaggtcccatagacttagaattttctttaagaactgcctttctctgtgtttctttactgagattttgcacaatgctctgaacaatacggtacggacttggttgctggtgctgatcaaatattggtcacatggtgctgtacaccgggatatgttttgctgttggtcctcttgcacggctattaacaatcctgaagaggatgatagacaaccttttttttgaaaatttcattccgaaattatggaatccatttgacaaatcaaaataatatataatcgcaacttcacaaagagataaaaaaacgcaaattacattggttactaaaaaagtactatgacttgaatgtagaagttgataacacataactagcttagagcgttagacacccagttatgttcgatcactaagctagcttatggttcaatcgtgatattgatggtggcatggctggcagtgctgccattgacgtcgtcgtcattgctgacaggggcgacgatgctggtgtccttggcgatgggggcgacggttggcagctcaaggttcttatcctgcttcttgggtgtggtccggtagtagatggcatagaggatgagttgcatgatagcaaagagcacgccaagaccattggggatggtgatgaagatgtcgaagcggatgagcgcgtataacgtccagcaaaggccgttgaggaagctcaccaccgatagcagcaacggcatgtactccacgctcttcgtcttcacaaccatgatggtgagtggtgaggagtacatgatggtgccaaagatgacgcagaggataccgacgatcaaagagcgcctctgatgggtgtgcgcgcccaaaagcacaccgaccgctaccgccgccatgaagagagcctccgtagcgagcaccactcccattttcttcttgttcttcttgtcggagaagaggaagaagatggtaaggtagacggcctctatgacgaggctaatgccgttgatggtgacgacgaggatgctgttgggatggacgatagggaggacgtagaagacccaaagcatatgcaattgagtagcgtggccaggtacgggtccgccttgaagttctgcacattcttattcttgatgatccgccagaaaatgggcaccggcgagaggaagaggccaaaggagatgacgttgccgacgatgcccaccacgttgcggatcaagtccggggacaccatctcgccggctggtggcggcggacgtcgatcgccttcctgtttgcttggtttgcgcgctgaaaatatttcaggctgaaattgctcgcctgatcgtacacgtagcggttggtgttggtttggttggtagctcgttgaagcggcgtagggctggatttatacacgtcgcgtacgtccgaggtacgctctggaatctggatagggtcggtgtcggagtcccggtgacggggaacaaaattaggaaagctcgttccgtgtcggccaccatttccgagtcggaataagttcatctgaggtcccttaacttatcaacgaattcgattttcgtccttgaaccccaaaaccagatataacgggtccctcaactatcaaaaccggtgcatataaggtccctcggcggtttagatggtggttttggctgacgtggcagctacgtggcgaatttgactcggtcacgtggtgcttacgtggcaattcgaccaaaaaataataataaaccttgtggggcccacatatcagtttcatatacaaattaataaaaatggtgggacccacgtgggccccacaagtcattctcaccctcatcttcttcctcctgacctcaccatctgcggccccgccaccgtttccaccgtcctccacgccgctcactgacctcgacggcgtcctcgctatgggtggtggcgggcgagctcccgcttctctccacctgcttccccgccgccgctgtcgaagacgacgacgccgatggcgacgggtttgaggagggcaccgggccaccgatgcggctattgggcgtcggcggcgcgggagcagggcggtggcggcgcgcagggccacagggtgcaagcggcggtggcgtcaaggagggcgtcggcggcgcgcggggccccagggcgcaagcggtagtgactagtgactggcggcggtggcgcaggagcggagcgtcgggacgcaagcggcgccgtggaggagggcgtcgtcggcgtcgggcgcccttgatctggtcggccgccagcttccggaagcgaacggtgagcacgtcgccattttctccttctcccctctccacgacttcacagggattggaaactgcttgctgcagttgctgttcgattctatttctacaattctactcacgatacaatccattatttccctcagtaaatcccgttgaaatttgaacaaaattcagtgccaaaatgttcgctcacatcacacacgctgcagcatgacaaacaaatgttcgctctacacacttacgaaccaccggatttcggcggcggctgctacggcgacggagtgcagattcatcaccctgacgaggctgctaccgtcctcgccgtacctgatgaggtggccgtacatccgcagccagtggtcggaggcctcgtcgacggtgcggtaggtccagatgtgtggtctgagccagaggcagtcgacgtgctcaccccacgtgcctcgtcttccatgctgatagtggctgcgggggggtcttcgtccggtgctccagccgcgggcgaggctgacgcagccgcagccgcagccggcacacgacgccatcgaaggtccgtgacgtgcctgtcgtcggaccggataccggcgacgccgaggccgggcaagcactcgacgaggttagcctcagctcggtcaccgttcctgcctcagtggtaacagccgaagcaggtagaggggctggagatcatcgaggtcgccactggcgagcggctgtcccgccggcttcgtgcgccgccgctccggctgccgtcgccccactccgcccgccgcccaagtccacatcgtaggaaagaagagagagaggggatagcaggaagaagagagcagtgaggatgacatgtggggcccacgtgggtccaaccttttttttttgaaactgaccatgtgggccccacaattttattatttttctagatcgaattgccacgtcagcgccacgtcagataaagaccaagtcaaaatagccacgtaagcaccacgtcatccaaaaccgccctctaaaccgccgggggaccttatctgcaccggttttaatagttgagggacccgttgtatctggttttggtgttcaaggacgaaaatcggattcgttgacaagttaagggacctcggatgaacttattccttccgagtctgagcagcgtacggcccatgggccatggccaaacggacagatcagggcccgctgggctaactatgcgtgggatggagggagttcatgtttcgctcttgttcagttgtttgtacgccatttgtttcggttgaggtccccaactacccatcggttgatctagttttattataagctgtaacggcttattagcgattaaaaaagatatgtaagtaaaatttttttgtatatatgttcttagtgatcgaaaagccaaagtagaaaaaaattatgttgaaaaagaattaaaatcaaattcaaaattaagttttaaaattcaaattttggctttggcttataagccatagggcaaacaataaggccatgtgatttaacgaaaatggtattttgcgggcgcgttgagggagaatactccccagatcgaccccagtccagccctgcacgaggccttttttttttttttggctgtcaccattcttgtaggagagaacccattctataccatcgagtttgttcgagtccaacgatttgccatcgacattatatctttctatagtataccagcgacttttatcaattgttctacgatataccattaagttgagccttctttttaaaaatacctaaaatgcccttatagacatataaggttaacaattgatttatcctattagaagtttcagaaaaatatgaaaacttttacgttgcctctataaacaacatggaaattcgtatagaagtttcaagttgttacatttctattttttataaaaaaatataacttatttgttatatgtcatataaaatactttttattgttgtttataatataaatcatatttcataaactacataaggtatttttgtggtattatctcttttataagcatattttctctcatatacgacataaaagtattttttttctaaaaattaagtatccagaaaaaacttgaaacttgtatacaaacttctatgttgtgtacataggccacagaaaaattttcatatttttgagaaacttctaatagaataaatcaattgttaattttttgtctctagggtattttgggtatttttgaaaataaggcccaaccaaatggtgtattatagaacaaggtgataaagtcgttggtatattatagaaagaaacaatgtcgatggcatatcattgaactcggtatagaatggattctctcttcttgtagtgtttattattgctattatttgaactagaaggtagcccgcgcattcgcgcaggcattattttagtttgaaaatttgtccaatgtataaattcaagttcaaattgaaagtaagatattttttcctttttctaattgagcgttcatcggcactctcttttcctaagaaatttgcagaaactttgatttctaacgaatgtattttacttgtaacattaggctagtgctttcttaagattggatgcttgggatttttggtcagtgtagtgctgaacttctaatacttataattgattgtccgactggatttagatcgatccttttgtgccttgtaagctgtatatacacggacgaacaccgtcgctagatcggacatgacggatttttttccctacaaacggatgggagtttgtgatagagatagagaattggacatattcaatttttttcgcttttttttaccgcgtcgatggaatcggattcttttttttcgcctgatttttttttttcacggacgacggaaacatttcttatttttttaatagtagagattaataaaatacttaccattggccaccaaatgtgtggcaggggagaaggaaaaaaattaatgagggcaagattgaaatgtgtaccctggaacttataaggggatctatgttatgggggaagcagatcctccaacttaactatagatgcaagtcactgacatgtggatgttattttgctatggcttatatgtcatggctcaactgcacaacagttaagttgtaggatcctttccttatttacattatagtgaggagctacgatagtaacgataaaatcagtttgtgattcaatagcatgaacattacatctaaaaagagtaaattgcattcacaatgcatcaacttggtatgttgctgcaatttggtacaggaattaaaaaatgtgtgctctagcgcaacgaggtgtgtgcaatttagtgtaggaactttataagtgagcgtataagtggaacaacttgtaatgggtgtgcgcttttgatacaacaagttaagaagtgatgcgacaacttaattattacaaacattttttaatacacgttaaattttaagtactactattttgtcaatatactgtgtgtatttttaagcatgtttataatttcgttcagacaactgaaagtgaattaaactttactatgtagaaaatattatatttcggttgagatttgagaatatgaagaaaaaaaatcaaaccagatgtgcaaataggatgtgtaacgtaattcttagagattgaattcaagattataaggtagtatctgtaggattgctatgtgatgacatattgacatcgtgaaaaaaactcaactagtattttttaaccaaaacaacgtgtacctagccaagttgttgcagcataatactaaattactaagttcttgtactataccgtatccttttactgagttgttgtatggtggttcaatttactctcagcctcatcggatggccaaatgctttagctgatcagccatttaagtaaaataagctaaccaatatgcattgaagtttggctaaattggaggtagctttggctgatcagacaaagcatttggccatccgatgaggcgctctctaaacaatactgtggtggcgtgtacagtagctctatcatctcatccgcccattctagaactaatggtataaatgcatgacaactagcaaatgcaccgcgctgttcacctctactggttccggatcccatttgcagaaatcaaaactgctcttcaaacgctcaattatggtttatgctcttgtgtgacttaagtgtacttgttaacaatatcacaaattgccgcgcaaactaaattgtcactcactatgcaaactaaaagttgtttacgttttgggctaaagcaaaaaataaatcaattcacatgccggtagcatgagaaatatggtgcgagcggaacaaatgagcatttcagaatcaggaaaaatccctgccgcggctgctagacaatatacaggacgaaatcaagctatggaagatatgtggaacaacaaatatcacgagattatctgcctagaacattttcattgttttagtagtagcttctttctctcccctctctctctctttcaccattttggtgatcttgtaaatactttttcatcccctacttaatataagaccagctttgctggcttcgttttttttaaaaaaaaagttgtttacgttttgggctattctggccttgtttttctttttttttcttcaatagaaaagacaggaactatgtccatcaattaagggtgatcaagatccacataagagccaaatgtaggccgactgggatttaagatgactgttcaggccttgttgtctccaataatttgtccccaatttgtttcgttcaatctcgcttggaaaagtttgtattaaggatattctagccgatcacgtgtaatcagctggaatatccctaatagtttgaacatgcctcaattctacacaaacctactgaattaaccatctctcttttgtaaaacttgtatacaaaactcaattatgacatgtctaatttctactcaaatctaccatcatttttttattacaacgtgccacaatatttgccaaaactctttttctggtgctaagcactactagccatgatcatcaacttcttccctactagctcgccgtcgtcgccgccttctcgacttccttgggccgccacatcgtcttctcggcgcagagcatcacctctccctgcttggacaccgtcatcctcacctcccagtgcaacgacctcaggatgctctccacctccgccgccgtgtcgcggccgtcccgcacgatcagcttcccctccggccgcaggatccggtccacctcgaccatcaccggcaacagcttgcacctgcacaaggtgatagagaagagacaccatggatggctagctcagctctgaatgggggaaatgacgaaagaatgtactccctccgttccacattataattcgctttgacttttttggccaaaaaagtcaaagcgaattataatgtggaatgtaaggagtagtatgtagtgaccttttcttgagcttggagaagagatggtcggcgtggaggaggtcgtatgatcgagggtaggtgctgaaggactcgcaccagtcgtggtacatgccaaacagccctcgctcatagatgatcggcagcgtgtccgccgagtccactggcaccacgttcatcacccacacattcatgtccttcaatgccgccgcgaacctgatcgaggaagaagatgacaatgtcattgatgcgatgcgatgcagggtgtttggatgggagtggattttaaaccgttgaggggatgtcccgttatttatcttttttcttttaaattcaatgtaaatagttgtagaacattctaaaaaatttaataatgtagagtataacaacatctatcagtacttaaaaatcaagttaaatgcaacccacaaataaaaaattcggatgtgaacagtacaatactattcatatgttaaatttagttttttaatatctcaatgtttcggctgagtttggatttaaaattttgtgaagtgatatgttgtatgagtgttattaaaattctttaagattttttttataatcgttggaatgtttttttaaacaaactcgaggcatcaaaatagtttccaatcgtgtagtggtgtcgtacccgccatacacggctcgcatgtccatgacgttcctgacgttgctccagtcgatgccgacgccggcgaggtacgagctgttgacgacgtggttccagtgctcctcgtccgccgcgaagtcgtctggcgccggcttgccgtagacgccgacctggctgtgcgacagccagtagggcgccgccgacatccgctccggccacagctccggccaccgcgcgccgcggacggacttgttggtgggcaggcggtgcatgcacgcccgcagcgtgatgttccacgcggcgttggggtcgtcgtcggcgtcgcagagcggcggctccggcttctcccggttgctgtagcagccgttgctcgtcggcttcttgaagatcaccatggccgtctcgtccacggtgtcgttcgtcttcttcaccatcttccagcacatggacttggtgagcgccgccatgtctgcgtgcggcgcagcgcggcgcggcgaggagtaagagcgaggcatatgagatgagaagaattaatgggggaggggagctcaccgtgccagatctggacgtcctccggcgtcttccggtagaccggcgtggcggaccagacgaagaggccgccggggcggaggaggcggttgacctcgaggaggagcttgccgccccagatgtgccatggcacgcggcagcgcgcgcagtggacggcgtcgtaggcgccgccggggaaggggaggcgcttggtgcccatgacggcggagatggccgggatgccgcgctccagcgcgaactgcacctgcgcctcgtgctcgtccttgggcgccagcgacatggtgagcgcgtcgcggtcgaacaggaagccgccgaagctggccacgccgcagccgacgtcgagcacgacgcggctgcgccgcccccacgccaccgccgggaccgcctcctcgatcaggtcgatgtagtgcgccgcgccgtttatgaactgcgtcccgccgccggggaacgtcaggtgctcgccggagaccttcacccagttctggtgccccttgtacgacgccagcttggtgtgcggcacgttgtggtaccagatcttgtcgcggctgtacggccacgggatcggccgccggtagccgccggggagcgggacgaggcacgtcggcgccgcggcggggcagtgtcgctcacggtgctcgtagtgcttggtcgtcttgagcttcttgatcgccgcctcgttgtccaggcacgggatgtagtcctcgccggtgctcacgttgcagagcttccacccgtgcgccaccgccaccgccgccgccgccgccgtgtcgctgccgttgctcttgttcttgtttctgtcgcgcgccttcttctcggcgctcgactccgacgcctgcgtcgggaacgagccgttctgcgccaccgccgacgccgtctcgttcagcagctcagcctggccgctcgggaggagctcctgctccgccgccggattgatcttttcggtggcggcggcggcggcggcggcgctgttcgccggcgcgtcgtcctctgttgtttgggagactgtgccattgctgctgtccacggctgcgagtgtcgtcgtcgtcgtcgtcgtcgtgttcgagtcgtcgttcatgtcgctgatagtttggttgttcgatgacgcgccggtggccgtgtcgtcgtcggtggtttgcgcctcgccgccgccgccgccgtcgtcgccattggtgggaacttgttcggagctcttctccgtgaccttgccgtcctctgccaccgtctcgacgccgtccatcttcccgttctcgtcgtcgaatgacgtctggttcttcgacggcgtgccgccgtcgccggtcgccttcgcgtcggtgggcgtatcgtcggagctcttgtcagccttagtctcggtggaagcctcatcggcgttctcgccggcgtccttggtgtccctgggctcctccgccgtgctgttctttttccccttcgtgtccgtcgacggcgcctcgtcggcatcgccgctggcttggtcgccggtgtccttgccgtcggttggcgcatcgtcggcgctctgcttgtcgggatcttctgggctcaccacctcgccgccctccgtcttgccgttctcgtcggagaatgtctggttcttcgacgtcgtcgtcgtctcgccgtcgcctaccttgtcgccggcgggcttgccggactcccccgcccccgtgcctccggtggtggtcttggcgaccgcatccgtcgccgtttgcgtgtcaacgccgccgcctttcacgccggtgtccccgacgtcgtccgtcgtcttcgccgtgtcgccggcatcttggactttcttgccaacgtcgtcggctgcctcgtccgtagttcgcggcgtgtcgccgccatcgccgccgccgccgcgacccttgacgccgtcggtgacgtcgatggacgacgcgtcgtcctccttgaccaccgccggcggcttgtcctccggcgacacggccatcgggacgtttcccgtcgacgacatcatccacgcgccgacgaggcagagcgccacgaacaggacgatggtcgccgtcgagcaggacgacggcgaagaacggcgtcctccgccgccgccgccgccgttgccatccagccgctggtaccgatcccgatcaaacaacggcatcttgtgacaggctcacagctagctcatgcagtaggcacttcacactctctgcacattcacacaggaaaggcttattagcctcttattttggagtgaacaaattatgtgtaaattgatctgggatttgaaatccaaattccacatcagtaacaatctaatcacactgatcaatatagcatattattactccagtaagaaactgtctgagtatcttatttagacagtttatttgtttatgttatgtggacagagacactgtctgaaatgttgcaaatgctaatgacaagaaacaataatggaattcctgtttacagatcagattgtttgggttattactacctacattatacaaaagaaggtgatctattagttaaacatgcgccaaaattcaacaaaattaagcacaaatgaaacgaacatcctagcataattagcaaccaagaaacagtacaacaaaacaacatcctggattgaaactgacctgatgagtgatgaattgaacacactcaaaaaaatctccaaatcaattgatcctcaaaccaatcgaacggttgcgaaagcgagatcaaatatgcaccattacttatatatgcagctagcagccacagtactagatcgatctcgagctgttgctttgcttgggagaagagaagaagaagaagaagtgaagtagagagagaaagtgaggcagatgaagagagagagaaattcaaaatgcaatctaccccgtttctatttcccaacaagaagcaaccggggcatggacgcatgcgtcgtctccttgttcctctcgttggctaatcttttattagcgcggggagtttgtgttaagggaggattacgcgggaagcgaggagaaaatggggtgacgtccacgaacaccactctctccgggtttttggcgccatcaccatgcaaaattgcaaactatgcagaaatggatcgaattaattaattagctggatcaaatcaatgggaaattaaagagaagttttcattcacgaacaagggtcgagtgcttctcaaattttggcgattgaatggggaatatttcttatatatggccacatttgaaacgcaggatataataaacacaaaaagaaattagaaaaaatgcaggaattgaaggggtgtgtttcttttatcttacaggaatgaaaaacaaatgaaaaatgaagataatcccttcaataacagaaaacaaacaaagaaaaaggtttccaaaattgttggacgtcttcttcttttttcctatgaaattggctatagaaatgcaatcctatgaaaaatttccattcccttcttacgaacatataaaaattccttagaaaactgaatcctccaaaatttgtaaagcaatcctccaattcgaagggaccttagagtaaagatatatcgttgttgagatatgaaagtaggtgtaaacataattatatttttggaacggacgaatacattgctggaaattccatggtgcaggatgaaagatgcatgtacttactggtgaagtgtagctgactctacaggagttgacgcgtcaaggggaagcttggctggctaatcctttccatgcattatataccgttttctttttcatgcttcttatacacttcgtgtgcaactaattaatagagagtaaatttcataaaactgcaactttagtgacaaaactatcagtttgctgcaacattagcgacatgtttcagtttgctgcgacaatagtgtgggaaattatcacaaaactgcaacttttacgttatatgctgctacagtactagttttgtcactaaagttatagtttttggaaatttactcattaataaatccgctggttaggagtaagcatgcaaaagttgttcttccacctgttgcaacatgctaacatatcctgtttttctttagcaagagagagcaacgactttcagcctcaaaattgcttgctcatagtcattgcatcaccaaactttaagcatctacggtttaaataaatactaaaatggaaaaataataagacaaacaaattaattatccacacgatcttgacaactatacactgaaaaagttttgaggttttagtcttcatgacgatacctccaacttcctaaggagtaaaattcgtgtgctcgtcgctagatgcaatcaacaaagattatataaagggatttcaccaaatctcaggtattattctcaactaacctcgttaagaccaccacagcaagcaaaaataagtcttggagctctactcacttattggtggaacatctggttagggaggaattggaggatttagatcagcgagcccgtcgtaaaagctgtgttatttaacccttgtaacctctcaagtctcaaaagttgtaacctcatctattctccattttccctaaaccttttgtattatctgacttttactctttctcagttatatccggcagagcacttgtcattgttggtttcagaaaaagataatgtattagaaaagggaaagcgaccaatttgattctattgcaaaaacaagcaattaaagcctagacatggagttttcatcctatggaaaaaaaatacaatagctctaccacaatatttaatccaatcctatggatgcacatggtcattataatttcaaagtctagtttaaatcatatttcatatttgtaacctaaagtaaaaattccatgcaactggactcccaaaattatttccaacagattattcagcatcgatatcaaaatcagtaatgtgagctatgactgtgtgacagaaacccacggttcatctttccaattgagcacggaatcctgactcctagcagtttgaatgattttctccaaattttggtcaaatttactgttttaattttgaattctcaaaaaccatttaataattaactcgcactccacttttatccaacatcaaaaccttcaaaagtttacaatttttgtacatttttatcgcaaacgtgaaccctgtagagtgcagacacgattctcgcgtgtttacttttctacttcttctgtcctaaaaatatatatggtactctcttcgtttttagtatacgacgccgttgactttttaagatacgttagaccattagtcttattaaaaaaatataattattatttattttattgtgacttgatttatcgttaaatgtttttttaagtatgacttaaattttttatatttgcacataaattttgaataagacgaatgttcaaatgtttatcaaaatatcaacggcgtcatatattgaaaaatgagcagtatgagatttaacatattttagtactatatagatttgaatagatctttcttcatatttatatagtatcaaatcttttattataggttgctatatattctacaacaaaagatttaatcttcccaaactcaaacaaacggaaaaaaagaagcaaaccactccccaaacggccaaaccccccccccccccccccaaacccttcctctcccctcgactccggcgccgacatggccgtcgtgcaccgcatcctccgccgcgggctctccgccgcctctcccctcccttctttccgcggcctcctcctcgtctcccctcaggtaccacctattcacgctcccctcggcgtccattacccgcgccggcgcacggtttcttgattttttttatcggtgatgtttctttcgctttccccgcgaaggagctcggcaggcgtccggcgagctcgtcgtcgtcggcggcggcggctgcgggggacgtggaggctgagctgcgcgccgcgcgggaggacgtcaggcagctgctcaagtccaacccctgccatcccatcctggtaccctgtacaaaaatttttagattatctgtctagctgtcaaattttgcatctgtaaacaagttcgttatcactgtgatatgtagtgaactagtgctaacaatatggtctatgtgattgcgtgtttagttaactggtagattatgctgttcgaaccaataattttagactttgaggggatgactgatgaggaatagctatttttttttagtattcgctatatttgcgtggttcatggttgtgcatcttcttgatcaaacatgcatatttatgacatgtctgctgagttaccattggtttcaggttcggttagggtggcatgacgctggcacttacgataagaacatcactgaatggccaaagtgtggtggtgcgaatggtagcttgagatttggagttgagttagtacatgcagctaacaaaggtagtggcgcgtctggtccattaagtatcagttggttcctgatgcatatatgatgattcttacagtagttctctgctgcaggtcttctgaaggcgttattcttggtcattcccatcaagagcaagtatgcaggtgtcacttatgcagatatatttcaacttgccagtgctacagccattgaggtccttctggcacttctaatctaatctaatgatatctatcattcaaatagttcttccttatttagtggtgatatgactgctttggctttcgcatttcaggaagccggtggccccaagatccccatgatctatggaagggctgatgttgctgatggtgaagaatgcccacctgaggggagacttcctggtcagtaacttttaggttctgtagaccaaatttgttcataaccatgatttgtcgtctataaacaaaactataatgctgtccctttagtgtcatgtcataccgatctcaagttactattgcagtgggtcatcatcttacaacttcatttcccagatgctactttcttctaattcattaaacttagaatattgatatgttctagagcattgaaatttaattgatatgcgtttcaaaacacagaaataaacttacaaatttactctatttgtcctctccttttatctcaatttacgagttacatgcaatgcaactgagatacctgattgatgtaatccttttcaagcttgtacacctctcactttaaggaaccacccatatcaaaatctttatttgtctgttgtatgtactcacaccaaagtatgttaacgtagtgtcaataatagaggacataaatataattgtaaattttttcttgctactaactcattgtaggtggcctgttatttttaaacagataatggtctgcctataataggttgttgcattcctggtaatgtttcccaggtccaacttatttagaaggtttaggcagggtaccttattcatgtatctgtggattttagtttgtgaaataccaaaattggtgtgaacagactaaaaaaaaaagaaagaaacaagttatgaaatattgctactgtgagctctataatctggtgtaatcacattttggatacgcaaatgtgcaagaaaaattactccagttacaatttaaggaaaatttaaagctgcccatgctgcgcagaataaaaatcaggcatgtgatcgtgctttgcctgtgaaactgatgaaatattgcttccctagtcttgctgcaatttcagctgtttggtttttgtaatcacatggcattgatatatttcctgctctgtcgtatactgacgatgatctaatcctctttccttttaatgttgtttctgttggtacaatgttgttccctgcattttacatttccaccctttcagctgctgacccaccttcacctgctgaacacttgcgagaagtattctacagaatgggcctgagtgacaaggtacttgcaaactggttgattcaatattccaaacaacttttctggggggtttgcattggctagtctcatctgtttcgcgatctgcaggaaattgttgcgttgtcaggagctcatacacttggtcgagctagaccagagcgtagtggatggggtaaaccagaaacaaaatacactgtatgtaacttacagcagttggtattgttctgattttaagaacaccttgtccattgatgcattttcgagtattgcatgctatttagttattactatttttagattagcacaccttcatgaagttcttctgatggtgaatttgttcttctgatggtgaatttgttatctggctaattgattatttttcttgactggcaaaggaaaatgggcctggtgctcctggagggcaatcttggacatctgagtggctcaagtttgacaacagctacttcaaggtaggatgcacaattttctatattaatactaagcattatagcagtaatagaacttatgcaagtctgcatacatattcaggaaatcaaagaacgccgagatgaggatcttctagttctccctactgatgctgtgctctttgaggactcatcattcaaggttagtgaagttgctcatcagctagtgttgtaaagaattgcaaatcaaaagtgatgctctaaatttttttctttttttgcttgcttgtcatgcctgaagatccatgctgaaaagtatgctgaggatcaggatgcatttttcgaagactatgctgaagctcatgccaaactgagcaatcttggggcaaagtttgatcctccaaaggtaaatgagattaaagacttcctcacttccattattggaatggagaaaatgtccagtcaacttgacttgcttattatcgctgaaatggcacagggtatttcacttgaatagctggcgtcagctgccgatgaactgcattttggcgagtgataaacaagataataccttgtttgttcttgctactatagagcatattctggttttactacccatccagaaatttaacttattgtaaatgtgatgctggtgctgtgtattgagctgtgttactgcttgccatcttatctattgtactatattataaagatagctcgaaaaagagcaaccaaatttgttcaggtcaacaattagatgcatcacaacctcagttagataatactaggtttttatataacgaagatagtaatgtgaattgtgagttcctacattatttctaacatacttatttagcattaagatcaaactatagttgcgagttgtgagttgtgacacccaacatgctagcacgggttccttcggtttctcatggaggaggaagatttgtattgtacgcgaaatgagaaagctcattagtatatgattaattatcttaaaaaaattaaatattaactattataaacttgaaaaaatagatttatttgttttttaaacaacttccatatatataattatttttttaaaagaaagtaacatttaaccgtttgaaaaacgtgctaataaaaacgagaaaattgaagtttgaacttaagaaaaagaagaggcctaaataactcaacctaaatactccctccttgacgccgttgacttttttaaatatgtttgaccattcgtcttattcaaaaacttctgtgaaatgtgtaaaactatatgtatacataaaaatatatttaacaataaatcaaatgacgggaaaagaattaataattacttaatttttttaaataagattaatggttaaatatttttaaaaaagtcaacggtgtcgaaaattttgggatggagggagtatgtgtcttccactcttctcccccccaatcaaacgaactagttaaagaattccaaaaaaaaaacacacacacacacacacacaaaaagagagtgaaattttgctattggtagattcctcccctgaccacggagcagcgaaccactcccaaaacgccaccaaaaccctcctctccccacctccgccgccgccgacatggccgtcgtccaccgcctcctccgccgcggcctttccgccgcctctcccctcccctctcttcaggtactagtaccacctacgacgcctccccccctccctttcgctgttcattacccgcgccggcggcggaccggttcttgatttagcgatgtccctttcttgatgatttttgttcattttctcccccgtgaaggagctcgggaggcgtccggcgagctcgtcggcggcggcggcgggggacgcggcggctgagctgcggggcgcgcgggaggacgtcaagcagctgctcaagtccacctcctgccatcccatcctggtatgctaatatatgctttgctgctttagtgttcttgtgcaaagattgcgggtttgtatggttcgaagagtataatgggattttagattgtctagctatatccatggatttcgcatctctacaaaagattgttctttgtgtgtttagttaactggtcgattatgctatttaaaacagtaacttttacttcgagaagatgcaactgctctagttcacctgtgtgcaagaagactgtaacacgttctatgcacaatattcgctagatttgtgcagttcatggttctgcatctgcttgatcgaacattgcatatttatgacttgtctgctgggttaaccttggttgcaggttcggttagggtggcatgatgctggtacttatgacaagaacattactgaatggccaaagtgtggtggtgccaatggtagcttgagattcgaaattgagttaaaacatgcggctaatgcaggtagtgcttctgttctgtcattatctattgttcgtgattcatggttatccttacaataaccctctacttcaggtcttgtgaatgctttgaagctgatccagcccatcaaagacaagcatgcaggtgtcacttatgcagatctgtttcagctcgccagtgctacagccattgaggtccttttgtcactttagtctaatgataactatgaactatcattcaaacagtatttattatttaatgctgatatgattgctttggtctgttttaaaactcaggaagccggtggccccaagatccccatgatctatggaagggttgatgttgctgcccctgaacaatgcccgccagaggggagacttcctggtcagtagcttttgggttctgtagcccaaatttgttcgttaccgtgatttatcatctggaaactaaaatataatgctgtacctttagtgtcatgtcacactgatcccaagttgctattacaattggccatcttcttgcagcttcatttcgcaaattctactttctccttattcattaaacctagaatattgataactttcagagcagaactgatatgtgttccaacactcagaaatgaagttacaaatatactctattggtcctcttgtttaatctcaatttatgggttatcatgcaattgagatacctgattgacataggaaatcgcgcatatccatctttatttgtctgcaatctatttacatcaaaatcaaattatttagatgtagtgtcaacaatagaagacattaatataaattgatagttttcttgctaacctactgtaatagtcctgttttatttcttctttaatgataaatttattttcttaaatggacaatggtctgcctataataggctattacattcgtggtaatgcctctcagattcaacttatttagaaggtttaggcgtggtatcttatccatgtatctatgggttttacttcatgaagtactaaaattgatgctaactggctaaaagcatgaaaaaacaagtttcttatgaaatattgccaccgtgagctctgtaatctggtgtaataacattttggacatgcaaatgtgtaagaaagattaccccaattgcaatataacagaaaaattgtaagctgcacatgctgtgcagaatgaaaatcagtgctatgattgcacttaacctgtgagattgataaaatatagctccccaagaattgcagcactttcagctgtttgtttttgtattcacatgacattgatatatttcctgctgtgtcttatagtgtactttgatatttgaaatctagtgctgatgatgatctaatcctctttcatatgcatgtgctttctgttgcaattttgttccctatattttacatttccaccctttcagctgctggccctccttcacctgcggaacatctacgagaagtattctatagaatgggcctgagtgacaaggtacttgcagattgcttcattcaatattccaaacaactttttctggggatttgctagttacatctgttttgtgatctgtaggaaattgttgcattgtcaggagctcatacacttggacgatctagaccagagcgcagtggatggggcaaaccagaaactaaatacactgtatgtaacttatatagttatatcagtagtaggttattgttctgattttagtaacgccttgtccatgattcattttggagtattgcatgttatttagttactacgtattttttagattagccaatgggataattaagttgtcatcactggcaatgcttattgatcttgcatatatctcttccttgtaaaagctctgtattgaagatctttatatgatttattactacttcaccgaagaaaataaagagatgcttctgcgctgttgtgttagttgaccatattatgcttcatctctaatcgcggatgacctatattagcatcaatgctacaaactttcctactacagtgcttatatgctttcaaatatgttcttgtgggtagtagacttgcagtattaactatatctagcatgcactccttcatgaagttcttgctgatgaatgttctgaatgttgaatttcttgtttggctaattgattaatttcttttgactcgcaaagaaaaacggacctggtgcacctggagggcaatcttggacatcacagtggctgaagtttgataatagctacttcaaggtaggatgcactattttctttatcaataccaaacatgatagcagttacaatttacaaaacttatgttagtctgcataaaatttaaggacatcaaagaacgccgagatgaggaccttctagttctgcctactgatgctgtgctctttgaggactcatcattcaaggttagtgaagattctcatcagctcttgttgtaaagaactgcaaatcaaaagtgacgctctaaactaaaaagttttgcttgcttgccatgcctgaagatctatgctgaaaagtacgccgcagatcaggatgcattttttgaagactatgctgaagctcatgccaaactgagcaatctcggagcaaagtttgatcctccaaaggtaagtgagattaaagactaacattactggaattaaaaaatgtgcagtcaacttgacatggttatcactgaaatgacacagggtatttcactggaataagtggcgtctgctgccgatgagctgcattttggcgaatgaacaagacgataccctgtttcttcttgctactatagagcatattatggttttattaccgatccagaaatttaatccattgatcggcaaatgtgatgttggtgttttgtattgagttgtgctctccattagaaataaaaatagcggtggccattttcgtttccaggaccaaacattttggcacattacaatacaatgttttagatgatgtctgcattgagctcttacacaggatgatcaaaatatatgacataatttattactgaatccttttgtgatatttcccaagtaggactgtacataaccagcaatctcaagtcaagttacttttcatagtttatttggatcatctgcttccagatcttcttcctttattaccagataacttggtcatcatccatataaaattacatctgccaatcctactatacatatttattttatacccacaactgcactgaaatgttctcttcatcgagaaaacatacagcatacatcttttatcatggtgaaatatacattgctgaggacataagatttcatttccctcttggaaaccccaagatagccttgatcatggctcccaggttgcccttgagcactcccctgaggatcttgagcttcgccggcgagtacggcgggtacctcgccgccgcctcgccggcgaagcggcggaccagcacggccttcttgtggctgaaggcctcgaagctgaacctgccatggtaggctcccatgccgctctccccaactcctccaaaaggtaggtactggtttgttagctgcagtggtatttttgcagacacatcagaatcagtcacacttggttagcaatgttgtttgcatcagttaacatgtaagtcatgatatgcttaaaatgcacaattaaggatcagattaatgatgattattactctctgtgttcataaataaaagtcaaaacgtaccttaaagtactctttaactcactggcttatgtttttatataataaattgatatcagtagaattgctatgaaaaatatttgcatgcagttatagttaatgatatttatgaaaatatggctaaaaaggaacgagaaattagaatcaatcatttggttagcactattgttttgcatcagttgacatgcaagtcatgaaatgactactaaatgcacaattaagggacatattagtacggattttgcgagtaaatgaaaagcttggatgcaaaattagaagccagattaatgctgattattacgtggacggctgtgtcgttgacaagcattcctcctgcagagatggctgcctcatattgttcctggagcttgctgtccttggtgaagaggtaggctgcaagtgcctttgtcatggagttgatgagagcaaagctctcatggatcttatcaacctaaggacagcagcatcatgtgagaacagagatttgtccatcatgtattaatttcccaactaatggtaacattgtcaatctacagaaactcatctgtagttgactacaaaaggtcatttattagctctaaccgttatgataggaagcaaggggccaaagatttcctccttcatgatccctgaatcaagaggaacatccatgaagattgtaggggctatctttctgaaaatgttgcaaacaaataaaattttaactgatcatccaaaccatgtattcagaagcatttgtcagagttgtaaaatttcagtcaacttacagctgatgttcatctctctgacctccgaacacgatcttatcagagacattttcatcgtccatcagcttcttcagccggttaaaatggttggaattcacaattcgcgacaagtcagatgatcgcagcgggtccctcccgtagaacttctccaaaactttctctagagcctccagctgagttcgtggcacggttgattagttaaaaccatttcaccacatattcttttaaatattcaatataaaatgagtttttttcttaccagctttggggcgaatgattttgttgttatgatgaaatcaggagaaatgcaggcctgcccattgttgcaaccccatttcccggcggctatcctcttggcagtaaccttcaaatcaaattaaagagaagattgcgacatgaacgaacagggtatcctatataattgtacactcgaactctaagtaaccttcaaatcaaattaaatattgtcatatgaacgaatagtgtgcactatatgattctacatttgaagctagcacgttaggatttctatcttatcatcttattaacacgtgtttctatatgtgctctacgtgattctacacccgaaacgatgcacgttttactctatcgtgctataggcacatgaatatgacacctatctccctctagtcataaataagtgtcattccaacatctgcgaagtcgacataaattaattttaaacatggctattgttcaaaaatatatgttttaccatatgaaaaatgaaagacaaacttgttataataaaaaccttcatactacttcctctgtcccaaaaaatcttgatgttttaaggtttgtcaacaaaatttgcttcatgttaaaatgatcaaattaccccaatttatttgattcggctgtcatttatttaagtcagcacacactcagcaggttacaaagaaaatatatgcatacaattaatcaatgtatttttttcaaaactcattggcagatgacctgaaggaatagacggcccacttatctaatcaagtttgctagtctaatgacatttttatgggataatactggaaatattgaacggcttgttttctgggacggaggaagtattacacttacgcaactaattttggatgctacagaaaagaataaagtggtcaaagttatatcttattaactttatatcttatttgtgaccgaggggagtaggtctcagtgtcccatgggggtagcaaatcctgaaacaccaaagtttatggtgcaaaatgcaaattcatagaggggaattgtgttgtgctttgcttacatggaggttgacattagagtcgacaacaaccgggcattttccgccgagctccaggaccaccggcgtcaggtgcttcgccgccgacgccatcacgatgcgtcctaccttgccattccctgcaatttcacccagtttcgtcagatttcagagccactgcaagaggagctaagcttcgatcacttctcgaactccatcaatggcgacaatgagaatcaagaactaagaacctacctgtgtagaagatcttgtcccatttctgctcgagcagggtggtggtttcggcgacgccaccctcgacgaccttgatgcagctgccgtcgacgtagcgcggcagcagctcggccagcagcgacgaggtcgccggcgccacctccgacggcttcagcaccacggcgttgccggcggcgatcgctccgatgatcgggtcgatcgacagcactgaaatggataagcaaaagtaatattagcttgatcaatgctactggcaataaaataaaatgctaactcgatctaaaccacagataacatgaggaaattaaaagaatatctatgcatgctggttccatctaggcatatagctctagttacatgattttaccctcgacgaaaaaaaacagttaaaattttggaaaaattgttcacttcaaaatattttgttgcattctatagaacagctgtaaaattaaggatagagcagtaaaaatttaagtgcacgtatctatggtttcacaggaaattaagggttggttgaactcaaatatcgtttttcatttgagaaatattctttttcttttactcagcatgatattgtaccaccactataaagggtgcagatctttttctattttcactttgcctgatcaacatgataatttctcttttagcgttgtcttaactagtgcctagtcgatttttctacacaagcttagattttaatagtacaatcgaatttgatataaagcccatggttataatcaaccaacccatatggttataatctactctcttcattccaaaatatttgacgccgttgactttttttttaaatgtttgaccgttcgtattattctaaaaatttaaataattattaattcttttcctatcatttgatttattgttaaatatacttttatgtatacatatagttttacacatttcataaaagtttttgaataagacgaacgatcaaatacgcttaaaaaaatcaacggcgtcaaacatttagggaatgagggagtatatattttaataatgcaatagatatatgttcctccaatatcatgatgttgtttatagtagaaaagcattttcgcattctattcatgttattatttttctgttgctgtattgcatagaggcatcatggaagttgcatgctgcaggtggttgagagtttgctgtcggaaccctctgcttctgtctgatacacacctcaaaactgaattctttttgagcaattaatagataggttgagacttcgcattggcatgccaacactatggtccactagtaatcaaacgattacggcaaccagctagtcagcgtctcaaaagatgcttatttaattctgaatttattgaagctcaagcagtcagacgtcgatcgataaagatggatcacaatttcagaaccacacttaaacttttgtttgcaatgtactccgtaggagggaaatcatgtgtactgggtggcaaatcaccaaccatacacatcacatcatgcaagccatatgcatgagtcaagttcttggattgagcaagcatgcaatgcaaaccactagaacgagacacatcacacatgtgtttagagacatcgagcagaaatgtatatacttccctaaaaaatgtagacatgtatgtgtactcttgaaattaatggatataaatgttgaatctaagaatttatcatgggtgggcctgatgtacttgttgcaatactcaattctacttcctccgtcccaaaaaaaaaaaaactcaacctagaagggatgtgacccctcctaagacaacgaatctggaggggtcacatcctctcctagattaagtttttttggacggagggagtaactcacaagtggattgagtgggttggagttttcaaattcagattttttttaatgaagcccaattcatggaaatgtatatgatcaatttaagcaaagagagttttggagaaatctaaggaaaaaatggatatatttttaaccagtatttttgtcatcgacagaataaccaaacaatttagaattatatcttgggagtatttttggtaaaaggaaaattagcccctggcccgtgaaagaacaaaaatggagaagatgggcattaatttcgatgaggaactgcctccaattccatactattatgtcgtcacaacttgttaatttggatggtattttggcaaaaataaattctatgacaattttaatatatgttcactgataattttattttttggaatatatacttatatttgtgagagcttgtttattatatttgcctaatgtgagctcatttgtgctcacgcgcatgctcgctctctctcttcctagtaccactgggaacttttttttttatataaaaccatgcaatgcattggcacaacatatatagttttagaaaatagtctatttggcaatagcaaccagaccgtggccataatgcgtaattaattcgttcaacgctatttaaaagttccatctcttacatgccgtaatgtgtttccagtctaggcctcccttcctgtgtggtccaactgccatatctgttctaattgtttcatattttcagaatatattactatcttttcaatatagaattaaaatcagtgtcaaatactgaaatatcaaaagattgttacaccaaacaaaatcatcatagtccactgcaaaatcaaatgatactatattattattgcgggattgtttgaaagcaaccctgaccacaaaaaatattatgcaagtatttttttaagtcaaatctagttatatatgaaaccattgtgtatggttttatcgcatatagtctcagtatttgaaaattttaaaatgctgagattttccttaaaattttaaaaatgcttgctgactattatttaaaattttaaactctagccgggtactgtgaggagggattgagcaagtgaccaacattaacgaagctctcatctcacaattaattccaatgagacatgaacgtcaatggcatgtcatgcacagggaacacggattatgtgtttccatcggaattgcgtgtttgacttctgctactcaacggaaaaacaacattctagaacaatattaatattaatatagtaattgctgcaaacaaatcgattgagttaaaaatgttcaaggcacgcagtaaattaattacttttctatgaaagaaagatcaaatcatatgtgaatgttaatttggttttggtccaacttacagaaagggtagttccaggccgagatgacgagcacgacgccgagtggctccgccgccaccctcgccgtcgacgggaacgtcataagcggagcagtgacctgaacgccatgtacacacgtgtgctaattaattactccctccgttttaaaatatttgacaccgttgactttttaagtatatgtttgaccgttcgtcttattaaaaaaattataaaatatgtaaaactatatgtgtacatgaaagtatatttaataacgaatcaaatgatataaaaagaataaataattactttatttttttaataagacgaatggtcaaacacgtactaaaaagtgaacggtgtcaaacattttgaaacggagggagcggttaattgggaagcagctaggatatagacatagggtactaatacactctaattaatgacttgttagataaggtttagataactaatgactctaattaaggtttagataactgatgaacaaaattttgtttttttaggtagaagagaggcgccatcgctacactttatagtgttatatattttgtggcaattttgatactattaagatgtctgaaggagcatcaggtgctatagtagttggctagttgccactcctctgtaatcagcctccagaaaaatatcgactgttacactaaattatgattgttttactatgcgctccttaggttcttaggctagttgaaaaaagaacctatacaatatgatctttaattaccaagtggtgaaaaaaaagagaacgaaaatggccttacgattctcgacaatgatactacgtagctgcacatatcatttcatagctaatagaggcaccttgagtgatgaatttttttttaaaaaaatgcgtgcaaaattttttaacattaaaaagaaacaagtttactcaaaacatgtaacataattttaacgcggatgtcaccatgtaagtgtggcgcaggaagaagaaaacgaccatctatttatcaaatgtctggattttatttggcaaccacttttttcaagcagactagctacacatcgaacaactctgaatgcctattttcttttcttggggtgaaataagaaatctaacttcggactttaaaaagtatactttagtgtgaattttgtcaatataaaaacagaaataatttataggagcataaaaaaaacttattttgtttttggagtaaatgatatttaggctgtgttcggatggctgtgttgcgaactaatcccttgcatgcaaaacaaaacgattaattagcgcatgattaatgaagtattaacttttttaaaaaaatagattaatatgattttttaaaagtagctatcgtatagaatttctatttttctttaaaaaacacaccatttagtaatttaggaaacgtgtgcgttaaaaacgagataggtgagttgggaagtcacgaagtcacaataaagacatagccttaatgaagtgataacagccataatatccacaccttttggggcttcatccatttcttcagattcttgagggcaaacttgcaggacgacttcaccagcgcaatctgcaaattattttatttttgtcatctatcagcagagcagacagagtggcaaactgcaacagcatatgcatatgcaattgatgttcagaatcgtcagatcaggaaattgatcagttcctttcctcagttgtacgttgtgcgctgtgagcgtttatgtaagcacagttaacatctaaatcagcatcattaatcatggtaattaaaactgctaacaagtggcaataacgacgtactaatactgatcaacggccgatatctgtagaaactggtcgactgtacgtctcaggatgtatactgtgccgctattgtcaaggctaagtacgatgaatcaaacacaaaccaatattcagctaatcaattttgtacttttcaaattatttaccaccatcacaggattacttttactctacgctttgaaaaatacattttctcaaaaaatattatgtatattgtgtgaacaacttattttaaatttcaaatgttcatttgttaaaatatttaatctataaccaatttagttcttttcaaactatttaccattacaacaggattatttaccctacgcactaaaaaaacattttcttaaaagatattctgtattgtttggacaacttattttgagtcttttatgtttatttattaaaatatttaatttatctttataataagtagacaatccgcagcaacaattcactcaagtaatctgcttcaaactaagcgagacagaaaattaaggacggaaatgtggcagcagatcagagtagttaaccaattcggtatcagtaagccagtaaccaactcgatcataacagaacagagattacttgggtggattattttatcttattttataggaagaaagaagaggaagaagggagagattggatttgcctcgtggacgtaggactcggtgtagggcttggcgaggtcggcgtggagggcgcggcacacctccggctccgccttcgccgccatccgcaggatcccgcggagctgcgccgcccgccactccgcgccccgcgtaccccccggcgggaacctcccccgcagcgccgccacctccggctccatccccacgctcctcgccgccgccatctctctctctcactctctctcgatcgcctctgatcgccggcgatggatggaaaggctttgctgctgctgctgctgctggtgatggtggcgaaggatgcggaggcgtgtggggggtatatataaacctctcccctgcacgcagggtttaccagacggtttgaacgtcaaaatgggaccccgggcgaatttgacgaaattcatgaatatcgagcgaatttgtggtgggaaaaacgatgggactttgtaggttgcgatttaaatcccggtgatttgtttcgaatcaaaatgtcagaacgaattttttttaaaacacataataaatgtggcacacacaacacacgtgtgtttacatattttgagcacatgcataaaattggaccgacatatttttgagattaaaaggcaccacggatatctcgctatcgattgatacgttgtctaccacttatataaggaataattagctgagaatattcgtgtcaagggtaaggctttaagctgggtggaccggttcaatattgtttttaaaccgaaaagttagaatatcgaatgaattttgtagaaagcgattacttgcgtcaaaatctgactagtttcttgttaaattacaaactatataataaaattttaatcaaattaaggacttttcttaaaaaaaatgccgcatggcattggatataatttttttaaggacattggatataattttgacacgctgaatatgtatacaacacaattaacattatatcaacaatagaaaagtttaaaatacatgctagcaagtcacataatattataatgtccatagtagtatcataatgtacatgatatcaaccaactaaagtaacgagctttcggtctattaaagccatttatttttcctttttccttagttgaagtgccagcatatacataaatttaacacatttaatatttttttcgtttttaatcaatattgatgtaattcactctattggttttgtgacggctgtatcttttgaggatttaggccatgttgtactgtaccgcatttttttttttgcggggagtactgtaccgcatttgtaaattactgggatggaatttccgagatttatttatttttccttggaaagaattagttgtcctggtgaattaactttcttttggataaattcacattagaacttatttgctttcaatttctgaagctcggttgtttacggtacagaggaacaacagaagtaaaggaaatttcttgactgcatttaaacatggaacccaacaaaaaaacagagaactaaatgcacatgcaaaaaataataattattggaatcgagagcgttgtggaagatttcatttagatattaaaataagacctattctttttaaaattaagcacacgagctttattgttcgttcaaaaacataatgaccactagctccaacaacaccacaaatttctatagaacacaaaaaaagtttgttatcttgatgtctcatttgacaatgttgagacggaagagccagaactaaaacttttaataaagccgactccccttacatatttaaaaccatatatctactatacaaaatatcaataaaattattccggcgtcataaatatttatgcggtgcaatttcaattggattttagtgaggttactactaatttaccgttgatctcaattttttttaactgtgttataagatatatttgcggggtgggtgagtgtggtatacttgtgggtataacaataataagaaacctatggggttagctgaccccacaagtctctagggttggctctgctaatgaaagaatgactagagacactcaatgacacccaaagcaagtactccctctgtttcaggttataagacgttttgactttggtcaaagtcaaactgctttcaatttgaccaagtttgtagaaaaaactagtaacattttcaacccaagacaaatttattatgaaaatatatttaattattgatttgatgaaactaatttagtattataaatattactatatttgtctataaacttagccaaacttgaaacagattgactttgaccaaaatcaaaaacatcttataacttgaaacaacttgaaacggagaaagtatctattgtttttctatagccctgaaagattataaccgaaacctagtgctgagaagcaaaataggacgcctcgccaagagcgtcgccgtctcccgtcctagggcagaagaggttttcatattgaagagtagagaagattttatgtaaaatatcttctcttcataagaaaatagcttaattgtttatgcttagaaaacatacgagatgaagatattgcataggtagtcgttgtagccttgtgccttctcagatacacacaacgaacggacatactcatgtgtgaaaggaaagacacattatgcattacacaaatatcaataaaattattccactgcttataaatatttagcattacgtacacatggatacactttcaatagaattttagcgaagttagagggcgttttcatcacgattcgtgataatagtgtgcgtgtagcggtatgtgtgtgactaggcacacatgatgccaaaagcaactagtagtagctaacaaaagagaagattcttggtgacattagttaggcatgactagaaaacatagaccgtgtttagatccaaagtttggtccaaactttagtccttttccatcacatcaacatatcatacacacgaaacttttcagccacatcatcttcaatttcaactaaaatctaaactttgcgctaaactaaacacaaccataggagaagaagtccacaggtcgtccccttgtgcctcatcagatacccacagaacggccgcactcaagcctgaaagggatgacgtcctttcagcctgaaagggatgacgtccagatttctcaacgatacatctcatgtccttcactccccaataaatcgcacaaaaaattatgcatctcagaaatgtttagtaggtgtccaaatttttcagtcccattggagaatattacagttacgagtacatcaaattcagacagctagctaaagagaagagaaatgcacccagaatgggaaaagatacagccaaacaaatctgtgcacaattgagacgataactatcaggcgacaatggtgtagagataattccaaaagatcattagaaggctaaatatattggttccagtgaaaagggaaaacactgtgaaacagacatatataggatctcatcaaaacaactaaccacaggatcatcttgaattaatgtgtaatacaagaacaagagtgatacatcaaacatttgtttccattgcatccaagtagtacgaaaattataaaactgcattatggctttcatttaaggtaacagggcgacagggacatggaaaattgtcgaattcattcatacgaaaggaacttctgcaccacatgattcatgtttggtctttggttcctttctttctccaggcacagaacagcaaactccagcaccagtagcacctcggagcgcacaaagttgccattcaatctaggatcaacaacaccatcgatcaatgtttggtcaccggttttaatcttctctgttactgtccacactaactgcctcaatgcagcaccttcatctgcactgccatttgctggtagctcagacattcgaagccccatgactaactccagaagcaccactccgtaactgtacacatcaaccttttcagttatgggaacaccagaaacccattccggagcgatgtaacccctagttcctcggatctttgacatgttgggatcagtctggtttctctgtagcagcttcgcgaacccgaaatcgctgattttgggctcgaaatcctggtcgagaagtatgttctcaggctttacgtcacaatggatgatccaatccatacactcatggtgaaggtaagctagccctttggccacaccaactgcaatcttgtacctatgctgccactgtaacagtcccttgctaccaaacaagaacatggccaatgaaccgttctctacatactcatagaccaacagccggtgacttccctctgaacatacacccattactctcaccagattcatatggtagatgcttccaatcacacttacctctgtctgaaactcggcctcaccttgcttcacatctttgagcttcttgatggcaactatgcgattgtcatctagaatccccttgtacacagagccatatcgcccacggccaagctcatctttgaaattcctagtagccctccgcaattctttgtaggtaaacctacggaaatgatctgttacaaccctgtagccttcctccgcagcccatatcgctgatcgtgctgagtgtgtttttgccatgaaccaccagccaaaagcaatgaagcagagctccacaagaaagaatgcagccaggaaacagtagtagtagtaccacatcatgcccgttcctttgttgctctgtgtagcgtaattgaacgtttgtgtttttgatgcattgcaaacatggcgattggcaagttcagaaacatgtgcttgtgaccgggacagaaagctctgaggaaccttgatatatgctgcaccagggtatcctgaaactgtcttgccattgaagagatcagacttcaagaagcagccattagggtacactttgtacacgaatgctacacaggagcaactcgccaaacacattgctctacaagcgtgcagggatgttgacatgacatagttcatatcaaagccccagaagtcagtctgaggaatgcgcacaaagctcattttctggccatcattgctgcaagtgaggttgaatgctggcttgcatcctctgctccaatcaccaggatcactgaccacataaccaggagggcaagagcagccaatctttggtgtgtatgcacatatcccgttccaaccacaaaggccgtgtatttcacagggttgggagaaagccatccaagaattgtaccagctcccatctgactcattcaggctgtaaagccgaagatttccatcatagtccaacgtgagtctcctcttaatctccaaaccccaatctgaggcatagaaagttgtgttatcgctcgccataaatttccccagcttatcaagaacaccactcctgctacggttgtaagagatcctatagtttgtccagctactctggtcagggttaggccagtagaggttaaagatgtctggtccatcataagcaagtgataaaacgtaccgatcatcaaaccgtaaagtgtagtaacttgttgggtgtgagggatcagttgataccagctttgcggtggctgtaacaggctgcatcgggagcagagtgttggttggatgatcaaagctttgccataggatgcttccaccttgatccttcaccacaaggttcccagagtccatgagctcggcacggacagcttctgcagagctactgatttgccagacaaccgtgccatcatagtctgtgagaaccatgcttccatccttgttcagcatgactttcgacccgctctcatgcacagggcggtcttgatttgcgctccaggcgatggtcttgtcagctgaattggtgaaccagattgacaaggtgaacacagtggatgaaaggttgtagaagccgaacgagaaggtgccatccgttgaccgcagtacattagaggcatgcttcgcggagagggaagaccctttatgcaggtaattagcatgaccagccactgcagaaataggagccagaaaggaaaagaatatgaggtttagtatcaataaagagcttggcatgatatgctttcaaagagcaagatccaaggagaaaaaatgctgctactgtatcatgcaggaggaggaaaggaatcagttgcatgtatgcatagttccatagttctgtacaattgcaattaaacaatatgaacaagcacatggcaagtgattaggtacctaattaagattaataattcaatcaactggggtaccttggaatacagtccaatatgatattccttctctcatctgttttttcatcctatgatagatgactagatgtcacccgtgatcagtttggcagtccaccaagttgaagatttcaggtcttactatatgtttgcttaaatctattatatatttataaatttaggccaagcacatgattacctcagaatgctggaaaatatatgtttttcttgattgagaatagtaataatatcattaaaaaagtgggtgccagtgataatttggtttatctaatttgacacaggttccaattaatttttccttaattcttgtttatgaattgacaattatgcaagtagtttagtatggtttattattggtgtacttttgcattcagttactctctaaaacattatataacaatctagatctgggtatatcggggtatttttaaggaagataactcacctgggacgaatgatttagatttcggcataccattttttatgattacatgtagtgcaatactacaatctcactgggaagtcatcaagtcaccccaaggtccaaggagatcatttgaagaataaccaagttttttgaacagtagaatgaaaaatcagatggccaatccaacttgaatttaatacaacataattttgcagtctccactagtttcttcaattgatagtgcaacaagtccaggaaaatgctacagaaaaaaaagtttacacttagcatgaattaagaaaaataaatgatgcatctcgattttagttattcaaacataaacccattgtaaggaaagaaaatgcacaccaaagaacactccatcatttccctgtaataggattgtgatggaattgtatatgaaaagaaaaaaaaaaactgcacacggagactaatcaccagcattacaatgggcatttgaaggtgcctgtgcagttcctgttatttctatagactactgaatgaaacatcaatttgatggaacgaaaagcatgctatctagcatcccaaagaaaatattcttcttcagacttcagagatagaactaacagcaacaaaggtattgctgatcaagaatcaggactgcaatatagctgcaacaaataaagtgcagattaatcgttatccccgacaagcatgtatataggccactcaaatccatatagcaagtatgcaagcctgaatcaggggaggcaccatgcatcctagaagataagaccgaagaccaaaaaattagacaagaaggccatggtcatgataggtggaaacacaaaataaaacaaagtcttattgactacaacagagcacacaatatcaggtagtatatgatttaggtgtgtaactaacagattattttgtatcaagttggagttaaacaacacaaacccctggcacaagactaattaagaaagaattatactcttttcaaattatttggcattactataaactgtcttctcaataatatatgatatagttcactcatcaccgtcaacaactattttttgacttcaaagatgagaagttgtaggctttccacacatgcaatgtgtcaatcatcagctaaaggaaacacgagttttctctattggtttgtgggatcatgcaagtttaggggaacatcgtccacctctaacatactttattggcgatcttttttacctttttatggtcacttgataataccataaatatcaaggcaaagacaatatcttattagttatcagacacatcatggacatagattattcaaacaaatacaatccaagaaaaaaatcaaacaatttggagaaagttgaatggaataggttattttagccacttttgagaagatataaatcatgatatcatctcttcttgctagactttacacaaccttagggattccaacttttgaccaagataggtgatggaaactactgatgggtgacaaaaactgctggtaaaacaaagaacatggcttgacatgttcattagggcatagcttaaagtctgaaaggatagacacaagatcgaaacttatggtcatcgtgagagaataactataatcatatgaccagcatgaagaataactatcatagtgaaacagcattcttgtgttgaacatttagctttatctaacttcagaaacatgccaggaaaaaaggtttcggcttcaggaattcaactggccaccagcacgacaggatgaaaagaacatgtaccactactcaaaataacagctcaaaatgtaaatttataccaggcagattgtactaagatgagaaacattgcatcagacaagtgaggctcacagtatttatttccttcgaactgaaactatgcgggcagtgtatttggaagccctgcaaaatgctgtcgtctataaaccaggtatcctccattggcaaactcaagaccctgcaggtagcaaagatgataatccggaatccgaataaaaactgaattcgaaggcattttgttcaaaaccgaagattagaaaacgaacattttctgataaaaagaggaaatcgaactctagaagaagagagacccccaatctgaagggatttcgtcagtctgctccctgctgcgaatggccattccccattccccccacaaacgcggcgccgccgtgagacggtgctggccggatggagacagcgccgcccatgcgagcaagcggcggaggacaaagatagcggcagcgcactggcgtcgtgccgggctcgcctcaactgccgacggcggcgagccggcgacggcgtgggcgcagccgcagtcgcggaggaagccgccgccttcgcctcgccggcggctcatatatgggccgatttagctacaggccttaagaaattacagcccagaaagcccaaaaacgtaagcaaatatttccgactccgagtctttgaacattttttttatttttacagaaattttgaaaaaacaaaaaagttttttaaacattttaataaaaaaatttcctgagcccgcttagccgaacggcccgaacccaagtttgactcggtttggcaccatcaattttgccattaaaaggcaagaccaaaccggaaaaaggtccaaaaaaaaaaaagtcaaagcagtcaaaccaccgcgcggagaaggagatggacgtggaccctccttctccgctgccgccgccaccgccaccgccaccgccgccgggacgccgcagcagaacaaggcggtggagcttcctcccggcgtatacttcaacccgacgcgtgaggaggccatgcaccactacctcaaccggtggatcgccggcaagacgataccggagatggaggccgggttcgtcgccggcgccgacgtctacggcgacggccccgacgcgctgcggcggcggcaccggccgggatactggtgcaactgcgtgtacaagtggttcttcctttgccaccgcaagcgccagagctcgcgcaggaccaccggcaacaagcgcgccgagcgcgtcgtcgccgccggtgggcggtggaaggtggagcaggggaagaaggtgctcggcggcggcggcggcggcggggagagggacagcttagggttctactccagtaactccacgaagaagacgtcatggattatggaggagtacacgagctccgccgctgatggcgccgccgccgcccgcggcgaggaggacagaatggagcccgtgctctgcaagatctacctctcgccgcgcgcccccgccggcgagaagcgggcgctgttcggggaggacggcgtggcggtcgggcccgacggacgcaagaggaacgcccgggtgacggttctggcgacactgttcgacgacgtcgcggcactccttggacagccggtcgccgcgccgccgctgccggcgccaggcgaacagcttggccatggccatggccatttcgatgatgtagcggctcgtttcggacaggtcgccgtggcggcgctgccggcgtcgggcgatcttggccacggcgatttcgatgacgacgccgcggccctccttggacaggtcgccatggcgccggcgccggcgccgggacatcaccaacagggttatgtcgtcgcggaggcgccgctgccggagtcaggttatcttggccattatcaccacgacggccatctcgcgcaggcggcggcggcgccggagcaagatcattatcttggctatcacagtcacgacgcgcatgtcgtggacgcggaggcgacgccggagcaaggctatcatgacgacgcgcatgtcgcggtggcgccggcgccggagcaaggcgatcttggccatgaccaggggcatctcgcggcggcgctgacgccggaggaatgtggcgagatagttggcgcatacgaatttcacccggaaatggtgcagatgctgtccattggcttcgccgcgcccgacgaacagttgttgccgcagctgctagaccccaccggcggcggctacgacatggctagctccgccatcgccgccgttggcgacgtgaacgcatatgccgccgcggcgcccacgccgcgaattagacccaacgcggcggaggcaatggcggcgacggcgacggcagagacaatgccaccaccgctggacgccgtggcggccgagctatccgcgccgccgcgtggcttaccgccggagctcgctttcagtgccttgccgtcggtgcagcaggagccatcctgtgacgacggcgacaacttcggcgagctcgtggcggaggcgatgccgccgttgatcggggagaacgccggcgtcgatgccggcagcgacgagcctctgccggatttggccggcatcatgacggagttggattttggacatgactttttcagcaatcagcacagagaatgaaaaaaaaaagtcatttgatgttaagagatggtttacaatttgtttgtttggaaagagatttgattcttttaagttcttgcagtagtcatcgaagaactctgatccctgatttattgctaggactgatttttgttgtggtgacaggttcaatcaaacactggccttccagattatttgcattgaatccgattgtacagtgtacgctccatgagtatttttttttctacaaaaatattggcctgataagtatataattctagcattatgttatgattcatgacagcaacacatagcatttcacaagttacctagatgtgatcttgtcaaagaatagaaaaatgcatagcaactcctgaaaagaacaccgaacatatcagggaatagaacattgtaacatgtacaggcactgctttgttttctttccctatgatactgataataaacatgttcagattactcaatgacactaaggaatcagctaacaaatcatatacatagcatattagactacataatgtatagtcccagccaataacagattgtggaactaattatattcagtcttacaagtatacaggaagaactttgtgccaaccaagagtgggactgggactgggactgtttcataggaacatcataattttatttcatatgaacatgatgatgtttacaggtaactagattttctcttttctaaagaatacattcacctaataataccgtgtagagcctccctttgatgttcatccttctgacggttggtccttctatcatcctaatggccttttcccttgtcgctcattttgtaattgaactgtaacagactgcggactgctcattctgataaccaatgatgttggggaactgaggccaacaataaccgtcctcaaatccatgaatggtattgtcactgtttgaataaacagagagtaattatgggtatatatgttcaggtgtgtgaaatgatcacagaagggaagatccaaacttggggattctatcacagggtgcacggatccatccaatctgccctctctcattgtcatatatcaccatctgatcttgcattgtgatgtctgcgataggagagaagaagattaacaccaaggcattagaaatatgtgagaagatgaactagggagtttcgttgcttgtttatgtctcaacttcctacctccgacaatgttcagatccttgaggccaacctctgatccattgaggatgccaaggcatgcattcccatatttctagcataaacataagaaaatgttagcaaccagtaatgcataattaattactagtaatatgcggagttctagaatgtttacagtgacaataaggtagttttcaggagggatctccatgagagctttcttgccattagaaaagctcaataccactgttctgaactccttttttacatcaagaacagatttgaatggtttcttccccttccagcatagaggcaaagagtggtcaggtacctctttcaggttcttgcttaaatcacccttaatctgcaaggcacaaatcacataagccccaatgtttatttatcaatcctgtgatgtcagaatgggaaatgtttaaaacttactgcatcaacaagtgcttgatatggctgtgcagaaaagtaagtgaatgaactgccgctgtcaaagactacttccattggcctcacacctagtggccggccaccaaagtaaaggtttgccgagccaggtgaatagtaattcctaaaaatagaagttcagatcatttgaaactaggaaatacaggtcatgtcattttattcttaagatgggtcatgtccatgcctagtttgaagacccatcaacaatatgggtatacaataacaaaaacaacaaacatgttaaccaagattcgctacacattccatacagagcaaaatgcagtgtataaaattatccgtgatttccaagaaaaaagaaaaaaaggtaaatccataaatgaccatgttcactacgctgctctcaattaatcttgggagtcatttgacactagtaacgatcgaccactcaatttcaacatcatattcgaacatgatactagtcatctgcatttacttaagcattgttgcaaacaagcactgagcacccaacccatgtttgtcagaccaaaatgaagtccaaggataatagggctcaccgggatgtgctacgagccataggagcccacgttgcacgcgagtaaggcacaatgtcatcaccaaagaagaggaaccctccacctcttgtactgaggcagtggccaaccacgttcttagtgatcccatgctgcttgagctgtgaaagcaggctgacagagccactcccaagcccaaggacaccatcagtagctgacacctcagtgctgctcccaacctgctgatcatacccacacctgcacacacaaaaaggcctccatcaagaaccacatcaagtggccaattcttatcgtcttccaatgttatatctaaccagttacaagtagcatacccaaatgcaagaccgggacggacgattgaggagtttgcaagtcggagtgcgaagctgtcagtgacaagcacaccaagtgatgatccctggtcagcatacttaatctcatagtcacactgctgctttggtgaatcacatttgtgcctcccggtcagaccaccgtgcagagcggcgcacatctgatccacacatggaaccagcttgttctttgttggtcggtacagcgggtgcggaacctgtaccaaaccatcaccatgcaagacaacattgaacataataaaagatcttgagccaaaagagcaatcaaagaatgcattctaatgaggattacaatgagctagagtgaaatatagcaattgacataatccatgggagaccaaaaatggattcaacaatcaacaccacatttagaaatggagaactgaataagagatgcccataaataggcttcaagcccaactgaacccaacaatgatgtaagcaacaaaaagggacattttacagcatcagcatgcaaaatcatcatcccaatttataaaaaccatctctatttctttttgaaaggtcaacctcatcatcctaactactactagcacaagccaggaaaggagattttctcccctgaaaaaactactactgagacaaatcttggattacacaaacaaaaagagacacaaagacatcaccaaatatggacattgcaggttggaggaggtggatcccaagaagagaagaatgctactaccttggagcagctgacgcagggggcgtcgcactgcagccaggtgaggtcgctgccggtgtcgacgtccaagaagtagggcctcggcgggttgccgatgctcatcggcacatagtacaatctgcgcaacaacaagaacaaaaaagaaaaattcagattaggactttgattcatcgatgcctccaaggggcgcacacagaaatccatccccaaataagaccaaaatttgcagtcagttgattagttcttggcgccggaggagaggaatggatcagagcggggccgaatggatcaaggagaggatgggatggaagcgagccatacccgtgggggtacacgtcgccgtagagcgggaacacggcggaggactcctccgccccggccgtcaccgacagcccgcccctcgccggcctgtccgcgctcgccgccgccgccagcaccaccaccaccagcagggcaaagccggcagggcgggcccacccggccgccatgggaggaggaggaggaggaggaggggagagctaagctctgcttctgcccccttctccttgtctgcttcttccccttctcttctctgaatatatatatatttttttggttcagatttcttcagaagatgatgatgaaaaaaaaaggagaggatttttttttcgatggatggtgatggtgatggtgagatgagaggagaggatgtgtgcaaaatggtgggttttatagtggaagtatggaatgtattgcaatggaaggttctttgttgggtgcagcagcaaggaacaacaatgggggtttcagagcctctttgttcttttcagaattgagaacttgagatgaccttttctcctaggtaacctctgagatggatgcaaggtcaggtggtgtggtggtggtggttatatgcctttttgttgatgctgtggagaaaggtattttgcatgtggtttgatcatctttacatcattagtgaaaaaggctaaaagtgtactttagttctaagatgcatttggttttgacacgtgtgtttgaaaatgttagctagtaattaagttatatcttataattttaaaagctcattcttcgattaaaatgttggttcgattagaatggtggaatagttaacatcctatctcaggaagtgaaatgatggtgggtgattcaattttgagattttctatattttgtcattgacaatgcaacggcggaaacacggggcacggcgagaggtcaggtcccctccaacatttttttacatggaatcattcaattaattagataattaagctaagtaatactaatacgtattaggactgcgtttagttccatccaaaatttgaattttggttgaaattggagatgatgtgactgaaaagttgtgtgtacgataggttgatgtgatggaattgtgcaaactttggatccaaagtttggatctaaacacacccgttccttccaagactcttggaacccttctatatctaaatcttagctccgtcattagacaaacgatcgattttaggaaccattgcgaacgtgatttcttctaaatgccttcacacatgcattttctttccatttttttgtgtcttccttgttacgttgcaaaatgtctatcttaccctaaaaagtatacgctaggctagggagtgcttagggcaagttttataatagatgtggtggtcacttttaattttatccacatcatccatccaaaaaattaaaactaacttatataaatacattacatttaatacactagtcccaatacacttgccaccaatcaacccctcttattttctcttgtttcttaaaatttgtgtggaggttgtctcttgtatatatgaggtgtgactcctctctctcttctcttctcttctccacatcgtcatttcgcccttagtatattctaaggagtgtcttttccgagcattcactagagaacagttggcaaaatactaatcacgatggtaaaaagaaagaaaaatgcatatgctatagcatttaatataactcatgtttgatggtaattcgaagtatcgaccgctttttaatcgctagatgtaggcaatattcttataagattgttcaatatattactacgggggattatctactttattataataataaaacaaatattttagaaaataaatttaaaaatagcttaaaacaagtgatgtataaaaaaagtttatttgggaaaatatttttcaaagcatagagcaaataatatgttttaacaatccggtaaataatctgaaaagaacaaagtctagtatctctttcgattttcatagatggcacttgcaggttttcgtggactaaaaaacaatgtgtattgaggaattgctatgattcaacttaataaaactacaaaaatgaagaaaaatcattttggtagtaggacgaagtacatattaagatgattaggcgatgtacttaatttgcttgagtaaaaatgatatacgatttaccaacaagactaaaacctgatttggatgatttatcactgagcgataaaatgatcaatatttgcgccctttgccgctcatgcagggaactaacaaaaaattgtagcactacgtgacggttgcttgtcacttttcacgagtactactagtgatttctatcaacgtgacaggttacaggtagacgtgttgtttgcttcgttccttgttcttgtcacactggtacagacagaactctcaattggctatattaaattgctggttgagtcaatatgcaagtctcccctaataaagttaagccccaaaagaatgtggattgataatgaaattaaattagaaccagcaagtaattacgagcaaaaccactccaaattccaaaaacgtgtagcatctcttgaaagtgggaaggcagatggggactgaaagttatatctgtgttcccttcttaaaaaaaatcccttctaaaaaaaagttatatctgtgtttcaagctgacttctataagtaggagtagttctttttttaatcaagtagtgattttataattaagagtcatttaacctgcaatctatataataattgggtatagcttctttaaagcaaataccagaatgaattctagttttttttaaaaaagatgagaactgaaataattttgataacacttccaacaattttgtgcaaatgttaaagacacaataatttgtaacgtagaatctattttacgaatttcataggaagtgtaactttttttatccctgtaagatttcttacatgacacatttaaattctgaagaaaacaaaacagaaataagtgtacaaatgataccttctggcgtagttttactaaagcagcaaaagaattgcagtatcctggccacaaagaaggtgtaaactgcaagttggagtattttaagagatgaaacctacaccgcagtgcaattatactattcattctcattccttactttaggcatgcacaagcactagaataataataacaacacaagaacaaattaatgtgggttgtattttggtgtaaggaagcatataagtgcagctttattcctagcctttgccctccatcagttgtgattctagcctttgccattagcatcaagtacattagatgtataaaacaacagggaaaagcatttctttgtttctttactttggagccagtgcagcctgctgattcatattcctgttgtgcagggcgaacaagttctgaaatttttccttttccgaaacacaatacagataggtgacctataaacacagcttacccttatgagtactgaaattatcatcctactcttcacaatttatgatagttgcaagcgcgatatttgcactctataaattcctcaaaaaatatttgtaagaatttgtaaaatttgctcctctggttctaaagttgttgtcatcgtctttttcagaaatttttttttgtcaaatttcaagacatgatacttgccctacaagtgcctcaaaaataattgtaagagtttataaaatttgctctaacaaaattgaaggaaacaatcctcttttgcccccaaaccctagctggggatgaaagatccatgctctatagttgccttgtaaggggaaaattgaagatatatggtcctaagagtgcggagattgttttggtaattaatgacaacccattgttgcaactaactattttcatgagttggtgagattaggttgagttccggcgtcaagttgaaaaattgaagctaaaagatagacactataatttgatgatgagcaagtgaatacattgacgatatggggtatgaagtggctatctatggaaagatggtgaagggcaagcaaggctcagttacgatacctggccaggctaagatcaatcgagagcacgatacctcgaaacctgataaagacggagatgagaatccatttttatgtctatcagactatcacttaattaaaaggtataaattgtggttcacttacaatttatgaattaatccataacacctccgtgggttgcagagaaatttgagattataccatagtcaaagatgggttctctcaaatgcaaatctctcagattcgccagaattatattctcaaacatggtggtgctccatgttaaaatgtctttcatcctcttttgtttgtgaccagacgaaattgcccttgggtttttccttccactcacagtcaccctcgccgtgtccggggagctcggagctattctaagcccaagctcttcctctcctctatgccagaagctcgaaactttctctttgtcaccgctcctagcccaagcttgtcctcctcgtgccacaggctgagctcaagcccttcctcactactgagcttcgagctcaacctcttcctccactttatgccggagtcttgtctttatttcccttgactagaaaaaatacccgtgcattgtaacgggtgaaggctattttaattgtactattgttagatatatttgtttttgtctaagaagtatatgggatttttgttttgagatgatatccaattgaaacccttgtattttcaaaaacgaacgaatttaaaaaccaacttaaatacagatgacataccaaaactatcggtatttttgttttgagatgatatccaattgaaacccttgtattttcaaaagcgaacgaatttaaaaaccaacttaaatacggatgacgtaccaaaactatcggtagaaacttcttcaatttttattaacatatgtaaatactccgtagagagtcccgcctctcccaagccgagcccacttacatctcccgcctctcctaggccgggcccacttacatctggcagcttttatagaccgccctcacataccaacacaagccttttttgcacactttgttctcactcatgtgcacccgggaagaagaatttccctgtcggtcacccatcccaaattactccaagcgagatcggcttccggaaaagaagttgcaacttgttggtacgagtattctattaatcctattaaaccctgggctgggatgtcacatcctcacccccttaagacaccgacatcctcgtaggtcaaccccaagccaggaacgtcccctcttggccacgtctgtatgtcgggatgtcacaaacatcatctaaggttttgtaaaaaatgaactttctctcatcctattgaaacgagattggtggcataacatatattttcaccagctacccgtttcagtgccttagatccatttaccacaaccttgtgcatcgaatgtgattgagaagagaagaaaaggcaagaaagttgaggaacacagaaaacatggtcacagatggccaagcaaggtcacggtgtaggacagagggacccttatttgatgatgtcacactaaactatagcctcagagagagggtaagagagaattgcgatgggagggaacgggtggaccagaaaggcaaggatgatatctcgagttttgttcggtgacattggcaggtaattgtcatcataatcttagaaatatgatgatgcacgtccaatgaaagacaacatatacccctaaaatgttgaattgaggcagcggcagagccacctcctggactccgccgatggtgttttcactatactttctttggctatacatgcgaaaaattgtcgatagctaggaaacacctggctctggcactgaattgaggcgacggatgaatcaaaatgtgaatggacaaaaaagtatcgtgctgcatgtgtaatatatagtttgggcataaaaaatcatgatgtttgctcatattgctagttattgcatcacccacgtcatcttgatcacataaatcacttaagcctaaatagccaaacgaaattatatgttgaaacgtgagttcatggtgttagtagcacgtactccctaaaaaaacccacttctgggtttgaatctggacatacacaactcagaagtggtttttttttattaggggagtataaattagtaacgctaattgagtctccagtatctaacatgtttttagaaaaaaaaaacagtatggagaaatatataacctcttatatctttcagatttacttttggctccccactttatcatcatcatcgtggttaaagctcgcgagcttcctcaaggtcattgtcagacgctctaccgggctccacctctgtgcccagccatctatcgtttgccgtggcttgtgacgacgacctgagtactaataatggttgctgcatctccttggtttatttcgtgctactcatcaccggcgccgaaatattattactacgagaaaattgcatcgccagtacatgaacttgttgggtgggtgtaatccagtacacgaacttgtaaaatgctctttttagtgcatgaacttgtctggtgcatgcagaagagtgtgaaaaggacacttcatgactaaacttattaatttaggggctaattaggatactatgtaaatatatactccctccgtattttaatgtatggcaccattgactttttaacaaacgtttgacctttcgtcttattcaaaaaatttatgtaattatcatttattttattgtgacttgatttatcatcaaatgttctttaagcatgacataagtatttttgtatttgcataaaaaatttgaataagacgaatgtcaaatgttggttaaaaagtcaacggcgtcatacattaaaatacggagggagtatataagaagattgctattagatatacacctcttcaataaaaaaatagaatgggatgtggtgatagtagaaaaagataaagaaaaaactgagcaatgatataagtgtaaaaaatatatgaaattcatcatttccatgatcaaggataaactagagatcaaatttataaatattgcatgtcttatgcacacttattttgaacctcgtaaaattaacattgtcaagttattttgaacctcgttcgcacgaacaagacaagtttgtgtactacagatatgtaggtgtgaattgatattaaaaaggaaaaagtccgaactcaacaaccagacatctttcaccttcaactattaataccggacgaactacccccgactcaacccagagaagttttgatcctaagtgacagtccagtcaataattcttcttttttaaattgacgggccccacctgtcagtcttatcctctccatctccttccccttacctctttatctctctccccaatcctctcactcttctccctcccctcacctccatttctctccatcaccaagccgccgcacggagggggagccgaggatggcggcagtgggcatcgatgggcaaggacagcggagggggagctgaggacggcggtggcgggcggggatgggggtggcagctcaaagcggcagtggcgggtggggacagcgactggggcgggtggtgacggcgacgccaactcggagcagcagagggggaactgaggaccgctgcggcggacggggacggtggaagcagctcgaagcaacggtggcgggcggggacgagggaggcagctcggagcagcggtgatgggtggggacagcagctgcagctcggagtggcggagggggacccgagacggtggcagcggtgggcaaggatagcagagggggagctgacgacgatggagtggctcggcggggatggcggagggggagccgaggacggtggaaggggacatgccgacagtggaaggggacatgccgacgtcgacgctcgattctctccctctcaacgccccctcctctctcttctccctccctgcgaggggcaggtcttcttgcgcaagtccggggatggccgctgctcacccttttctcacgcaagtccccacccgccactgcctccgccacgaggacacatgcagccgccggcgcgcggctcggcctcagcctccaccgacgctcgtagccgccagcgcgtggggctcctcctcggctggcgcgtgacgcgcacgagagagggggtgagaggggagagagagagaggagagagatctgataggtgggcccatcatgtttttaataaaagaattgatgattggactgccacgtaggaccgaaaccgcttgtaaagctgctcaggagggggggtcatccggtagtgatagttgagggtgaaagatgttcggttttcgggtttgagggcgtaattggtgctgacctattagttcagaggtgtaattcagacttttccctattaaaaacatataagcagatagagagagagagcgctctagatcgacaccgatacatcatcggacaaggagttgattcctgatcggtttgctcttttgttatttttccttgagtcgctgacggagatgggtctgtcttcctacccatcacgtgcagatatggatacgattcatgcaaaactagaaaggaggcaaaattaataaaacaaaagaaaaagaaaagggaccataggtggggataatactctctatccagcgcccgatgaagaaaaaaaatcagacatcgtcttaccatgtcatagcacttttgcactcttccttatgtgcatgttagaagtctgcatgttgcatgcatatgtattatgagtttcctccatctagtaaccttcaaaatgagtttcctcttaacttatttatcttatcaacgatctgattgcaccattatatttgttataattaaatctttacaataagatgtcacatgattatattctaatgaaaaatatatatgtttcagctagtgaaactcgatgtttcacatgtgtggtgagaatgtttttacctataattttactatgttccacatttttaagtttttgtgttgaaatggattatttttagtgtttcaataaccattttatgatagctcatttgaaaatgttgcatatagtgttattggatgtttcggtaagtattctgagatgtttgaataggtactactcaatgtttcatatttaagatgttttaataagtattttatgatgttttgctagtgtatttgtaaatattgcacatagtgttgtttagatgtttcaacagtcaaaactcaatgttccatatataatataaaaatgtttaagttacgaatgtagtcatatatttattttttatcaaattataatcatataagatctcgttgtaaagatttaattgcaataaatataaaggtgtaatcggatcctaaaacggatatgtaatttatgagataaaatggtttaaaatttattaattaatattgcatgcatacacgtcagaagaaaaggtggatcatctcccgtatgcatggatggaggagcacccgatttgtactcgtgtcccgtagatggtcgatttggtttggtagagaagaaccagatcgcatcatatatggaataataaaatctaatccatgttcgaccatgtattagtcttacagtgtgacttggggcggagctagaacaaaatgaagggggttccactcgcttgctttactcttgtttgaattaaatttagcttgatacgggtgtctaagtttaaactgacagagtatatatatggtgaaaataaataaattatagctaaatttttttgaaccgggttcctaggcaccccctagctagacatagctctgccccctgagtgtgacatgtgtggaagctatatgattgaagggcatctcgtgcgtgcgcatgtatgcatcttaacatgtagtacaacattagtctacttttttatctttaatgatttatacattttaaactgtgtattatttttaagatccgttttaaccattagactccactcaaaatatataataaaatgagcacaatatgaagtattttaaatatataaaaataatttatttatattgtagaagtaaccaagttctataatagaattagtaactttttatagcattataagtaattctatggatgtgttcaaagaaggtcttcatgggtaaactgtagattcataagtaaataaatgatttactatatatatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatatatatgtgtgtgtgtgtgtgttagtattgtttttcagaaaaaaataatttaatttatataagaagcaactcttagaaaacaaaagtaactattcatgatattaaaagtaaccatatgactgtaggaaagtaattaaaaacataaaagtaacacttcatgctatttcaaagtaatcactatattattttaaagaaactttgcattatattggaagtaactgttaaggaaatagaagtaatttcatagtatgagaatatgctaaaggaaaataactaacattttcacggtgttacaagctgccagagggaagtaactctgagaaaaatagaaataactcttcacattatttgaaagaaccacactggtagaagaaaataacacttcacggcattagaagtaactatactacaagagataagttctttgtagtattagaagtaactatactatgacaggatgctatatgcaagggatggtgtttggttggttggctggaccttgggttggaaatttttaaagactgactcttgtgcctggtcatgatgttatagatgttttatggtggattttttttctcttaaatcattgtactaaagaatttatatgaaactgacacaactttgaaggcgtgtggcaaacacataattattaacacatttgcacaacataagtgtggacaacgactagactaatcagtcactaaattgtactcatcattggttataccacatcgaataaacactataggaaaaagaccaatagatcaacatcaagcatcagctgtatcatcagcaaactataaaaagccatacggcatggtgtccacttccaccttaacaagtacttagccaacactattacatagccatttcactgcaaatatcaagcatcaacagcaatagagatctaatcggtacttcagtacagaaggccatatggcatggtgtccacttccaccttaatcagtacttagcaaatgctaacacatagcatggtgtcccagtaccacccctccaatacaattttaaaatagttagatgcaatcgggatgatgctcatgtaggaacttcgtaacccaacgagcacgacacgcctcattcttctgaatgtatatgaggcttataaacttgttagcagccagatgagttagaacaagatccaattggtcctcattaaaactgggaagatccatcactgcattgtagagttcagggtgcaccttagtatgggttgtagagcgtatggcagcagccacctcatgcatatagcaccagtcatgttagtcaggaaagccccttcttcttcagtcacaacaggggttcgctttctcttcccagatgaggttgagccaccagcaatgtcattcacagtaggaataaagttaccactaacaggcccagcagcactagcccctgcaacactttcacatccagcaccaaccccattcccaccctccatatccccatccataacacccaagccaccgtcagccatgtcagcaggaccaccaagggcctcattagagcccattgcaaatcttcctgtggcttgggttccaccaaagataatagccatcggtgtgtagttctctagaggcacattcaagaactcaacatctttagatttgtcctacatgatcagatttattatagttagagtgtgaactgaaattttttacagctaatggttggaagtacagctaatgatgatttattacaattagagtgtgaactcaaatcacatacctttgtatggcccatatagtgttcatcttctaggacaatcatgttgttctgatcatcccataaagccccacttagatctttcagcctaccgatacgaacccacattgaacgccatttgcgaagatggttgtatacttgggttccactggtgtcaagcccatagtggtcagtcaaattcttagcaagcccatagttcaagtgcacttccttgaaacccttgtcagtcttaacaccttgcgctatgagctcgaccatctttcttagcataaaggtagatatgtgggatgtccagcgcaaggctcctcttgcaccttgtccagcaaccttgtcattttcacatgtggaagtaaataaacaaaacaattgaatgataagttgtcagccaccttgtcttaacatatacaaattcatgcattagtagaaaaggtcataaatacaaataaatgccctataagctaccagccacaatatcttactccctccatacacaaaagttacacctatttcacatttgagtttttccaaataagttgttcctatttgtagtccttatgtatttaagacttaaatgaagagataaattaaatgttttattagaacccaatgagtcatctaaatactcattggctgcatgcttgcattcactccttgattttgtaacatccaaggtgatttaatttctccttgatcttggtgtcaaaagtaatatgtgtaacttttgtggatggagggagtataataaaaagttcaagcaaaagtaggaaatgtcactaatacaaataataataaactaaccacaatatctcataataagaagttcaagcataggtagaaaatgtcattaatacaaataataatcaaccagccacactatcttagcatgaaaagttcatgcataagtaggaaagaccattaatacaaataataaccagacacaacataattagttcatagatagtaatgtgatacatatcatgctacaaatcagaccctagatgaccctctagttgcccacgtatccccagccaagtcatccctaatttgtaccattcccctattgtcttgatctaattcatcgagctcttcttcctcatcatcacttgggttccaatcttcttcaaatggcacaaattcatcattgccataatgaagtatccaattatgaagaatgcagcatgcaagaaccaacttaacttgggtcttgtatggatgaaaaggtttgttatatagacaatcttgaaacagtttttgaaggaaccaagctcgactgtgactctaagagaggagtgtcttaaattaaacaactctctttggtcacgaggatactggcttccctcatactctctcaagtggtatcgacacccacggtatggtgggaggaaccctggtctagcaacataactagcatcaacgaggtagaattttcctaacagatgataaacatgggttcagtcattaccacaggacaagaaatcccaaatgatctaaattattgacactctatcacctgcggggacactacggccatcatccctctccaaggcatctgcaagtatgagggcatcatgtgcagacccttcccagccagcaagtacatatgtaaatttaagatcaaagtcaaccgcagccatcacattctgtattgtaacaccctttctacccctaaatgctgctgacatagcagatggaactcgagcaagcacatgggttccatctattgcaccattacaatcctaattgacatgaaaaatgttaggatatgttgtgggggaaaaaaggtcatttgtggataatatttgttttaccttaaaatatgggttgaatcttctgttgcctagaatttttcgaggtatatcagttgaaggtggtttgatcaactcatttctcagttcaccaacaacatacaagacctctctgaagtacctactgattgtcttagttgaccttctaaaaacgggttgtaaagccctaaatctaacattgtggcctacaactagaaggaacatggcaacatgttcctccactgagctgtgaatagagtcctgtagtagctctctttggcacaacaagtgacatagccgaaaaaatggtgcccttctcattctaagctgatttacacaatttgtatcatttgtatcatagatgaaacgcaggttggtttgtctaattaagtccctttccatcaatggtccataagaaatcctacgggtgcgttgtctagccctcctcacaatgaaactcatgtaggcacacattgtagcaactaaaccagcagctttagcctttaggatttgacgtacacagcgtatgtcttccatctatgcaaataacaaatttataatgcattatacattgtcagaacatggaatgcaaaaaagcacaaccatataccatacatccaaccacaagaggcaatagatcctacccatactgagacctacatacttgaaaaagaactagatctagcaaaataatcacataataatatactaaataaacatgatgcaaaaacatgcacaggagaccaactgcccaactaaaataacatcatcaatactagatctatacaattgatgaagcataagcaaagggagcacccacgacggtgcacaggagcctcaaaccctagcttcttctcctggggagtgaaatgaggaggggatacagccgtgcggggaggtaaccctcgcccttttgcatgtgcggctgcaacgaggggtctcgtgggtgcagttgcgctgcaccggatcagcctggatgcacagcgatgctcccccctcgtgtttctgctcagccttgcccagagggcgattttacatccgcccagcttggctcgcggaccggtccagccaaccaaacaagttagattttgctggcctgatgcgatgcaggtgcggtgcacccatccatacacgccctaagagtaaggaatgagtgcatggtgtagacacattcttttttgttgcatgtgtttactatttttagaaaggaagggagtcaccaattaagactaacgggagcacaagcttggcttagtcacttccatatggaattatgtctctcatactccgtacatgtagtgtatcttattgtaaaatgcatcatttaatatttagtagcattcaagctctacgcatgtagaaatttatggatatgtttcagtatagatcaacaaatttacctgttaagattcatatcacatattagacaaaaatatgtacaagttccctacacaagccaatatacacatcaaattaacattggaaaaataattgttatggaactcatctgtccaaaattttcaacatgtgccccgtgtctttaaactctaacatcatcaaccacaaaaaatcaagaaaaaaaatcaaatgatatactatcaccacaattgatgttagatatttaagatggagtatcaaggagataggttgacaacaaagcggatggagaagctcctaaaaacacactcacattaattttacatttaaaattaaagcaaagtaactaatttaacaaataaaaatgaaaaaactatttagttcgcatacatatattagaataggtcaatgccggttgaaatgacaagcttctccaaaaaaaaacatcactacacctagatatatcccactaaacaccaccacaccacgatatatcccactaaaacatcgtggtagtcgtagtctaacataataaaaacatatagagcatatctcagcaaaacaatgattgaaagaactttcgctacagtgattaaatacgttgtcttgactaaccaatttcctcgggcaaaatgtgacaaactatagccaagcagacccataaaagaaaggacgctaacaatgtatgaaagaatatagtactcctacttagagttctttttatagtatgtcaatattattattcataaacttttatcctgccttctaccaattactatccataaacttttcttacaatttgatcaatgtcaataaaatatatatgctaaaacaatgagcatttgttaattgaacgaaaatttcgtaaggtttcatactgtttgaatacttttgatgtttcatcatttactggataataaatctatcttgtccatattcactcaataataagtatttattattgcggcactgacatcttgttatcagttgcatcacatatccagcagctacctaaaacttcttttcagaatagcattgactcaattaaattcacaacttttaaatttgcacttcaaaaattatactaatcttaaaataaggtgtcagggttatggataccacatacctcggcagggcccaccacataccatgtcctatacaggagcaaccttcggatataggaggagttccggataaggaaagacaaccagagttctacatggaaacgacaaggactactcggattgtatccatattggtttctctagttctacttggacaaggggacacctatgggtataaatacaaggccccctagaaggagaggggatacggacaacacacccaacacaatcgacatagaagctacaacatagaagcctacatacgccaagacacgccgccggatatcaacttcagggataagcacggctagtaccctacggtgtctccggatactgtcaggagagacgaaagcactatctctgatctcgtcgggcatggattcgaggtggaaggctaccatgttgtcgactacgagtcagatcgtccgaccgccatgccgacaacagttagataggctatcccaaacattgtactggtgtgattatcatgaataagagcaataccggcttcggccaataggatgtaggattattacctgacaattcaggggcccgaacctgtataaaaatccctgtctccgtctcttttacctcagtctcgcgtatatcctagcaccaacgatccccatactgtccaaataccgtagtcgtgacatcaaacgtcgacataaggcataccaaaactaaccaaatatatatgagaattataattgaatagagagtgaattgaaacttaaataataaattacaataaaatggtaattaatattatgataaagtattcaaaattggtataagctttcaaaattgctaattactattacaagcagacagcatttaaatccaatagtgtaataatgactaaaaataaattcggtaactcaattgactataaaagcatgaacaagaaaaaaatagtgaacttatttatatctattaaaaaaatgtttgtgcatataattgtttctaagtttagagcttcgcaacaattaaaacccattaaagataaaaattgattatctaaccattttcacaaaataacatgctatgatgtaagtcactaagaaaactagcttaggttgtatagacatgtcttttatatacctagtcacttcttcaaatttcaccaataaagttattctgttatatgacaaattatatcaaattgtttacatttcaatagtggccagatattagaccttctgtctctttttcttcaactaactatctacattctaataaatattgtatttactaacataataaacatatgttatattttcatattttatcaattataacgaaatttatatataagaaataagggtaattagcttacaaaccagataactttttcttttacttttagctttttctagagcataattgaattatattagcaaaaaaaaatattgtttaaatagcttttaatgtttgatcattcactgaaaaataaagttatatttttcatgtattaaataagaaagctgaccaatacatggttaacagttattatataatagtcaaaacagaacttttaatcccacaaattaattgtctttagaatactaatgacttatattcacaaattcaattttgtctttagaatagtaatgacttagattcacaaattcaattatttttacttcatatgtatgtaggtttccagcctcactactttaaaagcgcatccccttcaccttttgaaaaaaatgtgtaattcccttaaaaaccttaaaaaaacaaaaggaaattcgaccgcacttccttctcaaagttatttccttctcttagaaaactatcgctacaaaaacccttctaactaaatataaaaaagctcaaaaatcattaaaaaaactatatagaaataagtcatatttgtatctctagacccattgttatgcatgggcatgtagctagtaaatagcgaaagccacaactcacttcgataatatatatagtgcactatgacaattggatttataacaagcgtcgatctttaatttatctataaattatatatttttatatgactatatatatcgttgagtattattaatatttacaacattttggattatatttagaaataaatatctttccagttcttaaaaaataagttaagtaacttgtataaataaaagatcattaccaaatataattattattattatttactcatgtaaaaacatagataatttatattgcggagcttcacacatgagctattaaggtggaagtaatagttttggctctagcaatatttattagtgaaaataaagaggacaagaaatcaacaagaagatggaacaatcgaacaatagaacaatattgggttaaagttttagttccacaccgcattatggcgaagaacaaattcaataatattaaaatattattgattaatgggagtatatatcgtaccatggttgtggacaactttccccctcatgtgtgtggctagtgactaaccttcctttttcttaccttctcgaagtcctcttgatatgtttagctaagaaatgtttgttttgaaagaaataaaaaatgatttgacgattattttttatggttgttcacttactacctatatatactatggtgcggcatttttgagaaaaaagtcaaatcttgtactaggtagggagtgaggggaagctccggaaggagtgccccaaatatcagagttttctccaagaagttccggaggagtgtcgagtttgtcgacatttttccactggagttccgaagaagcaccgaagttgtcggccttattctcttgcttgtacctcggcagatgcttcttttaataatgtaagtattcaagatctctttgtggtatttaatttatttgcttgagtgagatatattctcatcgttgcgggtttgtcacttagttgaattattaagtgcttcaatactatgattttggataaagaagaaagctcttgcacgaggctagagtaataatcaataacttacgtgtggtgtctaggttagcgggtaccttcgtttgttgtgtactccacagaaaggcggcaggtggtgatagccatttatgtcctttgtatccctccacattcaggtacatcataaagccataggtcgaactcagcttggcagaccagggaaaagctaatgtccgaagcaatcgataggttttacctttaactcaagtctaaattaactcataggaatcttctttagtcttaacccaccattagttattgtccttggatagaattttgttcttagaatactctaaagtgaagtgccacggtgatatccatgcgcttaagaatttatctatgcgcttacgaatttatctatgactgtatcaaataccaacagtctcaaggaattagagaatgttgaaagcaaaaactatgcgttcatcgaaaacaaagaagactattgttgcaagaaccattgattcaacacttcggccggggaagggaaccttcctttttcttaccttctcttgaagtcctcttgatatgtttagctaagaaatgtttgttttgaaagaaataaaaaatgatttgactaaattattttttatggtttttcacttaagtatctatatctactatggtgcgacatttttgagaaaaaaaagtcaaatcttatactataagcccaacggacgggagtttgtttccttttttttattttttttgacagatgttacggaccgtttttttttcccgcacgcatagaatcggatctttttgtcgccctttccttttattttaacggactgactaatcggatcttttcttttcacggacgcatctcatctttttattttaacggacggactaatcggatcttttttttcatggacactgatgactgttttttttaccgcatcgtatataatcagattcaattttttcgccctttattttatttttacggacgacgaaagcacctctaactttttaagtagtagtagagatagagatgtgttttaatttttgaagcaatagttggctatattattaaacttcctctggagaagaaatgtggcaccacttgcctctccaacctgtgcacccccatcggcaagaaccaagctgattcacaaatcaaatcaacccatgcaaatcaatttaagttaatttggtattctgtgtttgacgaaaacaaaacaatgaacacacagaaaatagggaaaccttgtattttattaatcatgattcattaacatgaatgtttacaaaaacatgagggctcccgcaggagttagccttttgccttcgcgaggaatgcttaatagaaaactaccgattaattacatccaaaggatgagcctatggaacacctccgattaagctgcgctttgtgatcgtcgtcttcaaatttatttgctcgccgaagattgaggttggtgcagatttaacggtgaatatagtgaatgtagaatggatggctttgtttcgccaaaacccagtcacagtacactactgtcacgtcggtgtgtggagggaatctggtggagcgggtgacctttgcctcgtcagcgcccactcatgtatcttggctttcatcaaacatggattttatggttgcttttgcctcgttagtgtccagcaacggcgtatccggtttccatccattttagacgtgttaatataataatgacctggccttgtcagcactcggccatggtttcgtcaagcctcgtcggtcatacacaatgaaacaaatgaatggctgtagccttgttagcttaagccaatacgtcgcccaacctcgtcggtctcggacgcaacgcctccgtagttggcgtatgcatgagtcaagaacagctcctgtgcatatgcatgggggcaaaatatattttaattatgaaaacaacgcctagacagtccgatcaccaatgggggctggacatatctagtaccattgttattggtatcatagtaaccgatagacgatccgatctccaatgaagaccaggcgtctagttttaatcatagaaaatatcaaatggcactcagatgatccaatcgccaatgagggccggaccagcctaataccattgattatataaatgcagtttgatcatagccgtgtttcggctctcatcaatctgactttaatcattgagatagattaagaccatccatctggtagaatttggagagagaaggaattactcccgtacatgacatgcacgaggcatgcacgaggcaaatatgtaactcttccagaatgaatatgaactcactttatgttattcagagcgcgctcctcttttccaaattttctcttcttttcatacaatattacagtttgtagaggccctgtacataagaacacagaacaccgtacaaactaaagagcatgtacctaaaacaaattatcaataaaatgaagggcttttgtgcaaaaatacgagggccaacgcagacacacgagaagccgcgaaatccacccgccctccagcgcacgctgacgtgtcgcgacccggcaagggccacaccagggcaaaacaccgtgggcgctacattctcgggcaggtttgaagactttagatatgtataaatcatggttggtccgatgccaataagactcaaactcatcccaagtatatacaaataaatatctacatccaatatttgatattttgataatttagacggcccaacccccagaaggattaggttcacctcatatttgtttgcagcccatattaatcgcttgacaaagatgacgtgtgcgtgtgtatgtgccactagggatacttatatctatggctaagttcacaatacatccacaacatattcgtctgtgcttcactttattgttttaccgtccgggctgcaaaactgcacaatgctacggtgtatatttgctccctctaggagataatgacgggctatgcatatatctgcacagcactacggcgttgttgtgttatataggataaacagcttgacggagaacaagatcagcttgttgtttaggactcaccgatagagatgccatcagcgcctgctgctacaggtacagatcgcccatctgcgggatacgcatcatctaattatgcattatcttcattttttatctctttcgatctcacttcgtctctctctctatgtaaatactcctatgtgggtacatgtgtatgcgtcgctagggcatattgctgcctaggtgcgcagcgcttacgccttgtgtgctcctctcgcgatcatgccggtttatataggcagagcgacagcaacggcgcggcctcatcctcgcgagttttcagcgtcgtcgacgtgttgtagataatgttagaaaacctatgggcttgggcctatgaaggcctagcccatatacactgacccacaccaaaaccttccatatatggaggaatgctatataaggaggagagggatgctcatattgtacacctgtactcgaggatgatagaatgatgaatgagaagagagtctcacccttacatctcgtgtctccatttttgtagaattacgggaccctcttggactatttcgtgtagcaggagggttgcgtaatacgttaccagcacgacgttctaccggagaccgaggaagagaagggtaagaactcacagatccgttttgcatctagctgattcaatcgcgaaaacgaatccctctccccgttctcgttccgtttttgtcgttcccgatgaaatccaccacagccgacttggagtcgccggtgtatgccgattggtgaaaatcacggtagacagacacggagttggcgtgccgcgacacggcatggcggcgaacccgcgccacggccgcgaacacgcgccccgcgctggcatgcacccggtgccacggccgcgcctgtacgacgcaacgtgcgacgaggccatgcactggccacgtgctgcacactagcatcgtgcccgacggcaagcccacgccggccgccatgatagcaacagcaaaacggagaggacaaagaaaagaagcagacccaagaacgaagaaaaagaaaagaaaacgaaagggcgccgatgaagacgtcgggtcgtcggctgcacaccctcgccgccgcacggccgcgcaggccgcgccaccacacgtccgcaccaccgttggctgccgcacggccggcgccgtccgtgccacgccgccatccgcaccatgcgggcctccgcaagggtcgcaccgccgctgccgaccgcacggcagcgctccgccgacccggccataccccgtcacacgggagtgccgccgccgcgccgctcgtccgccttgcagaagcgccgccgcgccgctcgaccaccgcgccgcctggcttccggcaccgccccggaatcccaccgtgccgtacatggcatgtgcggggtcaacgggagaagaagataaggaaagagaaggggaaaagaaaggaaagaaaaagaaaaaagggaaaggatcctgtgattttgcaaaaatacccttgttgtttttggaaattaagtgcatgttcctctgcattggaatctttgcactttaaaccctgaattttccaaaaacacacaaataaccctctgcatttgggatatttatttgaatggcattcggaatttgcaaatatcaccaaaatcatattctcgcataaaagagccacgggacattgaatttcgaccccaactttgcatttcaggtacctttttgctgatgtttgtgattatgaaatttaattatcgcatttacgattattgattatttgtgatgcttttattacttttaattaatatcgttgcgataaaatgtatagaattcatagtatatactggaattatttgtgggaattttgtgtaccattatattgcaacacttgtgcattttaccagcatttaatttgcgcatatttttgagtaacgaaagatgactggcatcgcaaattagaaattcgctaaatctagaatatttctgacatatttattcaatgtcgaaattacgatagagcaagaagctctacggtaccattaatccaattgcgctatgtgcactgactcgatgagtttgatctagcatctcaatctctcgctagttccttcaagctactctcatgaatgagtacgaatgagcgcgttagaagattatggaccctatctcttgtagagcaagtactatgagcaagagttggtatttttcgactataatctgctgagtcaatgacccagagagtacggtaacacggtgcaccgaatttgcactaaatactgcagaaactcttgatgttctacccgaacacgacgaaagtcgcacgcaaacatcactagtgtacatacaaagaagtatgcctaactagtcgataatagaatcgtgtaacgttcaggatagtgttcactagaagagcattatcttccaaaaaaccaactagcacagttgataatgaattcaacatgagcagctagcctggtgcacttacctcaacggaagaagaggaaaagggggagtagaacacaggtcaaggtgaacaatctagaactatgaacatgaaaaaagaggacaatcctaatagcacactcatcatgaattgagggggagaactcctagcctatttgcatggccatggacgtagaatctcctatgctagattggatcggtcctaaaatttatgtcagaatgccatagctgttgagcaagaagctcactatgaagttaattgaatctgatgtaccagaatactttgttgaatcaatatactccgtcatcaattgttgcaattcttgaatagagcattgcatcaaagaaatggttcttgcccaagtagagcacacattttccctgcaataaagaattatttccagtataaaatagcatatttaaagcatttactattttgttgctcttttctagcacatagttataatgctttgaattttgtgtagcacccaaacataagagaaaaggaatgaattgtggtccgcataaccacaaataacattttaagagaaagaggtatttccagacccatagaactggaaacattatgactgttgctagcaacaacaactgaatttgtcggcctagaatgcgccacaatcatattacctatggaacaattgtgcactttatagaagcatctattgtccgtcaatcccgttgaactctctaaaaagtgtgatgatttgggctacacccttttagcaatgaattttcagccattttcggtcttagaattataagaataaaaattacaactcgtatgatcatagcacatatatgcataattttcctaaatcatgaagatttgtgtgccagtatgcaccgacaggatattaatgcataaaccgcatatagttctagcatctctgaactagattgcgaagaataatgtggttcccatttggtactgtatggatatatgcgcttccgaagcagcaaacatcatgttcctcttagacaccgtgtctttgccaaaactgatccagcaagatcacatgaactccaatagaactcactaaatcatcttcagaagtccgcgaggacaatgccagcattgcatttgatgattggtaaattgacagcacgaagtaccaaatattcgcataagcggactaagtataaactatgaattgcaatatttgctatatcattgttgtaatacacgtggtagaaaaggacatgtagtcctgaaagcagcggactctgaaagaaaattcagaccatcggcataaacatccatcctgcaactagtgctattgcatctgtttggtttatgtgcatatcccactatcataatgcgttgcaaaaggctctctccgaaggttggaaaccttttacggagatagttatgaagcctaaattccttgacaaataagaattatttccagtcatttaggggggagagaatgaacccctagataggaaatgtcaggaaatatgatagtagaaagggactaatgcatgttacaccacactagtgaatgcagcttgcataaagaattgaaactgccaaatcactttgtaaatacttttgtgatttcgaagagtttgactaagttgcatgaatgaaatgcaccggagaagggtgataccgaagaaagtaaaggtacccctcgtcttgtctagaggcctcgaacaaaaagaattggacaagaaacttcggctcctcatgcccctaaagtaaccggagacgtctggtgaaaacagggcaagagggactatcatactcaaagtcacgaaaaataccccaccgaatagaaggggagccagttgagatctggcaagtggtacggaacctcagaacaggcgtatcgcaccttcccatcaaggaagaaaactagctgttggagtgtacactaacgctggtacatgcccacatcaaaaggtattaagcaagaaaaagaagaagaagcatatgaaaaatgcatctcctcgtatatccatggatactcgcataaagtctcatacaaccagtagaaattggcagtgagacctatcattgaatggaattaatgaactagaagttgaaatgaagaactcaacctgaatgattgataagcattgaagatagagtcaatgaatgcatttcaggagtttggatcttacacttgcataatagtacatgaagaagtactaggtcccgaaccaacataaaagaatagaataaccagaaaagaactgaagaaaacaaactcgttcgttttgaatttgagtttgatttgaaatatttggccgaatccaaatcatgcttacgcttgcagctaaaggcatgcgacagatggaagtctagtacatcagtccaactgcacttaggaatgttcatggtgcatagctttggaatagtctatatcgccaaaatgggacggaattcctaaacacgagtgtcatagcagcacatgaatacttggctaaatgaactaaaccaaactaagcatcgttgaactgttcagagcctcggcatggttttgagagatggttacccgcgagagcaatcgcgatttgaaaactatctcaacccccaccatttatgaaattaaagcagcatatgtcgcacatatgcaaatgagttatgtgagaagcaaactcactaagcatatgaacccccaagctcctctatgtacattgcatagaagcaacgaactaagtcatgtggaagtattgcagattcatccactaactcattacttacatcttcccttgaataggtgtgcccgagaaatcggaataatgaaacttagataaatgcaaaattcagggggagaatttcgctaactcatttcagaatcttgatatagaaaatcaagtacccaaaatcaatctagaaagattgaaagaagaattgggtgaattgtactctttttcccttggataagttttcccagcagtttcttatcaaggtttttaatgaggcaatccgtgcgacattgcatgcgtatgctatgtactctttctccaaatttttcccactgggtttttgtggagttttgatgaggcatagacatcacgcggtgagtgcccaagggggagtgttaggaaacctatgggcttgggcccatgaaggcccagcccatatacactaattgggcccacactgaaaccttccatatatggaggaaggctatataaggaggagaggggtgctcatattgtacacttgtacttgaggatgatagaatgatgaatgagaagagagtctcacccctacatctcgtgtctccacttttgtagaattacgggacccttttggactacgtcgtgtagcaggagggttgcgtaatagataatcaatcaaccgtctgctgtaaataaggaaattaagagcatcaccaagagatacccaatactactcccaatcctagaattttggagttttacacaaaaaaaggaatccaacagacttccaatcagcatcctaaaaaattagaaatcccaactccataattctcgttctccagttatagggaagacccctgactcccaatccgccagtcacaggcaactcccgcgcacggctgaaatgtcccacagccgtcgcgagctcgttcgctgcagccttagtttgcgccgtcgtcggctcacgaactcatccgttgccacctcccgagctcatacggtggcccatcgcaagctcatgcaccaccggcccatcgcaagctcttccgtcgtccgctcgattcacatcactgacagtctatcgtgaattcgattctctcatcgtcggtccgccatcgaactgatctgcgccactggattcgtgccgccgtcgaattgattcgcgccgtctcagtccatcgcgagcacatccgggcggccctcgattcgcgctgccgccggacatggcgagctcgtctgcgcgtgtccctcgattcttgccgccgtgtcaaactgattcgcgccatctcggcccctcgcgagcacgtttgggcggccctcgattcacgccacagccggccatggcgagctcgtccgcgtccagtccttaattcgcaccgctgctgaactgcttcgtgccgccgtaggccgtcgcgagctcgtcccctcctccccggcgaagccgattcatgccgtccggatcatcataagcgagtcctcggacgtgtgcttgatgcccacgggagagacaggaattgagcaggagagagaaggggtagagggactgatttatgggtcctacctatcaggtaattatatagaagggaggagatcatgtggtcccactttttatgggagtaactgtatatttatggcgtcatatttttcaaaaaaaatagtcggtatgtatttactttgtaagttcctaaattagatatgtaagtttagtgtatttataatgtaagtttcaaaaattgcatatgtaagtttcaaaattacatagtaattacatatgtaagtggagtataaatttaaattttacattggaaaagttataaaacaaaagcatatgcagcacttactttacaggagatgatcaggaggaaatcgaacggtccgaacaggcacagccaaagacatgtagtctcgtacgagcaatcggacggacgttaaagccgactgagatcagcccaaaaagatgtcgacatcttttaagcaagtctccgctttttattaaggaagtcatgtttacataatctgttagaggagagtatattttacaagctcaaatcatgattagaaatctctaaaacatcatctagagaatgggtttattggatatctcttggtgatgctcaacaaagcgcctgcatgcagaagcaatcacgagattaaatagctagctaatgacggtgggccccataaatatatcatatgtgtttgtttgccaatttatctcctcggcacagataagaaccatgcacaagcttagagataatcctgagattagaataatcaatgacagtgggccacatgtcatatgtgcttgcttgaatcgccatgtcacagataattaattaatgaccaaacaatcaaactactagtaacgtaccgtttgtgaaggtagataattctttgttgagcagcacatatttcctctattatgtatcacatttgatttccatttgaaccaatggttttttatgcttaaaatgtacaacaaaacgagtccaaatttgaatatattcagacatcgtatgatatttgaattttctggtcccacacatcatatagatgttcgtcaaatatattttgtaaataacggctgcaaatatcattagcatgtaaaattaatgccaaatgatttattatttttttctatgaattttggttaaaaaattcatcaaacattctgctcaactagtatggcacattataagagttgtttggttggaggtacaaacctgacttcctgggcaccatttgcattttgtcgaggaatttgttgggtaccagtgcagcagtctactcgctccgtcccagaaaaagccaaccagtattagatatgatgtttcctagtccaataaatctggacagactaggttgacttttttaggacggagggagtctgtcagaagtcatgcgcgaaaactgtcacgccccgaactagtcccgaccggaactagcccgtgacgctccaaattaacctgttaatcgataccagtcccaggaaacagtgctggtatcacagggagacagagtatcacagcaacaaaggtctctttattatagagtagaagtacagtcatgttgggctgcggacagatcccgagctcacaactgcattacaaaaggaaagcggaagctaggacttggaccaatcatcacaggcgcgacttgggaactaggccgaaaccctaaaactcatcgtagccgacttgctcctggaagaacacctcgtcagcaggatccacttcatcttcttcagcaactgggggggggaaattatttataaagagcaagggtgagtacgggagtactcagcaagccaggggaaataagtgtttaatgcaggcttcaaggaaaggctgttgttttcataattgattttgtttgaactcttttctaaaaagtctaagtgagtgcttctcaaacgacacggatgagacagtgcgtctcgtccggtcggagtatgtgtaatgcatcaatctttagaattgaaacaagattggcacccggccaacagcttttcaaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgactgtgggcacggctgttcgaacagtttgttaacctctgcagagggggtacactttacccacacgacattactaacccggatcacccagcccgtggggatcagccacgtcgggagacctccaagctttcatgacaaggcattttgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacctatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattatcaatggaaggatcaaatgtaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgcgatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagatttattggatttttggtctaaaggaaaaaggatttatttaaatccttttttttgaaaagaaaaagaaaagatgggagggagggaatatagacttttctcgggtggctagggtgcggcccaagagatttggggcggctcggccgagctcaacggaccggccggcccaagacaagcgcgcgcgcgcgggagggggagccggtggaccgggctcaccacgcgtggtcccgggtgggacccgcttgtcagcggctcggctcaccgtgcggagggagtatgcggcgtacgcgcgcgggcggggctgggacgcggtgcacgcgcgcggttcgcggaggaacggatgcggcgggcccacgcgcagcctcacggctcaccgcggaccacacgcacggggagaaacggagggcgcagctggccgggtcggcttatccggtcgcggccgaggtggcgccgacgtggcgcctacgtggcagccacgcgggccggcgggaggttaggccccttttgttccgccgccaactcttttggagtcgtggcgaggtagtgcgtgcgtgtgttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttaccttgctccttgccctcctaagtgcttgtctgactcttacctcgccctcttctgggagtttagatggctagccgcccccgccgtgcagcccgtgcaccagcccgctttggttttgaagatggtagagttgagccagaagaaaatcatgagtcggctaatgagcagtcacaccacagcaaccgttcgcaccgtactgtttcccgcaacgcagaggttgggcaaccccgccgcagcaaccgctcgcatcgcacagtttcccatgatgcagagatgggacagtctcaccgctctcaccgcactgccagtcacaattctggagaagaacgcctcccttccccacctcatgtggaaaacaacatgcaacacataatggcagttcggaaacaaatcttgcaaggactaaccacagccatagccagttttcagcataatgcgcatggaaatggccaccctcacgtgggcaacaatagatccaagctgacagattttctgaggtcatgtccgccagagttctctcagaccgtcgagcccgtcgaggctgacgattggttgaaagatgttgatagaaaactcaactttgtgcagtgtactcctgttgagaagacactctacgcctctcaccagctaagaggacctgctgcagattggtgggagaattactgcaatgcacaccctgaacccactaacattgcttgggatgagtttgctacggctttccgtgcagctcatgtgcctgaaagcactattgacatgaagaaagaagaattcaacagacttaagcaaggcaacagcagtgtcaatgagtacctaagtcagttcaacaagttagctcggtacgcccctgaagaagtggacacagataagaagaagatcaggaaattcttgaaagggatcgcagttggaatgagactccagttgcttgctcatgatttccccacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaatatcaccagtcggtaactcaggctaaccaccagccaggctacgcccctcgtcctcagatgaaccgtccggcacctcagccacagcagcgtgcccctagtggcaatactgcgccaaacagtgttacctctttcaagtcaccacagggaccgtcagcagttcagtgtttccggtgcaacaggatgggacactatgccagacagtgtcctcggaatcctaccaacaccaactcagggcatgctaatggcagcactgccagaactcctgctccagcggcagctcagtctcttcctagctctcaggcaagtggacaaggttctcgtgcgtccaaccactttggtcgaggacgtgtgaatcacattcaagctgaaaccgctcaggatgctccagacgttgtgatgggtatgttctctgtcaactccgtacccgcaatagttctgtttgattcaggagcttctcattctttcatatcgcaagcttttgtgaaaagaaatggttggaaaacccaaaatttgcgtgtaccgatgatagtacattcccctggaaggaatataagggcaactcaaatatgcccggaagttaaccttagaattgaggaagttgacttcctagccaaaccgatagtcctagactcgcaaagcttggacatcattctagggatggattggttggctaagcacaaaggacagatagattgtgccgaaaagtccatcaccttgcaaggacctggaggaaagcaagtccgctttacccctaacacccctaccgcaagtcggtctatcctaacttgtttacaagtcacctccttggagtcggtgcccatagtctgtgaatatcccgacgtatttccggaagaattaacaagaatgccaccagaccgagagatcgagttcgccatagaactggcaccaggcacagctccaattgcaaaaagaccctaccgaatggcagctaatgagttagcagaagttaaaagacaaatcgaagaactggaaagtaaaggttatgtgcgacctagctcatccccttggggagccccagtgcttctggttaagaaaaaggatggctctgagagaatggtaatcgactatagagccctaaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcaccaatgctccagcattcttcatgaacttaatgaacaaaatctttatggaatgtctggaccagtttgtcgtggtattcatcgatgacatcctgatatactctaagaacgaggaagaacatgctgaacacctgaggttgataatggaaaagctcagggaccatcaactattcgcaaaattctcaaaatgcgaattctggttagaccgagtagcatttcttggacacgtgatctcccccaacggtgtcgaagtagatcccagcaaggttgaagctgtacttgcttggaacccgcccaagaatgtgtcagagattcgcagtttccttggcttagctggatattatcgaagattcattgaaggattctctaagctagccagacctatgaccgagctgttaaagaaggaaaagaaattccaatggtctgtagcctgtgaagacagctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagctcaggcctcatgaagttaattatcccacccatgatctcgagttggcagccgtggttcatgctcttaagatctggaggcattatttaatcgggaacagatgtgaagtatacaccgatcacaaaagtcttaagtatatcttcactcagaccgagttaaatatgagacagagaagatggttggaactaatcaaggattacgatcttggaatccactatcatcctggtaaagccaacgtggtcgctgatgcgctaagtcgcaaggcctattgcaatgtagctcaaatacggcctgaccaagatcacctgtgcagagaattggagaagttaagactgaccgtggtacagtcaggtgtccctgccagcttgacagtacaacctaccctagagtcgcaaatccgggaggctcagaaagacgacgaagggataaaagaattaataaaaagaatacaggagaagaaagacacaaatttctccatagacgatcaaggcacagtttggtgcggaccacgcatctgtgtaccggccaagaaggagttaagagatctcatcttaaaggaagctcatgagtccgcctactccattcacccaggaagtacgaagatgtaccaagatatcaaggcatacttctggtgggctagaatgaagcgagacgtcgcagaatacgtagccctgtgtgacatttgccaaagagtcaaggcggaacatcagaggccagctggtctgctgcaacccctaccgattcccgagtggaaatgggaagagatcggaatggatttcatcaccggtttgccaagaacccccagcgggtacgactccatctgggtaatcgtggaccgactcacgaagtcagctcatttcgtgccagtgaaaaccacctatgatggaaagaaactagcagaactctacatgactcatgtcgtatgtagatttggctgtcccaagaaaatagtgtcggaccgaggcactcagttcacctcaaggttctggaagtagttgcatgaagccctcggaacttatctgaattttagtacagcctaccatccgcagaccgatggtcagaccgaaagggtaaaccaaatcctagaagacatgctacgtgcgtgtgccttggatttcgaaggcacttgggatcgttgtttgccgtatgctgagttctcatacaacaacagttatcaggccagcattcagatgtcgccgaatgaggcaatgttcggaagaaagtgccgcacccccttgtgctgggatgaggtgggcgaagccctggtattcggtcctgacatactcaagtcagcagaagaacaagttaagctgatccgagaacgtttaaagacagcgcagaaccgtcagaaaaattacgctgacaatcggagacgtgaccttgagttcgaaaagggagatcatgtgtacctgcgagtatcacccctccgtggtatgagaaggtttgggatgtccggcaagttagcaccccgctacatcggcccctacctcataaccgccagacgtggcgaagtggcttatcagcttgagctacctgaaggtctcgcagacgtgcacaacgtgttccacgtatcccagttaaagaaatgtcttcgagttccagaagagcaagttcccctgggtaatatcgagctggaaaagaatctgacctacaaggaaagaccgatcaaggttcttgaagaggcagaacgtcagactcgaaggaagaccatcaagttctacaaagtccaatggagcaatcattccgaagacgaggcaacctgggagcgagaagatcttctccgcgccgagttcccggacctactcccttaggtgctgaatctcggggtcgagattcttgttaggggggttggtctgtagcgcccgttccgtcgtggcgcctagcgggaaaattatctcttaaaaaccctaattgcgaaatttgtttctttgcttgttgtctagtgtccgtgccatctcaagatctcaatccgcaatcgatcgtcgagatcaattccgaatccaattccttccaaatcgaatccctccgcaaaagtctagtttgcctccctcgggttcgatgggccgaattccgctcggcccatctcttccccggccccccctctctctctcccgggcgccccctctctctctctctatctctctctctctctcgctccctccccccccccggcgcgttccccccccctcgctgctcgcgcgtgcgagagccgcgccgagcgcctctctttccgctcccctccgctccgcccgcgcaccgcgcgcgcgtgcgcgggagtcgcctgcaccgagcgccccctcctctcgcgcgagctccccgctcgcaaagccggccccgcgcgccgttgctcgcgcgcgcgccgcgtggtttcccgcccaagccgcgtcgtctgcgccgtccgcgtcgcccggtcccgctgcccagccgcgccgcccgttgcttcccgcgcgcgcgtgccgagtggccgaccgcctggtcgccgccgccgtcaccctctgccgcgccagcccgcgcctgtcgcccgtgtcgtcgcgccgctccaaaccatcccaccgtcatcgccgtcgtcatcccccggcccccgccactccgcgcgcaagccgccaagaggcggaggccgagctctcccttccctctgccgcgtcgccccgctccctcctccttttcccgattcggcaaaggggcaagcccctttctctccctccttttcccctttccttcctttttcccctctcgccggcgtcacctcctgtcgccgctttggacgctagccggagcgccagctcgccggcttgaccgctcaatgtcggtttccctcgcccaaaccgacaataccgcccatttaagcccaagccctccccctccaaactctctcattttcgcctccgcgccattgccgccctctgtttcaccgtcgccgatcgtcgttgcgcgtgtcggaggagccggcacgagcaaggacgcggaagaggactccggccgcgccctcttcttcctcttccccggcccgaggccggagagattactcccgcgccgtcggcctctcgtcacatcgcctcgtcccgcacggtagtgtctccctccgttcttcctcctcgctccatctcctccccttagatttcggtagtagctcgggtagcctccccgtagttagctggcgccgccccgaccgttgccatcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcccctcgtggcctcatcgccgtttccctcttccctcgccgccggttgccgccgccgcaatccgccgccgtcgagcaacctccggcgaatccgagccgttggctcgtctcccctcgtcctgtgcagccacccggtgtgctcgttttcgccggtatcgccgtggctcgctccgccgctcgccgctgtcgcccgccgtccattcgcggccgggtcgtcgtctacctcccgccggcccgcgtggctgccacgtaggcgccacgtcggcgccacctcggccgcgaccggataagccgacccggccagccgcgccctccgtttctccccgtgcgtgtggtccgcggtgagccgtgaggctgcgcgtgggcccgccgcatccgttcctccgcgaaccgcgcgcgtgcaccgcgtcccagccccgcccgcgcgcgtacgccgcatactccctccgcacggtgagccgagccgctgacaagcgggtcccacccgggaccacgcgtggtgagcccggtccaccggctccccctcccgcgcgcgcgcgcttgggccgtcttgggccggccggtccgttgagctcggccgagccg

SEQ ID NO: 79627 - DNA, 3612 bp, Oryza sativa
agaagtaattaatcacatcatccaagtgagattgaagttctgcctcattatctcattatctgttcacctggtttttgttcctccgtgcctctttcgaacgtatccttcaaggttcacatgtgtggtcaattagaagcattctacaagtattaatagtatgtaagtttggtgttatttgtacttacaatgtgtagcactttaacaagccggtgtccactgctcgtagcttatagaggtaaaaaagatccgagaaggccactgcaaaataattttgttgccccaaggatggttcttggtcgtggtaacctactatggacgtgtccctcatcttgctcttggagtttgttttctccatgtagtatctatgcagcacttggcaagcagaacccattttggctaactcatggtctgcaaccaatggcacctgttgctgaaatgtacctggagcttgttttttggagtaacgttgacctccttatccagatctagttgtttgggaggtaactacggctcttgtgcctttctttttccttttgatctatctcttgcatgatgcgcccttctttgcaccatcggtggagatgaaatggccttggtgttttgcggaggagggtgaagtttggccatttcaccgaagtccgtaccatggctctcaaatggagcttcgatggccagaggaggtgaagggacttttgtggaagaatctgggcgaggtggagctggagctaaagttgtcctcaaagtgaccttgatgatgatgaggtcttttagccattggatgaagataccacgggattggaagttgccagttcatccaatcagcattcaccatgtcaacttgtactttgacatgtctagccaccaaatctgcaccgcgaactcttgtttatggagtaggtttgtatggttagccctcggcagcatgacaacagaatgtttgtgtaaccctaacttgtaggatgcattgggctacgccctgcatacaatccagaaaaaaatattagtttaagttgtacgaatcacatcagctacaacgagaactactattcgactgagacaggtggatgtcattctggaatcccagttgacaaacaactacttcgccgctgcaggggctcacttgcacttcttctggatgtccgttgtcctcgttcctttttggctagcatctcttcccttatcctagcctcaattccgtgtaatttttcattgaattcatggctaagttcactattgacggtccttaaatcataatatcagaccgtcaatacctgcatataatgaaataaacacatggtatccaacttagtggtaggtgttattactaatcatttccactagtgttggtgaaatatatgtatgcaggtaatttgaggagaaaacacatccgtcatgtgacaaaatgcacctccgcgcattcaggacgcgtttagacggattagaggcccaataagtcaataaaaaccatttagaattgggccaaaacatagcccaggttgtttggggcccattaaccaacctcccgaccgaaggagaggccgggaggagagtttttgggttcggccgaacctaccagttcgggcggaccaatcctggtgcttcctgtcatctgctttcacctggacggctcgaatttctctcctaaggcggttgcagcgtgttttggtcatttcccatacccctaaccgtcatttggagcctatataaggagctcttcatctcacttcaagcacacacaactttgagctgaattacaagaggctctattgtatcttttgtacattagaaataggtagaaagcgaggggaagctctgaaggagtgcccggaagtttggcgctcatccgacttctgcctcgacgagtgtagcttcctaggaggaattctgaaggagtactggagtatcggtgagtactggagtactggccgagtagcttcctagatggctacgaaatcagtcttggctttatagccatggttcgagagaaaaccttctctggtagtatcggtgaaaatccatacctccatcttcaggactttgagctagtgtgttcgtgcctatctatcgtcggcatgacacatgatactcttaagtggaaattgtttcctttttctcgtagagatgaagctaagcaatggtacactctatctgtcaagaaattccactgtgaatgggaggagcttaagtgcaatttctgccttactttctttccattaacccgtgtaatcaatctttgagtagacatcctttcttttcgacagaatgagaaggaatatctcggtgcagcctaggccagtttctcactgttaactcaatctggcccagacttgtcgttacccgaccacgtgttgttgcaacattttcggtacgggttagacaaggagtttgccgaaaatctcaatatttctgccggaggatcgttcgcacacaagacaaccgccgaaggaagagaactcttagatttgatcttagagaacgattctttcggccgaagcgaagccgtcccgaaggtcgagattattcatgaggaacctctgcacgtggagttggaacccgactcaactgtcgaatcctcatcccggtcgcaggagccggaggaagaagaaattcatcctccggaaatttcattccaattcgaggaggatcttttcgaagattattagaacaccttgaattattcctgagagaagagaccaccgaccaaggtcaattctaatgaacctcttgataaatctatgcttaaagagacggtgaagaggttgaccatcatcatgagtaacaaatggttaagagaaggagagctcttatctgaatcgattcagatccgatgcccctcctcaaccattatgtgtcacattggaggtaattcggtccgtgctctgtataatccctctgttggtgccaatattatgtccgcaacctttgcattcgattgcttaggggacagatcgttggaaccaaccgtcagaaccttccgaatttccacaaactctactaccgaaggtttagggattatctctggagtgcccacacggcacaacagtgttgaggtcatattagattttcatgtgtttgaaatatatgatttcgacatactcatagggcatcccatagaaaaactcttagatgtgcccgaaaccggtgtccttaacctgaaaataggaagaattgccacctccgtccctatgttgcaatcaaccaattctttgatggagtctcttcctgttcctgagccaattgagggagtgatggctatttctccattcgagaccctagagtctattttcgatgaatccatcgaagaattcaatgaaggggaggatgaaactggagaaacgatggatctgccaaaaacggatctgccgtcacgagccccaattgagctaaagcccttaccgtcaagcctaagttatgcctttctgaacagcgatgcggagtctctagtcattataagtgacaaactctctgagagggagatggcccgacttatcgccattttagaaaagcatagtgctgcttttggctattccctccaagacttaaaaggcatcagtccgaccctttgcactcatcgcattctcttagaaccgtctagcacaccatctagggaac

SEQ ID NO: 79628 - DNA, 25562 bp, Oryza sativa
  unsure (1)..(25562): unsure at all n locations
gtcacgctgcgtgacaacgaaggtaacatctttaaggtaaatggccattgtttaaaagttttccttgatccgttagaagttgatcatgacttggatgttgtgaatcttgtctcttttagcttctacccggagtctttaggtccccccttgatccgttagttttcaatgccatgagtccttaggcctccctctagttatcttaggtctagctttcatgataaaaataaaaaaataaaaaaaaataaagttggctccttggtcttccaaccatgtgagccctttttgcttcactcttgtctttctttttcttttttgtgtccaataaagcctctcatatacgaagacaagtgtgggggtgatcttgcacatcaacgccgtaacaaaagcaagatcaccccagacgagctatgacaaaccacacacgggaaattgatgcagttagacctagtgaggggtcagccaaatctccagttcggctaaactatctctaccaaggatcattttctattttatacagagcgcatgtttgcacaatttttcctttggacatccattctatcttgagtttaatttgactatcaattctaaaatatcgaagataattaaactcaaactagggatggtacaattagagttcatggtctccctgaaaatagcatgcatgcctattattctttgctcattacttgttgcttgtggtgacttatccaatagggaccccatgctatctaagtaattgatgaatgagatatagtctgatgatagaaattctgctcttcatgttgcacacttgggaattttataaaatgaaaaaaaacttgtataatgatgctaaactgctcattgatatttttattcccacttgagccataggttgatcattaataattagcttgctacatacgctgcttgtcattacattgagcgttgtcaagttttgtgaccctagtgaaatgcttttcatactttcatggtcaagatcacacacattccacatacacccacctattcttgacttctacactgcaagttagcattcctcatttgtcattcatttcatccatcaaataaatactcatacaagttctttcaaaaaaaagttgagagagaggcatggctatgcaaaaagaaagaaaaaaaatgctcatacaagtattgagcatgatgatgagaaaaaaaagaaaaagaaaaaaaagagatagccatgcactcttgaaattttcaaagagaaataaatggaagaggatgtatacaaaaggagttattgattcattttttttccacccacaaatttaccatacacatacacatacacatgcacattcttgaccagaaagtatgttttgtatttccgtggatccattatttgactttgcaatatatgtgatgcaagtaatgctctactcttttccataccctgagctccacaaaagccttattagatggtaggaaaagaaaaggcacaatcatatgccttgtgaggaatcatacactttgagcgatcgaaagaatcaatggaggagcaaagcatagttataattttgtgttacctcaaaaaccacaagttgttcttcatgaaaaattagggtgacttaatgtcaagattgttccatttctcaattgctcaagatcgcatggtagacactataaagatcgacaagtacaggtatggctttgaataatttgtttgcatgatgattagttaggaagtcataactctgttgtagagtccatagccttcactcgggatgagcaaaggttaagtgtgggggtgttgttgacggtccttaaatcataatatctgaccatcaatacctgcaaataatgaaataaaacacggtatccaacttagtggtaggtgttattactaatcatttccactagtgttggtgaaatatgtgtatgcaggtaatttgaggagaaaacacatccgtcatgtgacaaaatgcacctccgcacattcaggatgcgtttacacggattagaggcccaataagtcaataaaaactatttagaattggaccaaaacatcgcccaggttgttgggggcccattaaccaacctcccgaccaaaggagaggccaggaggagagtttttgggttcggccgaaccaatcctggtgcttcccgccaactactttcacctggacgtctcggatttctccccttaggcagttgcagggtgttttggtcatttcccatacccctaactgtcatttggagcctatataaggaggtcttcatctcacttcaagcacacacaactttgagctgaattacaagaggctctattgtatcttttgtacattagaaataggtagaaagtgaggggaagctctagaggagtgcccggaagtttggcgctcatccgacttctgcctcgacgagtgtagcttcgtagtaggaattctggaggagtactggagctgttggtacactttgctctaggttcagagaacttcttctattaagtaagcattcgtgttcctttcttatgttatttaattacttagtctgagtaagatatatttccatctttgcaggttcattatttagtatttatactaagtgctctagtactaggactccggatagagaaggaatttcctgcgcaagtattagagaagtaattaataacttaggcctggtgtctaggttagagattacctttgtttgttgtgtatcccacggatttgtcagaggtagacggcaggtggtgacagccctgaattccgtcctagtaatcctccatgttcgggtacatcatagagctatagccggaaccacactgacagaccagcaggggtcggtgcccgtagcaacagataggaaattacctttgcttagcttagataattaaaacacagagaaagtcctctctagcctgcctacctatagttgttgtccttggatcgtcttagccctaggtagattacacacattccctgagtttgatatccttttggggtcacccgaaggtgaagtgctacagcggtattccgtgcgcttgtggatttatctttggtcgtaagaaataccaacattcacccatgacctcccttacaatatgttctctaagatgatcttctgtctgttccttagtttgtttaacctcccttacaatctattctctaagacgaccctctctttgttccttagtttgtttgcgcttcctgtgttgtgcgttgtacttggccatcccaatgttccaaggaatgttgcatcctgtccctctagtccggccagcctgttgttggtatttcttaacgatattactagaaatatgaattcccagcaatggcgctagaaatggtcctggtatatatatggtttacagaaagaatccgcaagcgcacggatttaccattgtagcatttcacccgggagtattctaaggtatcgtatttatttaatcgcaagggaagattgtaagagagaactatgctaataatatatatacatgccacttacataatcaaagtctaagcatgggttaaaatatttatatgggtagagtgacacgaagcaaagcactcatatttcttctttaatcatttctgaactaagtggaagaagaaatagaaaaaacaatcaattcctataattctaatatacactcaactttagtctacatctactagtatacaaccatatagccaataccccctaacagtgccctcctggtgcttcgagagactaccccgggttgccgagtttcttacgacaacctaccatggccgtccaacctaggctaaatacggaggagtaccctccctaggaaagtttcttaggattagatactatcgtggaggaatacccgtactgagctgtcacaattagcagcccacctttactgactcgtagcatataaacccagataatgatacttagtaatctagacaccctgtctacattattaaatactactctacatccctcgagatgacatagagcaaccgagtaatcggacattaaacccacaccattgcacctctctggtaggctaactatatgactgtaccaatacaaacataaagtaaagacaatacttagatgaactaaagtatcgagagcatatgaagaagaattgatccagatctacctatcaatagtacattgttctttacttacagatcagaacaaaaggtgagctcatttctctctaagtctatgtgtgaaatatatgagaatttgatgctacataatatttcgcacttgagagattggaacccttggctggcataaacaacatgtgggtccagtcggaggtgaccgttgtagcggcgtacatgaggaagatcaattgctattctgttcatgaagttcatggagaattctgcattgatgagaaggctttcaacatgaatggcttatatactaggaaaggttatcaagtccactttccatcggatcaaacggcatgtcattccgagctttctaccaacggcaatctcaagttgaagacatcatgtgcgggtagaacgggcaacgcgcaagtaacaacaatggtgatgaacgtcggctttgaacggcatgtttggatggagttatactatcctatggcccatcttgggttgggaaggagtccatctataatttctccatggattgaagccttccaaagcaaggagtttctagacaaggaagaaaagattcagttcggactcggtttgggccagcctggatataccaggactaaaacgcccgtttctgtctcgtccggagtccgttttggacgtgtgagcacttgttgaaaagctaacttcatgacacacttggtggatagggcctaggacacaaattccttctggtttcacctcaagagccaaatcaaattgacggtgctgcagagaggtttctatattgtgttgtatttgattcgtagttagtttctaacacatgtaatggctatatatgcctttgtacacgacccctgagggcagaccaagtttaatcaaaagaaaatttgcagcaaatttagtcttgttcttcttctagagtatttattccgtggatgacaaatgtggtatatggtggaatggagtgtatgtgtcacgcctagagattagacaacccgaatcaccggctatctgtgcatttaacctctatccaggcatcaagcagagtacacagatgataatttgatacagttccacgtcttacaaaaatataaaaaaactcagaaaagcagcaaaaaaactaaagaccatctaaacttattcttctcagcaaagggaagcttccaccataatccacaggcaaaacctcgacgtctggcacaagcctaatcttcatagaactcaccatccgacaaattctctgcctctgggattgggaaaaataaagcaaggctgagtaccaccaccgtactcaacaactcataccaaggggaaggtatcatgcaaggatattcaaaggaatggctgataggatatttgaagtaagaagcagcatttataaatcataagttgaaagcagtaaaatagtagataattaagtagtattaacatcatcactatccaacgctaaaaccatgttatgataggtccaacccaaaccacctgaactacaccagttcattaggtcaaattattaaggtgagactagtcacggtgagctggttgaccgcccaataaccgcaggcacggctattcaaatagttttactctgattagagtgtacaactttactcacaagacacgattccacacatgttaccatgccccgaagtaccaccgagatactacaaagggggaaatcatgacaaaccctccatatagcctcccctaaccaacacacccacctccggtttcacccccatccctatacaggcaatgtgcagtccctgctcgtgccaaggtaaatccggaaggagcatagaccaaaatccaggtccatctgtactccatcactgtcgtaggctctccggaccttccattataattgagagatgaaatgaataactaaaatcatcaaacaagtacaatgaaatatccgacgcctcaagagaggaatattggagacattgctgggcctttagcctgccagtcaacttttgcctgagatgtgctcgtcaaaccactcgaaggcagcgaccagatgtgttacacattcaggagacttgacaaaaatggctaaagatctacaacatctcaaatattcttaactcatactcatgtgaatctagctcccaggatgtgcactagactcacactttcatctcaatcatagatatacatagcaaacacaattaagatgaaagtgattataaactacatctactttagttacattggccgaccggccaaataaataatagaacaacggaagcttgtctacccaatccacaagtgcaccgactagcggtttaccctagaagaagcagtcgattacctgcatcactcaaagactaagtctaaacctgcaaacaaaaggttaattcaacagcaagagtcagtacattatttctaggacttgcctaacactctacttgcaaggcatataatcaaagaaggcatgatatggttctttttagcataaagcaagttttatttgtataaaacatttccaaatcagttttgctttcaaataaatttcagcaagcaagtacttgacatattgggcatcaaagtagtcattaatcatgtataaatatacacctcattgccatccatggtagcaaggagatcattcacaaatctcatcacattttgaagttaaatttcagaatttagaagaataaacacaagtctatactcaatacatatccacacgccgctcatgaccgcgagcacggctaatcgattagttttaactctgcagagtttctacactttacccacatgatgcgaaataataatcatgcaagagcatggcacgcgataaataaatacccgatttattacccgcatcaaagcttttccaaaattcatgatttagccttacaccagcacgatacgtgttcctccatcctagtcatactggaaatatgacctagaaccgttaagtggcgggcccacgccttaaacttaatgccatggtggcggacacaacgggaaccctccacgtggcacaataccgttgtattggacacgcttagtcacctaaactaccacttcggggtaaatatgaagctcctctaaattattcaaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcacactctccccctatcggtacacatctaatcaccatatatgcaccgcttgaggcccaaacctaaaatccatgttttccaccattttatttatcgaaataataagtattaaagttctgtccagattatttaaaaatcaattttcatgtttgtaatgagcccataatgacaaggaagaccattctaagcatggctaagcattatagtaacctagtgtcaccaaaactcatatataaagtggtatagtcatattgctcctaaggttatgaatgagggatatagatatatgtggggttaaggtgataatgcaaataataggagtttgtctaacgagtttaacaaaattttaatttattagtgtacaatcgacatgaaagatttgcaaacattttcaataacctctaaaacataggttcaaagtgatcaaagagagggagctgggacttgccttgcaactgaaaaatgtcagcacctaattcacttcttcaccgtttaagcaatcatctatacaaagtacacattatgcaattaaacaccgaaatatgcgaaaattccaaaatgctctaaaatgcttgatttgtgcacaatggataggtactggtataatatgaatttaggtgaaagaatttctattttatctctttttatttgagagttatgaattttagaagtttgctcggtatagggtagtatttatttaggtactattgtgaaatgctgttgtaaggtgattcttattaagtttatgtttgctgaggtgaagatatgtgttttctaagactaacacatttggtttcataatttagagttaatatgaattctttatgtattttacaagttttagtgtgttctaggcatatagtctttatgtgcacatggctttggagatttagatccagaacttgctctaacttgctagtgttgtataaaatgagtattttagttaactaatctaatcttagttcataattttagagtttatattattttactacacattttataaatacggatgttttatgttagttacttaacttatcaaccaaaagattgttgcatgagctaagttcatctaagttttggtagatggggatggaactatggctccactggtcctaacaagttttattttgatttatttggagctaccatgcatatatatacttattcatatgtattgtttaaccactattatgcgtttagtacctattcttccaaattaaggtttagagttatggtctgtacaaccaaattaaggtttagagttatggtctgtacagagggtgccataattcactctactaggttgaagtatattacttgctggttctacagaaatttggttcacttcatttagactaaagatgaattttctacaaattttacaatttaaggtatgctccatgttgcttattccttacataaatgcttaggggttcttattatactgtaagtatgtctttttattttataacattgaagtgcacaactctgtaattctatagaacttgagtttactcaaaaaggatctaagatgaattttatataaacttctaaatttcagcttatgcaaaactagttattttaaagataatagttttagaggcatttgatgtaaagtatgtatatgttttattttactttgtttttagggaacatgttggtggatatgtagaaactaagttttctctaaaatgagttgaaatgaattttgtttgcattttataagtttgtatatgctttatgtatgatttatcttagaccaaatttagaggctacatttgtactgtgagtgcaagtttttatgaaataacactaatttcatgattcgatgagttaacagtaatttgtattactctaaaacgagttgttttcaatttgttaacgattttacaagtttacatgtttttctgatgaaaatataaagctttaggcatttcatttagatttttccagaatttaaatagattgggtccacaggtcagtctcaagccaatatgcagaaaggcccttagtgtttcaggaaatcaacccgcagtcctgtgactgttctgtgtgtgaggtaggttttacaaagtagtacctagagttttgattcttctcaatcgaggtccttagattgagctgacacagagctagccatggccgagctcattctcgagctcgctggcggcaaacggcggcagatctcggtgtgcaacctaaggagaaaatgtaaaggggttcaaggtgaggctataggtggtattcttgcaagcattggtcatcgaaattaatggcgacggcggtgcgagcggcggtggttctcgggtgacggtgcatgtggagctagggcattgatctaaatgtttatctacatgcatgtgcctctatgggatcctaggatgcttaccgagcgtccaaagaaacttggcgaggtccagatagcgatgaccacgagcagaacgactcggcggcggcaagaacctccaggttgaacggcgacggctcaatcggctccaagaacaatcatgcatgtatgtccatgaggttattgaggccagagagatggtgtgtgcacgagtaatcgaataatggctcactggaggaggcggaatcgacaatggcgacggcgaccggaggtgaagaagacggtgggccgatctccgcacttgttgcgccattgcctgggattttttgaggggttttgaggaggacttcaaggagaagatgttggcgcgacggctcggcttggcttggtctacagcggttggaatgacgacgagaacccgacggctggcactcggtgttcgctccggagcaacgatggcgaggtccacgttcccgacgatccgcggcaccaaatgggatgaaacttagaggaatgaaatcagcttggagaggtgataatggaacgcaagtggaaaggcgacgaccgcggcacaatgtcgacggcgacggccgtcgtcttcatggccgatggcaaggatgagggcagcggaggcgaggcgatccctctctctcgatttggtctacacagaagtggtaatggagaggaggcgatgcagctaggaagagttgaaagcgagctcggcgttttgaggatggcgacacgtcgtgtacacgtgtcagccacgcccagaacgcctctcctccctctctcacgcctgctggtcggttaaaggagttggacggggagagggcaagcccaagtggctgccaagcgggcccaggtcgtggtaaactaggtggaagagagaggtgtgggtagaaacatgggtgagtttggtttttggacgaatttccggaattattttcctcctctaactttgtagcttcgtaacttaatgtgtgataacttaatgtgtggaccacattaactagtgttgattttactggaggtagatgattatacctagattccattttatttggttgcacttaaaaattatggatagattactcacagaaattaggagaagaggggctctttggaaactagtttggatttttaggagacctaaaaatagaagataaattctggaaaaaaaatatatttatttattataattaacctagtatttgaataaattattttccctatacgcttccatgcagctaaatgctcttttagacaaagtatggttttagctgattaggaattataattagtctattatttgagtggtttgactgatttattcgaggtataaaatttagttatgaaattataccaaaattacagtgagttgtatatgttaagtagagcctacatgaattttcccacgattttatcttgcacgaattattttagataattcgcaagacttatgtcttatatgtgtttccctttcctaaatgcatgtaaatgtttacaaaagttatatttggactctcaaaaatggaaaagttagcttccaactattttgactggaaacttttaaggtctaaaatttggatatgttataatcacgcccacccttgccaacggtgtgttagctagaaaagatatacttaagatttagcctggagcgcatctggcatgtggttagtacgagtatatcttccagtgattcctgagaaccggtcgttaattgtcatgggcacaaccaccaatcaaatcatgcatgtgcccacgacccaccattatagcatattttaattaattaattatataccaaggtggtataacatcatcataaaaattaaggactaaaatatagtgaatcccattgtgagctagttgatcttagcatggctaagcattcctaaaccaatcatctagtcaaattaatatcccaggctaccgatgaatcagggtattcaaaagggctgagtatggtaaattccatcccacatgacattataaaacaatgcaattttaagagaaaagcagggattttgcaagtacgctcaatatgatcaatgatatccatatgacttgccttgctcttgagctgacggaacctcagcgaccactttaaaataaactggagcgacggaactgctggagtctaaacgacaaacaaggcacacaatgaatacaagttaaaagctactgaaacagcaaaagaaaccaattttaatggattcttgacgtttaacgaatttactgcaatttgaatgggttaaaatggagctcggatgaattagatatgaattttacaaggtgaactcttttattactaataaccgaaaaaccttaatcatttgacatagattattgcccaaaaggaaatatgatcaaaggatagattaacattggtgagcgaaccttacgagataccgactcaacgagtcaaatctacgtgacacgggaccatccaaatgatcaaccgaaaccggcgaacgaaaccggcggctctgaatggctctaaactaaggaacgactcaacatggatgaacgaacgaaacacggggcgacaccttgttcaaactaatgagcgagtgactcaacaatggctgcggctaaatcggtaggctagacacgatttagggtaaagcctcggtacggcaaacgataggccggtaggaatttgtggttgcacttaggtgttggtatttctgacgatcataaataaacccgcaagcgcacggaatataccaatatagcacttcacccgggagtattcttaggtatcgatttccacagggaacgtgtgtgctaactccggttcaggttcatccaaagacacgaagctatggataggcaaaggatagagaggtttcaccggtgaagaacaatgtctacggaaagcttaacttcaatcctaatgaggtacttcgggcactggccagctcactgctcccagatatcgctgtactgcacacccggacagggaggacttagtgatattgagggctatcaccacctctacacccacctcacacctactgtgggatggggagcaaacatcggaaatcaactacctagacaccgcatctacgcagttaataactactctagtgtttataactcactaaagcaatcactatagtttagttgattatagtgaacgatgatcccacactctgaataggaactaaccaataaataattcttaaagagcaaaactaaattattcaaaagatatttcaattataatcagagtaataaacagagcagaaagaataagaggaggattaccgacaactccggagctcctccgaaatcttctactcaactctctccctaatcttgtataaaataaagtacaatagatcctcttataattcagctcatgcttcaagtgtgtgtttacaagtgaggatgagaggggtatttataggtagagaagtgccttgggagtgtggagatgctccaagcattcaaagagcatcttctctcatgtgttgccaagtgtcccattctgatgacggtttctaccggtattaacgccataaccgtcaaatggaagtggagcactaccgaactgaacttgggcctaggccagcagcctctgtcagggttcggccgaaccctagccgactccattaacgccgattttcggcgtggacattcattttgggcccctcattctattggtatggatggaaggcccatttggaggtgtttaattgggtttctgggtccaaaactccatatgttcatatacgcttttgattctcctcctccttcaggtatatttcttctcaacttaggtagtttgtcacttgcatacgaatatacacgaacactcgtggaaattgttagaaataaaccctacaactatgttggatgtttatatttatggttttatgcagatattgatggcttaaattttgtatttaacagccgtcaacaaacccacacacttagctctttactcgtcccgagtaaaggttaaggattaatatggaataaaatttcccaaaatataatacaagtacacaaattattcttagccatatctgcacctgtgaactttgagtatctaacttaccatcttgggtaattgataaatggaacggtcatgactcaagtccttcatgttcctcctgtcaatctcttggggttttcatatattttcacaaagtagctatactcctcaatggactttctctcaaatcactcatgtggtttgatttgtggatcttcaccaaggcatgtttgtcaaaatgtctctattctaaaaggctagataggtggagcttggtagggatcaattggggcatacctgcatcacatattgcaaagccaaaagaccggacccaaggagatagcaagtcatactctctgatcaagaatgtgcatgtgtgtgatatgtgtacgtgtatggcaaattctgtggatggaaaaaggaaaataaaagacaacaactcctttcgtatacatcctcctccaattttctctctttggaaatttgagagagtgcatggctatcttttttcttcttttttttttcatcatgccacatactttgtatgagcaagttttttttctctttctttttgttttcactgctccatacttgtatgagcaaggctttatttctttttcttttgcatagccatgcctctctctatctttttttcttttgaaagaattttggaggaaaaggcataaatgacatggagtttttattttgtggataatagataaaataaataatggaagagagatgctagcttgcagtgtagaagtttagcataagtgtgtgtatgtggagtgtacgtgatcttgatcatgaaagtatgaaaagcatctcacacgggtcacaagaatttgacaaagctcaatgtaatgccatgtagcctaaacatatatcaggattttgtaatgagaatcatatatggccttggtaggtaataatatagtcactgaggagtattgctcgaaaagaatttttgattttcacaaaataaatcccaagtatcatgacagttggacatgaatttctattgtcataaccatatcacatatatcaattacttatattagcaaggttccctatgatagatggttgttcacaactaacaagtgttagcaaagaataaaaagtatacatgataaatcattggaaaattctatctgttgagtgttaatgcttcaattttcatttggagccaaactaaattgtgttcaattttctaccaaagtttaactcacaatcatgggaggtgtggagattatgggtaccccatacccacacgatatggttatccgactaattataggggataacttgtatctatggaatatgtaacggatcatgacatgggtattacggtattacgtttccttgtatattatggaatggcctaaagtcctggtttgctaattttgtaaagtagatttagcaaaccgatactgcattggttaaggtttctatcttgtaatcttgccccccatgctatataaggtggacaggaggtcctctaggggggcatattcacatatgatcatcagatcaatactacacctggcggattcaaattcccaaataggagtagggtattacctctcatcgagagggcctgaacctgtttaaatctttgtctccacatccatccacttttaggtctcgtgcgctaccccattttattgttgccgaattcttgtttcgacaggaggataaggaaggacacctacaaacctgactacacggtgaaggatgacagcaccgggctaggcaaggggcgagagaacacttggttcggccaacccagctaggacatggttctggctgctgagttttgtgcgtgtccgtgggacaatgttcatcatgttgtccaccggggtgaaataccggtgagccaaattttattcaagtaactcaaggcacatgaagtgcctaaattttttttttatttattttcatattttttcatggcaacaatggaggttatgggtaacttagcagggtggagatatgaggcgcggatgcacaaggtgtttcagatacttaccagacggatcttaccaaacttagaactgaattgaatgcaacgaagttttgcatttgttctacttggttccctgtgcaacaagcttcacagctttctatgataccaaggagcgtgggattggtgttggagttattgtacaccgctccttggttgtcactttattccctgcaaaaggttagtggacaacaaatactagagggactacaaagaattggaaagattttttcatagcctcaagattaattgttaacatctacgctaaaaaggaattggattcaaaacttaggaagcatggatcccacaaatttgccataattttattttgtcttcattttttttcttcgagagacatttcttttattctttaaaacattttttttaatgttttattgttcaccaaattttcattaagcaaaaactcatacaggacttacagataaaattgcacgatcataacaaaggagcaattgacagtatacttactttgcaccttgaaaggtgatgtgttactctctttgcatgtttgcaatttattgatttgtttcccgaaccctgacttacctctagtgtgaattgaacttgaggactcacccatgaatttgaaaactttcctgcagggggttagtccacaaaagatatgcatctgaaagttcattaagcaaatttgactccatgtctaatttgattaaagcagactatctaaacctatagatgtcttgcgcaaacacccaaaccagagcatatgcaaatagacacaagaaacataacccatgtatgctcaagcctcattcaaataaagataagtatgagtaaaagatgtggtgaatctttcgctaccttttgtatacctaagtgtacttaccgccagcacgatgtgtatgttgaattctctggagcggtgctatggtcgcatgtaattgtcgatctcccatcagtcttgatgcggattgtggcaagggaaggctgatgaggacacaactagctcgcatataaccatgactaccttatgtattagtcaaccaaaggtgcatatgttctacattagatttacttgttatatatttgaacaaacgttgctacacaatgagttttgtgtgttttcgtttgcagaggtagttgcttgggcgaaagaaaagagaccgagcataaggaatgcatggatgattgaagaagttgattggggaccaaaccaagaccttctcctagtcttctttcatctcaccacgtcacttttggtccatagaagacaagaaataaagttccacacgttttgggttcggattcaggcctcctgatagcaccaacttcaaatggacctagccactgatcaagaaggaattttggggcccatgagtacttgttggaaagcttatggagtctaatttcagatggttttggtcccacgtcaaaattcctaccgggctgccgggaatctgcaaaacaagccatgtacctcatccaatctgtatctgatttcggttttgggccttgtaattgtgtcgtgggctcccaagggggtgtgcgccctagggcaaccctaggacgtccctaatcataattaatcagtagccgtcgtcgtttagagttgggttttgcttagattattttgttaagaacagtttcgctgctagatcggtttgtggaaccccaaattcgagtgcttaataattcatatgcaattgtgttgcaatctatcttgttcttgcttttgttcttctattcgcatgcagggattagccttctcggcgaggtcaaccaggtttaggcacggttgataaccagaggagacgtggtgctgcgattgcggggcttagtagcgtattcgttcagaagccagatcgagttgtgtcgcgactccgcccaaatcgattgtttatcaatacctatcggaagattaggacctaactccctcatcagttggcactttgaccacaccaactcaggcgagtggttcggttatgcacacaactcgggtgcatgaaccttatgccttgaaggcgtgttccattggtagaatgctgtagagacgtagggtgcatctctttttgggcaaatatgcaagttccaactggagtggagtagcaaacacctagaaaagaagagggcgtctcctcttgcttgtgtgcgagtaggtgctgcgggagcgagaacttgtgcacaactaggagtggatgaaggctaaccaaggcggcacatgagctcaagagaggggctgggtgcagccaagaagaataatagctactggcgaggtgtatagccagaaaagactcgcacataatgcggtctttgatctagatcgtcagccctcttgctctcttcctcttctcccattcttttttttcttcttttcttttgtctctcttttctttcttttttttttcttccacacttttttcagcaaggtaagactaacaccagctttaaaccaagatggcctaggttgacgaaacccgccaggaagagcttgtcgacctccctgcctcacacttggacttttgtgtcatgagacgtcaaaaaccaagtatgtgagactgggatcttcataaagtgtgttccaacacatgaacagttgatgtagctcccatgttcttaggcatcgtacgtctctcgttcttaatcttcacctgaaatggttcttgcttttattggaaagaaaacttactaagataatccggggtgtctcccggtagtgttttgtttgtggtcacaagctcaaccattgagacatcatgctgcaagattagtgtgaatacaaatacgagatttgcagtatttatgatagttaaaagcatccacaaccacacttcaaaacatgttagaaatgagggtcgtaaggtggttgtggtccttgtacaatgaagtggtactaattggacagtactctggggattccttatgagagcatgtatcttggggaactttgaaagagaggctttcatgctcatttgtggagttcgcatcctctagagttgatgtctcaaacttgtccttggcctgaaagttctccattgaaagaacggggttgtttcttgacaactgtcgagaacaacatcttgagggccaaagggacaaggctttcgctcgattggaggttgtgatggtggttctatggagtgtaattcaaaagtctcgccagaatcttctttttcaatgaaacaaagatcatcctgttctagaatagattcaggggacacatgaatctatcagggggatgcctatcaaggttttgtcataatcgctatgaggatcatccctgaatttaggagtgcaacctggagcttgatttctttggaatccggagatggctccaaggaggactctttagtcagactttatgatattgcgggcttagattcaggttcggcaaaagaaggttccntccttcctgacacnnaaatgcctctggacggggctcaacacactacccggcaaaggaggtattttccgatatgcgatcgagaatttccttgccttcgcgggagttttgtgcatgaatgaccctccaacagttatgtcaaggtagaatgcagactccctatctaaacccatatggaaatgttgcaatagcacgtaatcaggtatagaaagggttgggccagactatactaaattagtgaatctggactaggctgcacaaatcgattctctatttatctgctgaaaactcagaatttctacacgaagagtagtaatacgggttacagggaaaaatgggaggcataacctgtctcgcaatttctcccagtcactgtttgcacacccgacggtaaatatgtaccattgtttcgctctcccatgaagtgagaatggaaataatttccaccgaacagtctcttgcttcatgcctcgaattcctgcagatgatgtagcggttttcctggcctaaaccatagaaagatttctccctaaccatacggatgaattcgagacgaatttcattgccaggtgttaaaataggctccgatgaaggaggtggctcgtaaaattcgccctgaggagcagataattggaaaatagattgcggctccatcggttgagaaggtttactggaatacttctcggggatagcaggggtaaaggtagaagtaagaaaaataaaaaggatacgaggatgaacaaggttcggagatagacaacaatcgttccccagcaacggcgccagaaatgcttgctggtatttcttacgatcacagataaatccgcaagcgcacggaatataccgatgtagcacttcaccgaggagtattctcaggtatcaatttccatagggaacgtgtgtgcttactccggttcaggttcatccaaggacacgaagctatggataggcaaaggatagagaggtttcactggtgaagaacagtgtctacggaaagcttaacttcagtcctaaggaggtacttcgggcactggccagctcgctgctcccagatatcgctctactgcgcacccggacagggaggacttcagtgatattgagggttatcaccacctctacacccacctcacacctaatgtgggatgtggagcaaacaccttaaatcaactacctagacaccgcgtttataactcactaaagcaatcactatagtttagttaattatggtgaacaatgatcccgcactctgaataggaactaaccaagaaaaaattctaaccgagcaaaactaaattactcaaaagatatttcaattaaaatcagagtaataatcagagcagaaagaataagaagaggattaccgacaactccggaactcctcccacttcttctactctactctctccctaatctaatacacaaggattagattggaaaggaggaatcttagtggaagtaggattgggagagggggagggagttggataggagggggagggagttagacaggagtgggtggggtgcagtggcgcgcgcgcgacaatggagggagggaggcggcggccgagctaggagagggggagatggggaggaaataaaagaaaggaagaatggattaggactttcccaaataggaaaaatcaattcggtgcggcagcttcgaattaaatatatgatgtggtctcgctcattttttaaggccgttttaggaagagaatggaaacgatcccgcaaacaaaaacagacacggttcgccatgcaaaacgaaactacgaacagagaggggagtgaattaggcacaattcacgaccaaaggcacaaggaagaattattattaaggtgatcttgacacttttaaacttagcaacactgcctgacaattctgattattaaatatattgttaattagggttttctcctggttaaccaaagcaatttctatagatcatttattagtgacttggaacctaagggaagggaaaactccaggtgtgacaaacctatcccccttaaacagaatcttgtcctcgagattcggaagaactggtgaagagatggggatgggtggctttcaactcatcttctctttcccaagttgcttcatcttacgaatgatggctccactatagtctgcaaaacctgatcactttatttctggttctcctctcactggtctccaaaatacatgtaggcttctccacataagtcaaatcctcctgaatctcaacattatctggacttgctggttcctcaagcacacttaggcatttcttcaactgagatacctggaatacatcgtgaatgctggccatgttaggtggaatttcaaactgatatgccacttcacctctacgttcaagaattcggtatgacccgatgtaacgttgcaccattttcccttggtctgaaaacggtgcactcctctgagcgacataactgtaaggtacacttgatcaacaacctcgaaactgagctctctccgatgattatcggcattgcttttctgacgggattgggcaatcgtcaatctctccctgattgctcttactttcacttcggcctaactcaacacttctgtaccaaacaactgacgttctctagtttgatcccaaaacagaggcatacgacactttcgaccttaaagtgcttcaaacggtgccatgtacaaactagcttgataactgttgttgtatgaaaactcagcatacagtagattcttatcccaagatccaccaaaatcaagggcgcaaactctcaacatatcctccaaaatctgatttacttgctctgtctgaccatcggtctgcagatgatatgctgtgctaaagttcaaacgggttccaagttcctcttgcagcttatgccaaaactttgacgtaaactgacttcctctatcagacacgatcttcttcggcacaccatgcaaacagacaatcctcgaaagatacaactctgctaacctctttcctatataagttgtatgaaccggaagaaaatgtgccactttcatgagacgatccactattacccaaatagaatcatgacctgatgatgtccttggcaatccggttataaatccataccaatttcttcccacttccattctggaatctgaatagactgcaaacctgctggtctctagtgttctgcttttactcgctgacatacgtcacggagtgctacgaattctgctatctctcttttcatactgaccgaccaaaacttctccttgaaatattggtacatctttgtgcttcccggatgaattgaatattggatctggtgagcttcactaagagtcaactccttcaactctttgttgtcaggcacacacaatctttcacccatccatatcgttccatgttcatcctcagtaaaatctcgggctttatccactcgcatatttttcttaagctctgctatctctggatattttgcatgcgcaacgagtgtcggctgtgcttccaaagcggcaacaaaaccatgttctacaattcccaaattcagacgttctaggtcttgtatcagttgagtacttacttcttctaagcatgttgcattgcaataatttttccggcttaacgcatcggcaacgacattagctttaccaggatgataatctatacacacatcataatctttgatcaactctaacaatcggcactgacggagattcaaatcgggctgggtgaagatatacttcatgctcttatgatcagtatatatatctcagaacgattaccaatcaagtagtgtcgccagatcttcaaagcatgaaccactactgctaactccaaatcatgagtcggataattgtcttcatgtgtacgcaactgacgcgaggcgtaagcaacaactctaccttcttgaataagcacccatcccaaaccttgacgagatgcatcacaatacacttcaaaatcctttctctgattgggcagaatcaaaattagagcggacactaatctcctcttgagttcctcaaaactctcctgacactgcgaagtacgaacaaacttttcctctttcttcaacaactgtgtcattggcttggcaattctcgagaaattctcaatgaaccgacagtaataccctgtaagtccaagaaaactcctcacttgcatcactgtcttcggtggaatccacttagtgactgcttccacatttcacgaatcgactgctactcttttagtggtaataacatgccgaacttgacttctttcaaccaaaaatcacacttgctgaacttgggatacaactaatgctccttcatcttctccaacactacgtgaagatgattcccatgttcttccttagactttgaataaaccaagatatcatcaatgaaaaccacaacaaactatccaggtattccatgaacacattattcatcaaattcatgaagaatgtgggtgcattggtaagtccaaacgacattactatgcactcgaacaattcatagcgagtcgtaaaagttgtcttaggaatatcctcctcgcgaattctgaactgatggtaacctgatcacagatatatcttcgaaagcacagttgctcccttcagctgatgaaacatatcatctatccttagcaaagggtacttattcttgatcgtaacatcattaagcgctctataatcagtagacatcctctttgtcttgtctttcttctcaacaaaaatcactagagcaccccaaggcgatgtgctgggtcgaatgtatcctttctgcaactgctcatccacttgcttcttaacttctgccatttcttcggctgccatcctgtacggtctcttgtagatgggagctgtacctaggaccaaattgatacggaactcaatgtctttctttggcagcatagctgtcgactcctccaaaaaaacttcagaatactcacaaaccacaggaatgtcttctaactttgggacatctttcatgacttcatcctgttgttcactttccacttaattcaagcttacttctttcttctgaataaatggagattgaattactaccacttctccatttcaattaaccaacgtaattgtgcggcttgcacaatcaataactcctttatgtcttgtcaaccaatccattcctagtatgacatctaggtctttgcactccagaaggataagattggctagaaaaggtgacccttggatttctatcatcaaagaggaacaaaaactaactaatgttaagctattacttggtgtattaactttcatgggagtactaagttacacttttcttaacccgtgtacccaaacaaatctcttggatataaatgaatgcgtagcaccagaatcgaataaaactgtagaaggaattgagttcacagggaacgtacccaaaaccacttctgacgctgcttgagcttcctttgtagacacatgataaacacgagcttgaacgaccttgggtccattgcgcattgttttagggcacttatttgcaaaatgtccggtatctccgtagttgaaacacataaggggcttttgttctgacttcttctttggctggtggggctgcaaagcttgagactgggcgggcgcggaactggattatggttgttctgatttccactgttgcctcggctgaaatttcctagctgatatggcctgtgctatcgaacaatcataatagtagaaccactgtgctgtccataaccacagcgatgcttctgctgtccaccttgctgaaacctgaactgcatagctttcctcttgcgatctatcttgttacgttgatcttcctaacgaatggtcctgtccacaagtctctcaaaatcagcatagtctttagaaatctcctggttagtcaatgttgacggtccttaaatcataatatttgaccatcaatacttacatataatgaaataaaatatggtatccaacttagtggtagggtttataactaatcatttctaccagtattgatgaaatatgtgtgtgcagatattttgaggagaaaacacatccgtcatgcgacataatgcacctctgaacattcaggacgcgtttacacgaattggaggcaaaataagtcaataaaaaccatctaggattgggccaaaacatagtgaaggatgttgggggcccattaagcaacctaccggccgaaggaggggccgggaggacgtttttctagttcttgaaccaatcctggcacctcccgccatctggcttcacgtggacggctcggatttctcccctatggcggttgcagggtgttttggtcatttcccatgcccctaaccgtcatttggaacctatataaggaggtctccttctcacttcaagaacacacaactttgagctgaattacaagaggctctattgtatcttttgtacattagaataaggtagagagtgaggagaagctctggaggagtgcccggaagtttggcactcatccgacttctacctcgacgagtgcagcttcctaggagaaattatggaggagtaccggagctatcggtacactctgctccaggttcggagaa

SEQ ID NO: 79629 - DNA, 77039 bp, Oryza sativa
cctctcgccttcttctccacagctgcgtgcacgggatcggggggctagaggcgagcactcttctcctcactctctctcctagcttcgggcacaatggaatcgaggacggcagtcagcggcttggacgacagagccaaggagaatggcgacggtgtggccgaagagaaggacatcacgtcactactagcctcgaggaggtcgacgctggcctcccgttttgtcatgtcatgcacatgtgtctttccctcgatcctgaaccctgactggacgtataggtatgtggtatgccaatgacagttattgaagctgccatcagttatgcatttatggattcgggtctagtgaatagggtatgcctaagcgcccacccgagattggactcgatggtgggtaagacccggagcgaggttgtccacgataggtcgcggcggtgacctcagtctcctcctcatggaggctcgcgacaacgggctctgatgctgcctgcttcttcccccctcttgtcatcgttgaacaccatagtccttaccatggatgaagacggtggcctcttcacccttgacccgctagtcggcgaggaagacccacccatccttgatctccttctcatcaaggctcgcggcggtgggctctaatgccgcccgcttcttcatccccaatctctttctccttccctcttctctccctcatccctcctctgtcaccccgtcgccccctacccgtcacatctcccacggcacgacgttcatcccctcatgcgcgcgacaccgcgcaacgaagattgtgtccgccttcacgatgcttctctccaccggtgcttacacagggacgtcggtgatggccactgcctcccaacccccttgagctactgcatcgtcgttgcgctgttgccgccagcctctgccctcccctttacctcccaccgccttgcctcccgtcgagagacatggggaccgcagctcccttgagctcctctgccatcgtcacactgttgccacccattgccttctcctcaacctcccatcgcctcgggcgccgcgttgcccactcctagagtcgcgccgaatccagaagataagggtagagaagagggggtggagaaggagagaagggatttggcatgtggggtccgcatagtaactcggcctgctagagtaggtcaacgagtcacgtcaacaaaaaaacaccctcaaaaccactaagggagtcatcttgcattggttttaatagttatgggtcaagatatctgatatagtagttaagagatacaaattagatcggaccttcaatcatcaaacccaactaatgaaggaaacggtccatttcgcatccctaatttgagtttgcatcactcaactataaaattaggtaagagtatcctctaacttttaaaatcactgcaaatcgagtccctcgactaatttgaaagtggtttttgacctatgtaacctctacttggcacgttggcatagtcttaatctaacatggcacttgtggtaatcacgaaactagaaaaaaatttaaaaaattttaaaaataaggagacccaatgtgagtcgtagttgtgccataatttttctaatgaaagatgtaggactcatatgtttcacatggaaaaaaaatataagagtaaatttcacaaagctataaatactttgattaaattatcataaaactacatatttaaagtgatgtatcacaaaactacagatctaacaataaatttatgacaaacctactggtttaaggctaagtataaaaaagatatagatttgctgatgaaattatcgtaaactacagattttggggtttaaatcctcagcactaatgctatgtttgagttatataagtccaacttctgttattaaattgatatcaaatctatagttttgtgatacttagtcttaaacatgtagttatgtgataaatttagtgctaaatctatagttttgtgatatatcatgttaaacctgcagtactgtgataatttactcaaaataaaaaaaacatctatacaattaccacttacatgtggatacgagtcctattatatattttttccttggctgtaattacatgtaagcattacgtcggataaggactaagttaatctgtcatgtagccgtaggatgaaagcgccgtgtaaactaccgagggacttgatttacattagttttgataatcggtaacgctctatagccggttttgcgctaatggacacgaatgaagctcaatgcatagccaagataattagggtgtgtttgcataggctggtttccaacccggaacagtaacacggaaaactgagcagtcaattagcacgtgattaattaagtatttgttttttttaaaaaatggattaatatgactttttaagcaacttttgtatagaaactttttgcaaaaaatacaccatttaatagtttgaaaagcgtgcgcgcagaaaacgagagagatgggttgggaaaaaggggtgctgaacacacccttaaagtgtactcttccacagaaataataaacttccaactcaaatttggcccagcaatccaaatatggtgagtgctaggcagccaaatagataactcgtctgctactgaaaaataacgatttcatggttttcggctacaagttggatgtgaatccacataccacatttacgcccccacaaacccaagtgggcgcacacaccttatttttctaccacttaactttatttcagctgttcaccgccttgctgctaacaaagggcctatttcgtacagttccaactcctaaatataactccaggagttgagtctagagtggagttgtgtagctgtctaaggccccgtttggtagggctccaaactccaactcctaactctaaactccaactccagtgagagctagctccggttgaagttgaaaactcgttaaaagtgtttggctatactttcagttctagatctgaaaaaaaaaatgaaaaaatgaaaaaaaacgaaaccaatcggccccagccgcgccgccggccgccggccacgcgcgccgcccgtcctcgtcccgcagcccccggccgccgcagcccttcgccgccgccggcctccgcccgcgcgtcgtcgtcacgccccgtcgccgtggccccctaccgccgacgctaccgtagcccgccgccgccggcctccacccgctcgtcatcgtcacgctgcgccgcctgtcgccgcctgtcgtcatcccgccgctgccgcagcccgccaccgccgccggcgcccgctcgggattgggaggggaggagagagaacgggaggaaaggaggattgtaggggtagttgagtggcattttcgtgtagatactctaaaaaattagagggtagtgggtcttttgggatagagtggagctgtggagcagcaaaaacccagctccaccccgtagttcattttttaggagtagctctgccaactccactccaaaaaaaggtggatctggatcgtttggcacaactccggctcctgataagttggagtgggagctagagctatgccaaacggggcctaaacccagctccacaactctagtacattttgtgagagagcttcacccaactccactctcaattttggtggagctgaaactgtttggctgaactccagctctaggaggggtggagttagagctggagctgtgccaaacaggcccaaagtaacagtgccaccgtgaaggaacagcagtgaattgtaaatagtagaaacaaaacagtactaggcagggaaaatgaagtattattagcactagtatgcgtatcaatcaacagtcggcaatgcacagaagcattgatcagtcactcttgcagaagaaaaaacatgagtggtcagtaacagtcgcgttctcttgttacattggccagaaaaatgtgaaacgatgaaacacaggcgtacatgatagaacaatactgcatctgtaggcgacctcttattctttagtatcgtgtcactatccccccgtgcatgtcctatcatcaacggagacttgtcgtgctaaaccaactcgtcccaatgcaactcatcccctcgaagagtctgcagtctccgtctcaagaaccacgacagcctgccatgcatctatcgagcgcgagcagacggccgattcatcctgacgcttacaccgttgccgccatctgcctgccggccacgccatcctcctcctccccgtcgctccggtcgacgtccaccgtgccactcctgtaccggctcgcgcacacgaggtacacggcgaagtccgcgacggccagcacggcgagcaggaagaagaacttgtcgaggtggccctcgttaaggtcggcggggatccagccggggcggccgcgcacggcggtggccttggtcaccgcgctcacgatgacgtcgctgaagtagttgccgagcgacatggacatcatgcagagcgcgctcccgaagctcttgagcgcgtcgggcatctccccgttgaagaactcgagctggccgacgtacatcatcacctccgacacgccgatcagcgcgtactgcggcacctgccacatgatgtgcaggtcgctgctcatcgccgtggtggcgccggccttcctgaagtgctcgaccgtgccggcggtggccatggccatcgcgccgagcaccaggccgaggcccatcctctgcagctcggttgggccggtgtggcggcccgtgagccgcgacacgagcgggcagacggcccggcggtacaggaagatggtggtggcgacggtgaggatgtcgaaggccgacatgctggagggcgggacggagaagcccgggaaccgggtggtgcggcgcatcgcggcgccctgcacgacgaacagcgacgccatctgcgtgaacacgaccgaatagaggatggtgcagagccagatggggaggagccgcaggatgctcttcacctcctccacctgcgtcaccgtgcacagcttccaggggtcacgcggttgggtgcacgtgccaagcttcgggttagcgcccaccaccgccgcacggtccaagaacctgcaatacatggcgagttcagtgcgtgcatgcgtgatcagttcacagctcacaaaaccacacaacactttacctgaaaccttccgtgtgcaggagcttcctcccaccggaatccgccttctcgtcgctctcgtagagtgtcacggcgcccggcgactcgccggccttccagttcctgcacgcggcgaacgcgacctggaagatcctgccaaccgggttgccgctggggcggatgtaccggtagcggagcgtgccgccgaggaacagcagcagcgcggtggccgcggcggcggtggagacccagaagccgagcgcccagttgccctcgtcctcgaggaagctgaggaaggtgttggagaagagcgagccgaggttgagcgccaggtagaagtagctgaagaaggagaccttggagtgcgactcggccgggtcctcgccgtcgaactggtcggcgccgaaggtggcgacgttgggctggtacccgccgttgccgaacgcgatcatgtacagcgcgatgtagaagatccccagctccgcgccggagtgcggctcgcagggcacgtgctccgtgccgcacccgaccggcctgatcaggtacagccgcgacgacagggacagcagcgcgaggccctgcaggcaaaacaccgtgacgcgaacgagtcagccgcgtgatccacatctcctgggcgtacgcgcaacgcgaccgcgatgtgccttgggccgatcgaccgaccggtcggcgccaccacgtactactctatgcctctactatatggaccatccactttcgacaccagcatacgtgcagatacaatccacccagtacagagtacaggccgaattaactccactctggacagattctcccgcaccaatcgctgttactttgtacgtacgttcctacgcatctatagaccatcatttcccgtgaaatgggcaatcagaacggaaaaaactggtcactgatgattgcccgaccaacagatcagaccgaagtagctagaaacatgagatcaatcgatcgcaccgagaaaggcgcgtggttttcagatagaactgcggagagagagggatgtgccgtgtggtggtgcttacaaggacaaagatggcctggaatatggcgcaggtcttgtagcggccccagtaggagtcgctgaggaaggcgccgatgagggagaacatgtaaaccgtgccggtccatttgctcacgttgttggcggcgtcgccgttgctctgctgcagcaccctcgtcaggaacaacaccaggttcacgtttaccccgaagaacgccagggttgccagaccctggttcactgcacaacacacacaaaataaaaaggtgtcaaggccttcaagaataattctaaacaaacataaaacgatgcacacatgcaaacagtgcgccgcttaactcccccatgaaagcagcaataaagccaaactgtggtagggcgatatcgtactccacataccctacagatcgatcgatcatttgatcgctatgcatggttgctacatcgtggataccatgtccgatgtctcctacggagatcctaatgtggcgctagtaatgcgtgcgcccgaatcccccgtggcgaggaaccctccagttgtgggcgttgcatggccgatgtcacctcgtcatgcagcattccgcgtaaagacccggcgcctaccgccactttaagcctcaacgtcgagtcacctcagaccgacttgcactgttgcgaaaacacttcactggaaagcccagtcatcgactttgtctccattttttgctggcccgtctcagccgggaaggagatggtgaaatcagcagagttcagcacaaagtacttacgaagaataaggccgccggcgagccatccgccggacttgcccttcaccgccggtgagcccttgatatccacggagccatcgagggtgtactcgcagcatacatccttcggggcgttactcgtctcatcgccttccacgacgatcaccctcatcttcatgtctccgtcgttgccagactgcaaccatcaagttacatgctgtcagttagtttccagtttcatgtgctgccatgtatacgcatggtgtttcatcactgaacatggagacaaaactgaatcttggctacagaccaacaagctacagaaacaagctgaaaccgtgtagctttgctaacatatatgccaagaacgatcaaatcatgagcacgtactaaccatttcttgctcctcctcgggctctcctcaccggtggcctccgtcggctaatgcaacgagaagctctgtgtgaggaagccgagcaggaggaagaagaggaggggatctatggaagtggttgtgtctgagcagagaggtctgggatttatagagctcagctgcagctggctagctggctctgcgactgtgagtaggatgtgcagatcacaaaagggaggtggaggagcgtgcgtgtcttgctcgcatgatgtcacaaacaggtattcttaggtatgtgcatcacaccgagacgtcgcgctcgacgatgactgtcgccgtttttccacctctctttttttttttttatcccgttctcatagcccggccatcgtagcacgcaagagcagccttttcccaagaaaaattcagatcgttcctggcaatctcaagtgtgccttttactcttatttgtggtcggttggtgtggctgctcgtgttctgtttcagtaacttatgtgactttacctggttagataattggcaaacgacgaaaaacttagtgccgagtccagcaatttgtctggttttaatcagggtttatctgcacaggaatactacatgacagcatatatagcccgccgcatctttttcactcgccagtctatttatgcagggtaattgcaagctgctagtcgaccctggaaatgggtgcacgccaaagatgcccctcacgctttctcttggaaatccagaaatggagtggcattctacattagactgctacgcttagtcgtggtcaaccaaccattccttcatataatcacatctgcttgagtaaatgaaggccgagactggaactctggattgtttgcccctgaatatgttgccacttgcctgtgtgaacacaaccgcacgatgattattctacgaggctgtacggaacacgagcctcgtctctactagtagctggctagtgcatcgtcacttcgtcaggtagaaatggcaaaaaagaccgaggccccaaaaaaaaactgaaccgaactaagatcagattattgtcatgttttttcactagccaaaattttaagttgaaggttgtaattgctataattaatgctatctcgatgaattgatacgttatatgatgtttgctactattatcttgtgatgtttaattgataagttaaacatgtcctcaaagaggggaaagtgatgccaaaaaaattgttctcatttccgctaattcttctgtctcttaaaaatagtcacatattctggtcataacctaaaatagtcacatgtaagaactggtattgatttaggttacatgcagcggcagcctactgaccttatgtattggatatccgtagattgaacgggaataaaaatataaactagatgacgtcattgatttgtggatatatatatatgtttaacgatttgtcttattaaaagatttacataatatatagtattatttattttgttgtaagttgttttaagcataatctgtatcttatctatttacacaaaattgtcaaataagataaatagttaaacatatatataaaatagttacagcgttacctacaacggagggagtacaatgcacgagcctagataggcttgcacaagtggcaggtgagtgttactactgtgttagtcccttagagatagggatagcatatttactgccatccatgagtttaagctgcgcggaatggatcgagctagctagcgcgagctatcgtcgctgcatgctccgccgctcggtgtcggaggttgcgtcgacaccagtggactggcgccagtggctgccaatgcgccaccagttgccacactcccttatctcgtgcatgcatttgtcattttcgcgggtttgcgcagcagcgatcgatcgatcgatcggaaagccgttgtttcgggctgccgcctgccgccggctggctctcgccggtttcagggaacagttaacagtgcgcggattgacgtccagggttcttcacagtggccgctgtgctttacagctcaacgtgggctctcttccactgatggcatgcagggtagtgtgacgatacatcatcggccggttgccatcgatcggatcatatatcacacgcacgcacgggcgtcatcacgccggttgaggggtgggcgtgtggtggcgcctagttcgctgtggtattactgtcgtcaagcgttgtcaaatctttgcttctgtttttctctagccactggtggttgcaacttgcaactagaggaggaggctaagagagatcccacatatctcggtcactgtatgtgtcgctatatatattgaactgaatcaatatgcatgccaaggtgtcattcctaaggtcatgtgcgatgtggtcgggacctatagagtttacggagagtgctacaaatcgaaagtctgatattttttaaaatatcggacggtgttgcagcgcatacggagaaatgtttcactgaccaataaaaattgtttcaagaggaatgtttcagtgccgcagagaaatgtgtcattgacaataaaaaattgttttaatataaatgtttcagttgtttgtattttggagagaaatgtttcatcagtcttgagaaaatattttatcaccgggttaaaaagttgtaactagatgcaacacttgaaaactactacctgcaacataaagacaacaatatgtgcaacatcgattaaaaacacaatgaaacatcattccacgacaagatgcaacaaaaagcaaataatgggacgactcgatcaggcggtgggtgaatgcaacagttgaaaactactgattgcaacaaaaagacaataatatatgcaacatccaataaaaatacaatgaaacatcatttcacgacaaaggtgcaacgaaaacaaataatgagacgactcgacgaggcggtgggcagcgatggagccgtcggcatggccggtgaagaggaagaagaggtgtggcgcggagagaggtacacaagcagggcagtgatcggcggctcgttgcacaccctaggctccagctcgagcagcgcgtccacggcgacagagaacacgaacacgcggccgcgggagtcgtcgacggcgaagtacttgatgagcccatccgcgtcctcgtagggcagcgtggtcgccgcggcggagtacacgccgtcccccgagccacgcggccgcgacgaacccctgcggtgccctccggtcaccgggatggcgagaagaaaatggggagaagaagataagacataagagataaggatggggaatggcgaatgggaaatggattggttgaatagttaaatgactgggtcccaccatacgcagccgtccggcattttgttttctatcgaacgtcaggaagcattttcgagagtctaccgtgtgccgaggtaaaatgcgaaagggctaatctgcaaattgccatagttttcttccttatttaaaatggttttacgtagaatgtttttatgggtgtgtttagatcggggtgtaaagttttggcgtgtcatatcggatatatggatacacatttaaaatatcaaacgtagactaataacgaaacaaattatatattctgtctgtaaactacgagacgaatttattaaacctaactaatctgtcattagcaaatgtttactgtagcaacatattatcaaatcatggcgtaattaggcttaaaaaattcatctcgcaaattagtcgcaaactgtgcaattatatattttttctatgtttaatactatttacatgtgtccaaacgttcgatgtgatatgttgtaaattttttccctgggaactaaacacaaccatatcaaaagtacctaggaaaatgtttcacagtggaccataaatatacacttggttcagtgtccagacacttcacacgaccgcgcacaagcatccggccattaggtctaccctgtaaattgtggtaaaacacgcaattgttacaaaacaacttctaaatctgatgcattgcaatcggtatagtcaaagtgagaaagaaaacactagtgaactatttcctccgtttcacaatgtaagtcattctagtattttccacattcattatggatgttaatgaatctagacatatatatctatctagattcattagcatcaatatgaatgtgaaaaatctatcttgatgctaatgaatctagatagatatatatgtctagatttattaacatctatatgaatgtggaaaatactagaatgacttacattgtgaaacggagtactaccccaggacgtttactcctacattgcatacggtcttacatcatgtaatattagaattgtttttctcatttcacatgaccaaaggccatcagcaatgtggatagacaataggacgtcagggcatataagagtttcatagatgctaattaaataagtatggtaaagaatggaaggctctgtttggtaaacctctaactctaaaatttagttttaggagttgtgttcagagtggagttctagagcagtcaaaacctagctccacatctctagttcattttgtgagagcactctacccagctccactcccattttaggtggagctgaaattgtttggctgagctccaggaaagatagagctggagctgtgtcaaacagggccgaaatggattataattctttgagaagatgttttctcctgtcgctcttatatgtcatctaaatagtaaaattatgatagattaatatgtgatatatcactttataaatatgtaagtttaaatttgatccccataagttgtaacaaaaataaccaatttaacttaaactagtacacacaagcatatctatttattttaacttatagaagtcaaatttaaacttgtatatttatggagtgatatattaatatatcttgccaaatataattatcttaattcttcaaaactatttatttgataagcacgatacgatggaacatccctctatgggttaaaagagtttcctgataaaacatgcaattgttggaacaaattggccgaacaatcatggcaagggctcccacccctcattggagagagcctaaggttggatataggagatagtcaaataggaggagaggagggatgagagttagagtaaccatatattcatgggatggattgggatcccccttgtctctggagggccctatctattcattgacaacggaaaattacattattgcccttgactcgttacatgagagtgacattgctctaggggtgttcaatcctctatctactaacttattaaataatagaaaaaaggctccacactttctctcacgataaagaaattctcatattaatcaagaataagaaaaaaagggagtccataataaagtacaatttaaaaatagctgaaatttgaaattaaaaataagtaatattggaagaggaaactagagtccacattggtattcaatttagaaccaagtgaaatttagaattaaaaataaaaaaagtaaaagtaaaggttagagtccatatagaaatacaatttagaaataacaaaatttcaaaatttttaaaaaatattggaaaacaagtctagatttcatatagaaatatagagtgtatttagttcacgtcaaaattggaagtttgattcaaattggaacaatgtgacggaaaagttggaagtgtgtgtgtgtaggaaagttttgatgtgatagaaaagttggaagtttgaagaaaaaagtttggaactaaactcggccataatttagaaataactaaaattaggaattaaaaaaataaggaatattgaaagatgaatttagagtccatataaaaaatacaatttagtaataacgaaaattcggaatttaaaaataaggaatattataagaagagtctaaagtctacataggaatttaaaataaatttggatctaaaataaaaatactaaaattgtagagtttaaagtccctatagaaatgtaatttagaaataactaaaatttaaaataaaaaaataaatattggaagaaggacctaaagtctatatatgaatataatttagaaataactaaaattcggaattaaaaataaaaaagtattaaaatatgagttcagggttcataaaaaatacaattagaaataataggaatttagaattaataaataaggaatattgaaagaggaatttagagtccatatataggagtactatttagaaataattgaaattcaaaatttaaaaataaaaaatattgaaacaagtgttaagtgtttagaatccatataaaaataaaatttataaataatgataatgcggaattaaaaaataaagaatagtggtgtcatggttatggatactacatacctaatagtagttgactaaatctcggcaggacccaccacataccatgtcctatacggaaaccgacttcagatatggagggagttccggataaggaaagacaaccagagttctacatggaaacgacaaggactactcggattgtatccatattggtttccctagttctacttggacaaggggacacctatgggtataaatacaagcccccctaggaggacagggggacagacactcaccatgagacgatcaacacgatcgacaaccaccatgagacgatcaacacgatcaccacgatagggacgaccacctcatcaacacccaacacaatcaacatacaagcctacatacgccaagacacgccgccggatatcgacttcagggataggcatggctattcccctacggtgtctccggataccgtcaggagatacgaaagcgctatctctgatctcgtcgggcacggattcgaggaggaagactaccttgttgtcgactacgagttagaccttcaaactgacatgtcaacaacagttagataggctacccacatattgtactggtgtgattatggtgaataagagcaataccggcttcggccaacaggatgtaaggttattacctaactactcaggggcccgaacctgtataaaaatccatgtctccatctctttacctcagtctcacatatatcctagcaccaacgatccccatactgtccaaataccgtagtcgtgacatcaaacgtcgacaagtggaagtagaggttagagtacatgtagtaatacaatttagaaataactaagatcaaaattgaaagtaattaataactatcacgtatgatcaatttagtaaataatttaaaactatgttgctattttaataataaaatgtgaaatatatatatatatatatatatatatatatatatatatatatatacacacacacacacacacacacacacacacacacacacacacactattatataagaaaaaaaagatacttttcgcgcaatttgcatgggccatcaatagtgtagttatgttattagttaacacgataagagcaggtacaatagtagactataagccaggtataaacatattttaatgagataaaggaagagagagaagagcagcgggctacagatttgtagccagctatagctaggtgtaggactaggtattaatagtatagtaagcaactattgtatgaattgcctattacattggttatagatgattcgtagctagaagttggctatcctattaaacttgctctaaccctaagagtggggtttatccctaacacagtggttaacactgaatgtggaacaatatatatacttaaaaaatcatgtcatcctcactagtcttgagccaacgcttggaaaacaatagtaatgattttcatttgtttcaaggtccaaacctggacctggtacagagtaaatttgacgcatgcaatgggtagactgtagtgtgagaaagaaaagaggtcttccgccctcgcattgcacatgacctaatcggttctactgtacactcgtaacagtagatgcaagatgtgctagctggtgctcgattcggactactggtaactaatgtcatgcgatcattgtccaaggccagtcctaacttaggtctgtgcctgagaagtaagaattgatcacatccacggttgcagggttcggtgagatgaccaatcgatcgatcattgtagatgggactaattatcgctgctgataatgactctcaggcagctgatgggcgccgttcgcgtggtgattaacctgacggcacgccgctgtgcggggtgaggcaatgaactcgtgtaccttcatgctgataataacattttcctgacagtcctgctctcaaaatatcattgcatgctgcttaattcagattgcccgtctttgaccgttaaactaaatgcaaaaaacatggagagatatcacattggacatgctgtcaatcagatgggcgccatacgtttggactctgtattttctagtgtcctggttcactggttctggaatgaatacaattacacaaaccgtcctttgtaatgatatttcgagaaaaataaacctccgctaattatttccccccagaaagctacatatatatgtcttcaggctgaatcaggcagacgcctctgacgaattccacgtacgtcctgatagatcgatactactaacatctgagctgagatagctatggtccaagctttgcagcgcattggcagtacggcagatcgattaaacccagcgaccgtttggaatcctaaagggcatgcatggtcgacggctcaagataaccaaaggttactagctgaacaatcctacccgtcactgcctttatcacgcttaaaaaaatataaaaaccaaaacgtgcctgttcttatagctatactatgaacgatcaaccaatgcaacgtaagtgcacgcacgctagcttactgctactaaccacatgcatgctgcatgcatgccagaatcactatattcactgccgtgccgatgataatacatcaactaacccttcgtgacatgtggttaggccaaaagagacaacccctgatccaatcgatcctccctctccgaaaccgtgcgcgaaacgacacgcgcgcatacatgcacagcaacgcgcggctcgcgagcactggcccgcgcgcggcccacgtacgtcgacagccgaatcccacgcgatctcccggccaggacggtcgcgcgcgcggggaggctaggcttcgggcttcctttttccggttttcccccgcttttctcgcggccgtataagcggaggagaatatcaacgcgcacgtaggtgtacgcccgtactactacgcctctctctctctctcctgtggttggcatatcgctcgcgcgcacgcgtgggctttggctgccatgcatccgccctgtcacgctccactcaacccccccgatcggctatcgcaagggctgggcctacccgatcgtgaccgttccgaggggcacatcgccgtcgaccatccaatgcccacgaccggggcggtcacgcatccatccatccacccccttgtgcagcagcacgacagctactactttggtaggggtcctagctatagctactgctccctgggacgtggtacgcgcttctgctcatggacggatccgcgacgactgtgatgctgccatgctcgcacgctgcgcgctaaagccgcgggccacgcgagaccgcgagagacacgaagaagttgggccaactgttttcaggtttcctggtcacgacccccatgtgtgaccagatcgcgcgcatgcagcatgcacacactccgccggctcggcgagcgtacagagctggctgttcccctgttcctgttggtgcaggcgaatcgattagttggttcgacttccgcgcatatgtgttcattgcacgcgcgggcaatgggcgatggagggactagggagccgcaattcgggagcagggtgtactgtactcgcggtgtacaatggtggcgagcagcgagatcgatctatcggcgcatcccctttctggtcctgcacgggtagacgctcgcatagttcaagcgatcctgacctaccgtttcctctgcacaggtcgtccctttaggctagctaccttttagcagagtttagtgtgtgacagtgtgttccctgtcatatggccgagcttttcttgtgtgtgtgtgtggggggggggggggggggtttacagttgaatgtacccaaatgttcttgtcggtaagccagatatgatgatcgggggaatataggccatccatacgacgacatattgtcaggtgtgtgtatattgtgagtcgttatcacttttgtctgcactgtactagtgatttactcctacgtgtctgcagcgctacatgagctgcattttgcatgactaccatgaaagtgtgtcgacaggtccatatactgtgtatccagattaaaacgtagtagtacgagtgactatgatatttgctaaagaaagcaattgcattgtgctttccaatgcatttgcgcacttttttccttttaagaaaaatgcagaaatgttatctctctctttttttttgtctttttaaaaagacatagatgcgtgcactaggagggctggacgtagaagccttaccaggcatacgtccaggactctaggcgtgcaaatttttcaggtaagctaatccaatcaatctttcctgtgcgttgcgaccagatgagtagcaagcagtgggtgaataaaattgctcgacagtgattacagatcggtttaactaatggggattaggactttccaatcattgctttccttccgatttccctttcgttgatgaactgcaatcactgcacgcctccatattttagcataaaggcatgcgtgacacgcagctacgtttttcaggtaaccaagctcacgctggttaagtgcattctagatggatcgcctgacagcggctgcagcctactttataattcgaaacgacgactgatttatttcaaatcgactttcgctttaccatactttcgtgattaatgaaataaacaacgctaaaaaaatcttctagacctactccagtctgtcactgaaactaaccatagaattcgccttcgatcttctaattatcatcagctacacggctagctcagctaggcatacctgattcttgatgtaaacggtatgacaccgacatacctaattcttctcatactcccgccactttacgtggttggctatattacagagtttacctctcggtctcattctcatatatgctctgaaaaaccaacgtgacgttcctatcattgcatttgcagagggcctcctttagcaggacgtcgcgctccgattgcgcccccactagcgcagctagctaccctctcgatccccgtcgcctttgtccaccacgcgttcgcgcggggatgacgacgaagagtcgacgacggcgaaacgactgcaggggactgtgtggcagctccccgagctgtcgctgcagcgagtccgacgaagaagagatgcgatgctacgaagccaccgaattttcagccagcacggccgtgaactgaccaccgctgctgtccggcgggcagcttgcttgctggctgagaaatgcacgtcttgaaggttgcagccggggctaaagtgccacactggcatgcataaacctctgaaattctgatggctacagccaactaacactgcctccccggcctatggccatgatctttggatgaagcctggctttagtggcttccatgcgatgcagagagagtgagataagccttctcgagataagtagggagttgagagtgactcatgtatatgtgctgtggtaggtctgcttgctactttatttttctccccctgatctaattaatggcttcctcctgtgcccggaaaatgacatggtcgtttgttgttatgtatactgagcatgagcagtgaacatctgaaggattttgacggttaaaaatgcgttcatgcgtcgtggagaaacaactgtagcagctcgttttttccccccaccacttgtctcgaattcactgtaccttgccaccaattcaactttgatttggggtcatgtagaattgaacaacttgagataagtcaacagtggtgactacctggaagcaaattccttggtctgaaatgtcccggggggagagaaacagaatccagtaatatcgtggccaaattttaaggttaggtgtgttccctgcctcttcctgatagcctttttcgattatcagaattcagaaaatgatcgaattggggtagataaacagagctacaattaaactggggcagtgaactgtccaagtttgttacctcgaatcaattttcaacgattaaataccatgattgcttttgacaaaacatgctactagaataaaaatggggcttttgatttgagtgtgtggggactatagaaaatagtgcatgatctgaagactttcagtatcgtgggtgcacaagctccacaaaaaaccttttggataggtcgtacagtgtatgacctaaaaattatctggttcactcctcaacaaaacgtggtctgaagcaacttgccaactcgccccttcagattagtcatgattgtgcagtgtcaactgttgatcacttgttctcgtgcccataaagaaaaaaaatgttgttcatggtcctatgctgtttagtggaccatatcccgaatgtttttcatttcacattttctatgcagagcatatactagtattagaataggctgaatagctatcgtaaggaaatagatgtgaaaatgatacagaaatatcatatggtgattctgtaaatggtattgtcctgtagacactccatgtctccatggcagcggagtacacaaacataaaagcaacggtagtacattacaagtaacaggtgaataaaatgagcatgtaaattagaaaaaaaaatccattttactcgcccaaactaattcaatagaccatttatcctctcaactattttttggctcattttatatatcccctaaactattaaaaatgattcattttactccttaataacatttttttactcattatacaagctgtattttaagctgatattgttagagccatagatgacaccattaccaaagtttaaaaatattttaaaatttttcatggtgtttgctcgaactttagaattttgatgtttaaatcagtttgaagtgctttcaacctatgtaaacagtgagggaaaaaaatcacaaaagaatgttgacgtaaaatatgacttatacagggagaactaaagaagagaggtagcgttggttgggggggatgtgaagtgaaccattttcaatagtgcggggtgtaaaatgagaaaaaaaagtttaaaggggctaagtgctccaatgaaatagttcagggagtaaaatgaactttttttgtaaattaataaggaagaaggaaaaaaagtccttacgaggctaacatagttgaagtaacaacgatttattgttacccaatcagattgtttgtaggtggtggagatgatgcaagatgggggtttttcggcaacaacggttgtggtaattttctatgaatgccagatttttgatgtatgattttgttaaagtctctgtcgagtgttgtaatagggaagccaattgtgtagcacatgttctaggtaatcatgcttttaagtttaagaattcttgtaattgggttgatgaggccccaattttcttgtggaacattccagtgaacgatgtaactatgtttgtagattaataaagcacgctaaatgactttcctaaaaaaacatagttgattgtaatatgttgtattacagtgcaacacactcaagtcatttgtgcgtcagagtgagccgtgtacgtagcgaaaagtgagattgactcgtggcgccgtcctggttgtggtcgtggccagcgcgttggcgcaggtgtgcaacaagtacacgcacatccggggctccgggccatgcgacgcgtaatgattgaagagggcgctgccaagacgccccctgcatctagcttcgccagcctcacccgcttccacttccacgactgttttgtccaggtgagctagctacactaagccatgcctccacacaacggcacggcacgccgagtaggatggtctgacgagcttgggaaagataagtgggggataagagaggaggaagaagaggaggagctgataagtgggtcccacagttttttttaaaaccttagtcatttacatgtggtcccacttcaatttataactaggttgtcacatcaacataggtagatcaagtcaacatgccacgttagcgaaaccaccctaaaaaatatcaagggaatcaaattgtactggttttattattttttttcgtgggggggtcaacatatgcaatattgcgtttgagggatataaatcagattggccctacaattgaggtagttaaattggacttatttcttaagtcatccctagtgatccttacagaaaaagtcttccctagtgactagttagccaattacggagaaattcaccctgtacactgaaatctgcagaaggaacttctatgacatttcaaagtttgagcccggaagcctgcaccagtgtctacagaatatcttggcccaatggaagtggcccatgtgaagagtttcgtttaaggccatgtttgttttagcttaagattattgtaatctaaattattaaatcagattactctaaactggattataataagctgacataaaataagctgtgagttgtttgtttctatagattattacatgcatgtaagggtaatgagtctttagtcacttaataatctggaaaaagctcctccaaaggagattattagattataataatctggcttatagattataataatctatcaaaataatttacttgtttgtttcaatctacttataataatccagattataataatgctaagctgaatcaatcagggcctaagttaaagccaacacataaattaaagagtggatatgccactaagtttgtcacatgtttatgatttatcatttagtcatattctacaatacgctatcggcttttgtttaacttcgacaattcaacatcatcgtctgatgagcctccattactaatgtacaattttatccaaattaccaaaacacccctaagacaaaaagttacaaaatttggatacaaattctgaaatatcaaattttaagtttttgaccaaattttggatgtttataatcttatgtttataatatgatatcttggaatttttgtccaaagtataaagtcaatagcaaatcgcatgtgtctataatgggttctctcttggaagcatttcttcctttttcttccccaaatgaccacatacgttcccccacggtttgtgccccttaattcgtagtaatttcaatagatttacattgaaagcacaccttttcaaatatttatattttgggttatcccttttatgaaaagaaataattaaattgtaagtgagatgtggaagagtcacatccgtaccttagagctaagccatgcctgtgttaaaccatttataaactaaagtttttttaataaaaagtgtgcatcaccataagcatgagcggaacatgagcctttcgtgaaagcaacaggcaacaggcaacagggcaacatggctaatgtcataatgtttgtctgaatcatctaccattttgacttggaaatggagttttggctggttgagcccagggtggatttagacagtgctttagcttggctatggtcgtgtagtaataaaatctatctttacagaaaaaaaaacacgatacaaaatgcttatgctcatatgtacaatttaaatgcacacttacacacatacacacacgacctatttctacgagtgccccctcccttgctctgctggaagccacctcccctacccatcggaggccaccggcggggtgtctagggtcggatctacccgtggggtaacggatccgcacgtaggggtgatagtttcgatcatgacgactggatctggcctgtacaattaccggtcacccaaccacctcgtgtcgtggccgttgaccgatcattgcaccgccatagcagcctcgctcactttgccttgctctacgccatccattgctcgcggcttgctgctatgccgaccgcatctcctatgcgagaaaacgacgctaccatcatggctcgccgtgcggttggtcggtggctcactctgacggcggtgaggtgaaggtggggggctgggggaggtactttggtggctagggtttccaccccgagccgcccgcctggcgggacgacgtgggggttagactcactctatatcatattatcatattataagctgttttaattttttttctcagtcaactttgtttttttaggtttgatcaaatttattaaaacttaataataattataacattaaatcagcttcattaaatctaacattaaatatctttatatattatgtttgttttgtattgaaaataatgtcattttttaaaatttaatcaaatttaaaagtttaaccaagaaaaaaaaaatcaaagtcacttataatatgagaaacggagagagtattccgtttatcctcgaataattgttatcatctcagtatcattacatatattatctactcctatcaatacctattggtaacacaccggccaaaaatcattcacctcgatggaaatctgagaggcccattggatacttaataagctaaactaaaaaccaaaatttgaattttcagacataattttaagttgatcttaaaatatattaacttggtttttttatattagcttttaaatcactaagaaaagatataaattaatttttattttataataaatcattttagttttattagaaaatatgggtaacgagggcctcaacaagaaacaatcaaacactcgtacataccatgtggacttgagaaaaatagtttagaaagtcattccgacaagctaccgttattatttcttcccgtcacaatccaagtagccttcctcctcttcttcctcctctcgcgacggcaacaaacgattcacttccccattatttttccttacgctctccgcctctccgccaaacacgcccaaaatcgtcctgctcctcctccgctccatctactggatccgcgcgaccggcgatctcccccgaacctcgactgatctactggtgacgaaccctaataactcgcttgaatatattgttcggagtttttcttttcctggtcttcttgagcagtagtataatcgatactctgtagcatccatcttcgtgcggatcttgtatgctaaagttctcgagtagtactagcagtttattcatcagaatcatcaggggttgaactgaatccccatgctgtaacgttaggtccgcctcttgtttggtgaatcaattcatacctcgattctttcagggtgtgaatctcatgtactagtattgactagctgtagaaggctattcatagtcatagctttactgttggtctaagtttggtcaacgggtactattcttaggctttcctaccgctgtttctgcgaatggttagcgttgaaacgcagaattgtacaatctttttttgcgaataggttatcaaaccaagttttgatcatttgctggcatctataaagctaaactgacttccttacattggaggttggtggaagagccagcccctaccttcgttagagttccttcaaggagctaactctaatgaggctagaggttgtttcttgtaaggtgataggttggtactagtaaaatatagaatcctttgttcattcttgtccttccatcacagtcgtttctacagtttggaccgctttccaggtaagttcttttactaatgtccagtgttaagaaggtggtttgtttgacggacctcaaatcctcaataaaggaacatttgattctgaatatatagcttagacagagatttgctcagtaaagctaatatcagttgtcaaggcgtattaatttaattttgtgcttactgctaaaataatcagcacaactaatgcatatttagatgttttcaccattctcgcttctacagtccttttcagtggtagaggtgaaatgaaatatagagctagaaagtttcatgtgttcattcttcaacagcagtttaaaaagctttgttgtgttgcctacgtattcttgcatcataatgcagagtttctgtatgttctccttaacacagtacaaaaacaaagcattttctccttggtacagtaatgtgcaaagcttttatgtgttttcaaaaagcggcgcaagaacgaaccatgcctgggcgatgcatgcatgactacagtttgggctattgtggcaggctcagttctctcaaaacttgatttctaaaggaatctttgttattcccgaaacctatatttacctcaattgaccatagatggcaacaaaagttggagcaactgggtcatatatgtatgaaataaaatcagaaggtcaaattctatcaagtcatatgcatgatctcactgagaatctgacaactacctgtgggtcttcttaagttctatttacgcgatcagtcactatgtatgaattccattatctaaaaaaagacacaatgtatgaatatgatgccttgggactgatctcttggttgttggtgctgtattaagtaaatgcgtactgataatttcatcaaagacttaaaatgtttgataaaggtgcactgtgcatcttcattctttgatctgccaaatcagcaattgatgtgttagcttggcactagagctctgggagaatcactagtcaaaacttgctcgtgtttcttggttatctcattcattactatgttcagtacatattatctatttccttactgttgatgtttcaagtcttgagagttaggatgaccccgagacaaagatcaagagttctgacatccttccttttttacatcaaatgtagcctttgaccgatggcatcgcctgcagcgccaacagcaacggagttcactcaggaagctgctcgtcagtctctcattgagatctctcagtccctcccggagaaaccttcagcccagaacctggaggtgaagtcaccgagcccacgtgcagcaaacgaagatcatgaagatggagcagagaaatacagatcaaagctgatctcaatctcctacctttctccggatgcccaaccgacgccgtgccctcccaagaatgtcctcacttaactgtgacgatgctcctactcgtgcgtgtgtggcacagtatatcagtgttatacctcacttttagctggaaagatggaaatggaatacttttgggtgcttatgtttctaaccctaagaaacattcagggggaaaaaaaagaacagatagttgtacagatgactttgtgacgaagaactatttaccaggaacaggcttgcttaatccttgcatgttattttgttgttgcataagcttagttgtttccttataatgtatggttattcgaagtgctacattttgccctctttcagagtgaaaataaaaatctcttgcggttatgaacgacctgctatgaaacgaacactggcacgcagtccaattgctaaccttgttggtctcttccatgcgccattcttggtcattggaagagtatcaagcacaacgactaacctcttgccttatccatctactagtattctttctgatttagttcaactttgttcagaaatacagaacgtctgaacaatttttgtttcgagatttgtaaacttttctgaagaaaagggaggcgaaggctcggttaattcaaaggcccaactcataagaagcccaaccagcccatcaaacggtggggaagtgaagtccaacctcctggcgatccaaggcccaaccgatcatgcattcacgccactcacggtgaaccggcggccggccgatcggcggaggatggcggccgcggcgggggactcgtcggagccgaaggcgagcatcggcgcgggcagctgctggtcgccaccatccacctcggtctcggaatcggtagcatctctccgcacctctcctttcgcgcatttttgcatttgaattcggttccatccgcattgttgggggggggggggggggggggcttcccgtcggtgatcgtgctgagggaactgtagcctgtaggtccgattggctccgggagtcgtcgtcttccttgaagggagattctaccgtgtggcttacttggagtagaagagtgtctccttgagtccttttgtaccgagaggattcgtagtctacaggggaattagggcgaagtgctgtcgcttatggctgctgaatgctgaggcagagttagcgcgtgagtgcgcaggtgtactgggacaactaccccagtttgcgcgattgctctgaaaaataacgatgtagctatgcgattggctgcatagtgcatagctcggtctaaaagtgtgaagtgtgaaagaaggggaaaacccccatgaacaatacacttgttaaatcaattttcttctttaggatttcgttcttctgtttttgctttatcctttgatttagaattttatgtttgggaggttactgaattgataaatcgtaggtttattatggagtttttcttcctcaaggaaaagaaaaactaaaagaggtttggttttcacgagctagagaaatgcccaggggtcttctggctagctccacaaggtggtgggctagacgacctgggtttgaagcctcatcccttctaattatttgatattaggtacttccctaatattcacgttttttttttcacaagccagagcttgtactcagtagtatatacgaagatatatgcttggactccgtgttgaattattccatatatctactttcacttctgaattcatatatgcatccaagcagatatagaatggagtgaattctatacacaccaaatatatttgaatttgtagtgagtgaattctattcataccaaatatatttaatgttaactgaaaatttaattgtgtttgatgtatgcagacatcactttagatgtagagttcttgtgcagagaaatgctacaatttgatttcacagaaaactctgtccccgcttttctattggttattgctataagattccatgttttgcattgtgcatgcagtttttccaatgtcctttttgtactttttgtttgtcaaacttctagtagctcttgccatttttaaatttgaaatgtggtttcattttctttggaaagtttgggcataaatttccaagaaaatatttatcctttcccatcctactctgatggttgttagatggtttcaggtgaatgatgcatataaatactaaacaaacatatgtcttctacggccaaatttctgcaaatgccttctctaattgatctcctggttaatctttagttactaaccatgaatattgcatacagcttccatattcttgtcctttaatttgcaactttcctgcatttgacatcatagtagcagaccaagttttgttctgattccattacttaaatcaaagacttggccacggccaaggtagtatttccaatttctaaaacctctttgttatgtttaatctcagttctacattcattattattgtgcatattttcagagtcatattttgtagccatctgcctgattattgcatgcaaaacacattagtatttgttggaagatattttgcaaccgtaattgacatactggaagaagtcataaccattattgtttccatcgctgtataggttttattttcgcccacccatttgccttccactgtttagggaaaagaagagccttgatctcgccatgttgcatttgctttccttcatccagtggttatctgcatgaagtaacttcgatgcttacaggtgattatgcgtgtgttcctttttcctctattagttgccttggtttttgatattatcagttctgtgatatcgttttcctgcaacttggggcttagggcaggtaggataagactcagaaagcaagtattggcagtgactgaaaggtgtcctttactcttccagagttacatttgttcttaagaaatgaactttctaattgcttgtgtcttatactaaaaagatacttgtctagtttgcatttaggtttttcgtggtacatcatgttgaattccaacaagtgcgtattatattatatgcagaacgagcacttcgtgattgttcgtatggaagctatgttaacacatcaacctgcaattgcgtgcaacagtggtggtcatggaagttgtaaatgcattaatggggtttctctatgaggcctcctggttaaatccttgaaagaatgtctggtaaatgatcataatataacaattttgatgggaggaaataagaacagagcattgtggtgcaggaacaattgctagctcctcagctgctttattcttaacctttaccatcagatggtttgatagcatataatttgacttatcacatacagtatgaaagaattttccaggctagacatcaatttcctgaagttctagacatagctagagagtcagcaacaacaacaatcattacaattcagtcagttcagctattgtgagtaaaccaaattgcatggtacttatgggtctgtccatctttcgtactactaggttgtgtctaatccaggattaggttgctatattttgggatagagggagttcgcattaaatctggacttctagattatgaagttccggacgtaacacttatcaactggaatgattaaaatacctagagaactcacttattaatctctatctatcttctgttattctgccatgctgttaggacttaggatggaccaatatcatctgctattcctgcacctgagctagaatgtcttagaaatgaatatgatactagcttgagttttttttaaaaaaactgtttggtttccttcgtgtcctatctttgttattatgggcatgaatccataacatttcttgagtggctatttctaagtggagttctcttgccgccaatctttttccaatggaaagttgactagctgacagtttattgttctatggtatactattttggtatttataccatgttattttatccaaatcttttcttggatgttccaatgccaaatacttcttatggttttctaattctatatctgggacatccagaatactcataccttgttgtacctgtacggtcttattatgggtagatccctgctatgctatttcacaattaatttgatgttttggcctatcacttcatattattgttcgagacaaaggacaatttgcaaagaaatagttggtgtactattgataaattaatgcaatttatgtttcctccatgtaggttgcataagagcacagttttctgataaaagattttacaaaactgcaaaagttgcaagtcagagactcggagtattactgaagtgagtccaactcttatagaacttttttgttggtggggttcatccttcgaactataccttttgccacctctgggaatcaattatttcccggaaatatggatttgatttcttggttcctgcagctttgctgatcgtaccacaatagatctgctggcttttgcccttcaagacccaagagggctagcttgatggtacatttctttaatctttgttctgaagcaataggtcaattgtgaatagtttcttttctatgctgcaaaaggtgtaccagacttctttaccttctttaacaatgttgtagttctccaaaaggcccatatttctaaacattttcaatcttttagtccatcggtaccccagtccagcgatagacctggcatacccttaccttattctatttacctgtgttggacttgaggaaatatattagtgttgcaatcttttagccctactcccatgttgttttattctactttaatctatggttatcttaatgcagggagactaatcaagtccaagattcctttttcacggatggatggtcccagttgagtggaccttttggtgggaagcggacaaactaaagcaggttcccacttgacaccttaattttcttcaaaacaactttcttcacaagatctcttgccaattaaattgagacccagaggtaaaattaccacataatcgtcactccgaaaaaaatgtcactaacatcgatagttagtcaaaaaaaaacatcgatagttcaatatggctgacatgctaattcacaatctttgtttgcaacccatcattttaattcaactatatatatatttctctttccgagggagtaatatgtgaaagtattccttttcttcgaggtaaaaaaaaaggtaccttatcgtaggcgcaatcaaggattgtttgtttagggcatgtttaattcgcgaaaagaaaatatttgggtgtcacatcagatgtttgaccggatgtcgaaaggggttttcggacatgaatgaaaaaactaatttcataactcgtctggaaaccgcgagacggatcttttgagcctaattaatccgtcattagcacatgtaggttactgtagcacttatggctaatcatggactaattaggctcaaaagattcatctcgcgatttccatgcaaaccgtgcaattagtttttattttatctatatttaatactccatgcatgtgtctaaaaatttgatgtgacgtttttgggaaaaaaattaggaactaaacaaggccttatatcgcttgcttgctgatggagtgatggttgattggtgattggaccaatctatcatttcttcatattggcaattgattcaagtcattcatcgtttttgttctaacaattaataatacatccaaccattcttggtaattttgatttggaaagaaaaatatctacctcactttattaaggattgcactccatctacttcagatactaaatcaggtattgaagaaccacccaaattacacatgaggcagtagaggtgtttttaggtaagacctttatacttatatccttagctctaaaagccaagtctggaaaataaaaaacaactaaacaagccccctaaattgattcaaattaagttttaaaatttgctgcagctcaaattaagttctaaaaaaagaagtttactatagattgtttgtacagctggttttaagtatttaaggacattaacttgaaagtagaagtgttcagtagaccttataaattagaaatagttgatgtcttgaaatttctaggctcatgtttcttgtggtctattagtggtgtaaaagcactcaatccatttcaaccctattgaccaagtgctgtcacgtgggtccaaatatcagttaaagttaaaacctactactacttgccttccacttccctatgtcaagcgaaacaaaattttaattgtagttcagtatattaaactccgctagattcaatagattaggcttgcctcaaagacaaccactgactctctggttgcaaacagtttgtttcccatggcttggttggtttgagcagtgttgtagtaccctttaaaatttttccttgcatgtgatgcgagagagcggatgggaaggtgaaaacgcaggaacagaccctatgacccctgcccctatgcttaggtcgtgtttagttgtttggtcaattttttttaagtatacggacacacatttaaagtattaaacgtagactaataacaaaataaattatagattccgcctataaactacgagacgaatttattaagcctaattaattcgtcattagcaaatgtttactgtagcatcacattgttaaatcatggcgcaattagtcttaaaagattcgtctagcaatttacattgcaaactgtgcaattgattttttttcatacacatttaatgctccatgcatgtgtccaaacatttgatgtaatatttttggccaaatatttttggaatctaaacacacccttactggatcctttgcgttctctcgaaccatatatatccatgctgtctgtgccggatacatgcattgcgcaagaacaacgtgccataaatcattcatactgtgccatcttagcttaacttaatgcttactgtagctcattgtgatgtgactttcaaatctgatatctaatcttaagagcaagtttaatagtatagtcaaatattagctccaaatcatctataatcaatttaatagccaatctatataatagttatctataaacatatactacacttttaatatctacaaattgtgtcttacagtccgtgttatagctgtctacaaatttatagctccctgctcttctctcttctcctttatctcctcgaaatatgtttattgttggcttataatctgttattgtgcctgctctaacattctcgtgctatagtattatagacacatgtcttgactaattttgtctaaattatagcgggcaatttgattaccgccgttttttaagctatacttttatcttatcagttatggcattggccaaactctccacgataattattgcctattggaacctggaacattagtagcgtagattgtactcctttggaggaatcctaacttatggttaaacctcatggaaaattcactttgtgtccatacgtggttgaatagttcttttgttttacaatttctaatgactatagatttgacacttcaactcttgtgttttcctaatcccgtttttaaattcatgagtcccctaacatattgttgtgtgttccacacagcagaacaaagaatcaacctgaattactgaactccaccgtaatagcttaagtgactataatttttcctattttcctgcgcactgtatgctgtaccaacacatatagaagtatctgtttaagccattgacaacaatacatgaagcatcatagtctatgttaaagttagccgtccttcttttgcctgttcagatgctaacaagctgtttcgtcaaagattggttcctacctgtcttccccgcaggtgaagtcgctgttttttttccatgcaactttgcaatcatgcttttgtcttttgcctgttgagattttcagaatggaacttgggggtaagtatcaggttagcagcagaaaacaacggggccgcatttcggcacactgcatccatcaaggaactgttgagtttgacttgccaggtacccctcttcttccagaatccaatgccccttgcccttgaaccctttatttttatttttgaaacttattgaaccctttattagacgtgctttcatttcccgtcttctttcatgtgaaacacccagagaatatcatcaggtcatcaggagcaacttttttttttagggaagtcatcaggagcacataaatgttttatcaagaaagccattttgcatagtataaaaagttcgaaattaactgttaacatatattgtagtaaacgaatgttagcatttggtagtaactgtcattaaaattaaattaatagaattttcactgattttttttctgttttctggatttccttttctagcaaaacttatccttgtgaattctagatctgtagattttttttttggcatttatctcaaatttaatctatgtgaaaggttttattttagatttttgttgctgttcaaatgacttattctaatggatttttacgagatgaacttttattatattagtagtgagctataaaccaactataaacttatgtgtaagagaaaaacaaagaaaatgcatgagtgttggctcttatacaagagaaagagaaaagcttcacattaaattcatagtaagaaaaagattcagacaaaaaatagagcaaactttatagttaatttattatacatattagctctaacatggactaatagctaattgttagctctattattaaacttgctcccatgaaacaccatagaggtttcaagaatttctcttcctcggtgcctctaatattgactgttgccccattcagtagaagagcctacggagttattgcagctgcagctacaactaggcaacaccattctagaccctcttcattactgcacatgcaggactgctcactaacatgtgggaccgatggtcagtggacaatgggacacatattattgttggcttgtaattgtagtaaatgggtagccgaataggccctgtatagaatgatagaataatttttgggagtagattacatgcacgtgaaaatttattaaacttcagtataactatcgttttgttattatatatgggtttagtttaattttgatttaagtttgaatgctttttccacgtaattttgtatatttatgaactgtaagtttatttcatgtttagggtataataatctactgctcaacattttatgaagaaaaaaaaaggttctcttttaaatgagtaagtaatggagtaacggaaaccattgaatcctcatctactccctccgtcccaaagaaaaacaaaccctagtttccatgcccaacatttgaccgtccgtcttatttgaaaaaattatgaaaaaaattaaaaaaacaagtcacgtataaaacattaatcatgttttatcatctaacaacaatgaaaatatgaattataaaaaaattttatataagacggacaatcaaagttggacacggaaaaccagggtttgccttttttttttgggacggagggagtagatgagaacttttaaaaatttcaagcacctgaaatctgatactcccataattctttatttgcgccgtgggccctctcatttatttttttatataatatgtggaaagaatattctatccttatttttttcgctcacaggttttctcttaattaccttttttttctcttttttttcgatggtgcatgaaaatactagtactatcttatactgtcgcttttcctctttctacgagtgtcagatatggtggagttcgagttcccaatgcttcagttggcccgccaaagccatccaatttgccgagacggacaccccgcgcgcgacgccacgccaccgcgcgcgaatttacgcggttgcccctcggtggagtccccttcgccgtaattagcccctacaaggaggggcagtctcggcgcgaaacgttgactcccctgcactcccccaatcccctccacgtcaacacggccctgccacgtcactggcgaactcttcccctgctccccggcgtgagcggagcaggtgcggacaaaacggcccctccaccatactaccagcaccacctgacaatttgcgttctcaccccaagttaaactcgtaattacgtgtagccccctcctaggctcaccatttataggagattttttttttcaatccggtacttgagaagggttggaattaggatttggggttcttccttggtgcctggtaatggctaaaataatccggcctagcgcacggtgcactcacgaacgaacgactgcctcggccagtgggggcgtactggtaagaaaagcccactcgttactcgttagtgctgcctccgcatcatctgcttgctacgctttcctttctcctaagagcattcccaatagaaaccacggtagcagtggtcttatatgaaccatatagcctaagagcatgtacaacagcgggctaaaagtcagctgtaaatatattttaaagagataaatgagaagaaagaagggcagtgggctatagatttgtagccagctgtagcatggatttcaagacatagtgtgtgtatgacaggtgggactagatattaatagtgtagtatgtaactattgtatgaatgagctattagattggctatagataaattggagctagtagttggctatactattgaacttgctctaaaatcatgctatataagagtaggacacactacttctattgaaggttacttcttaatccccccgtttcataatataagcatttttagagttggacacggttattaagaaagttggtaggattaaatgtgtgagtatagtattggaggataagtagagataggtggaaaattaaatagtgtagggttataattggttgaaaagagaatattagtggagaagttatattttatgataaattttaaaagctataagttgttatattttaggacggagtaagtaaatattacgaaatctgaggatactttgcgaagataagcccatcccagcccacaaacacaagcgctgttttcctctcctacccttttctttattttattcggcccactccccctcctttttctcgtctcctccgccccagcgcccggcgcctccccttctcttcaccgccggtcgtcggcgctgccgactgcgccccacgcgccacgacgactcagccccaccgcgccgcctccgactccaccccatcgcgccaccgccgactccgcaccaccgcgccgccgactccgccccaccacccgtcgcctccgctcttcgccgcgccagatccggtgggccgcgccgtcgactcctccccacggcgccgccgacgactccgcccctctccctccgcccttcgccgcctctctctccctccgcacggcgagaggtgcgcgcgagccgagccggagggggaggggagggggggagggagcggcggatgccatgggcagcggcgcgtcacggctgctgaccgcgtgcacgtgctcgcggccggcgccggcgtccgtggacgcggagccgtgcctggacgacgctctcggccactccttctgctacgccgccgccgccacggccaccgcccactcctcgtcgttccgccacggcatctccggcgccgcgctctccgccaactcgtcggtgcccgtcccgctctacaacgcgtccgccgccgccggcggcgtggcgccggggtactcctcggcattccacacctcgtcgtccttttcctccgcgccgctgcagctgtccaacctctcctcgggcccgctgttcctctcgggtcccatcgaccgcgccggccagctctccggcccgctcgaccccgccgtgcccttctctggcccgctccccgcaaagcctcccaagcccgcgtcctcctcatcgagggggttctcgaggaggttccggaagccgtccttcggcagcctgcggcggagcgtgtcggagaagaaccgcccgtgcgccgtgccgctccgccgcgacgacggcgtgcagtgggcgcacggccgcgccggggaggaccgcgtccacgtggtggtctccgaggatcagcggtggctcttcgtcggcatctacgacggcttcaacggccccgaggcccccgacttcctcgtcaccaacctctaccgcttcctcctccgcgagctccgcgggatcttctacaaggaggccgacgcggacaacaagaagctctggcagtttctcgtggacggcgacgacgacgacagcgagctcgacttctcgggctctggccggttcgcgctgtcactcgacaggctcaaggagagtcggtttcacatgtgggcgcacgccgcggccgacgagagcggcagggaatggggttccaggaggttggcaccggcgcctgcggtgagggaccatgcggcggtgctagccgctctcacccgggccctggcctcgacggaagcggcgtacttggacatgaccgaccagtcaatgggaacccatccggagttggcggtcaccggggcgtgcctgctcgtggccctcgtgagggacgacaacgtgtacgtgatgaaccttggggacagccgtgccattgtggcgcagcgtccggacgatggcgacgatggctgtgtgtttggaaccatgcggcggatggaggacgtcggggtgggcttggagatcgagacaaggcccggcggatgcgccattattgggcttaagccactgcagctgtcgactgatcacagcaccagcatcgaagaggtacattctcgttgacataggggaacaaatgcttacacgtgtttacatgcaattgcctttcttgtatccattggttggcacaatggcacgggcgtatggggatgctcatgtcgttgtttgggaacaatgtgctgacttatctgaatgcgtctgcaatatgactactatcctcttgcacttcaaaagccagaccattgccctttttcacttttgctttttatatttcagtacttcatataactagttatggtaagcattgttagtcgcttcctttttttatcattatttttatggctatgcattaatatcctttgtgttggtctgcaggaagttcacaggatcaaacgtgaacatcctgatgatgatcagtgtattgtaaatgatagagtgaagggtcgcctaaaagttacccgggcttttggtgcaggctatctcaaacaggtaattgtgatactgtttgagtgggtcagccattcttttaatttgattcttatacttacgatgtttgttttgtgtggtatacatatccatcttcagagcaagtgcatttgttgtcagtactttgtacttttaactagaaactatatctgtcatgtgttctgattaatccaatgccctgattgaattaatatagacactagataattcttgatcatagaacttcgtgtatttgtgcaggcaaaattgaacaatggattgttagagatgttccgcaatgattacattggtgatacaccgtatatatcatgcacaccatcgctttgccatcacaagctcactgcaagggatcagtttttggttctttcttccgatggcttatatcagtacctgagcaacgaggaggtagttttgcatgttgagaatttcatggagaggtttccagaaggtgatcctgcacaaagtttaattgaggagcttctctctcgtgcagcaaagaaggctggtaggctctcttctataccatacctcttgcttatttcaattcctgattgattctcgggtggttttttttgtcattgtatataacatcatgcgtatagaattggatgattatgtgcaaacattgatttgcctgcacatgtttgtctcggttgtcaaaacttcctatatcagtccatggcatgtgaggaacttctttatacttttaccaatcattcttgacataaagttctgtttgatgaaatagtcagatactcatgcaactccctcaagtttgtgatttgataaaattctaccagtgtatccttggcttattgcattgcccacctgtatatgagaccaagatacactttacacttttactacatcacaaactccactatggcttagagtgttagagatgattgacattgtcctagcttaacaattatggtttctcgaaactgtttgggccagtgagctaatcagcctgcatgctcgcacacttggagcatctgtccctcttgccaagaaatgaactacagctggattttgcaaactgggtatactgtttttcagcactatgtgtcctaaggtgcaagctggttaagcaaaacaaattttgcattgttggtgtaaagaacaccatggttcagttggtaattttggctctactgtaggatatttttgtattgattgttatgaacaacttgcagtcatcatcattggtacacgtttgtgttgaatatttgaatttcaatagatgaatgtcttgtcgaaacggtttccagttgtctttaatgtcaaatacatgtacctttttttttctcctttctccctcagtaataccatgatttaacttttacttttgtttctttaggtatggatttttatgagttactagatatacctcaaggggaccgaagaaaataccatgatgatgtcactgtcatggttatttctctggaagggagaatctggaagtcgtccggaacatatgtgtgatgatcagttggaacaatgtcgatgtcaatatttatggtgacgcatcaagtgatctcagctggtcagagcctctgagcaactgcatttatgctcatcaggggagaaacacccacagatggctgacagatgatgcactccatacatttgtcaaagcgattggagttggagccagcgttggtctagatcttagcttcagcacaaaacacagtccatgaatgtgctagagagttaattctcggttggaccaagattgcagagagagatgacacatatgaggaatccctttgcaaagcagagttaagaacactttcttttgtgacccgcttagttgattggttacatactcacctgtgacaattccctcacccccctcccccctagctggctagctatgctgcatagagattgacacttctttcatttttggagaaagaacgtctttggaaggcgccgttttcatgttcatgtcaggaatgggaaggaaatgtaatatgattggatattcatggtgaagaaattgaaaatgtgtccctcatgtggtgctcaacatcgttttcgtaaagtcctgaactcctgatagtccattggtattttgcgtgctcgaataattaggacagcagttgttatttgttcggttggtcctatatctactgttgttcgcagttgcctggaatgggccgtggtttttgctggctggatcgatctctcttggtatgggtcgacgccagcttgttttcaaacaaattgcaagtgctatccatttgatgattcagtcaacgattcagcaccgtcgaccagaagatttctaacatttgattctgatttcggtatcggctaagcaagaagtaaaaggcaaacttaacgctccatttggaatgatggcaatttgcatgaatttcatatctgaaacgttttcacttcctgtgtttggcgtaaagctaggtatatttataagtgacactctgagattacaaatgtgtgcactcaattctgaaactgcatgcttgttccaaccggatttcccagctcaattcaactttcaaccgtttgatctgaaatggatagttgcaaccgaactccataagattgacctgcagtcatctatgtaatccattcatccccagtttcaaagtcattgcaaagatcaggtaaaccttgtaacggaggaatcccaagatgaagatatcaaatctttgagatactctagcctatggttggatctttaggtaacaagaaatttacaggagaaatcacttgtacgactagcacgatctcttggcagattagtacgaagcatctgatgatatattataatggctttacgatcggtgataattcttaggatgcattttatatgtgcattagtcaacgtctggaatgattcttagcgatcatgagctgcgtttaaatagtcctttgataaattttttttcaaggatttgaaagccatctgcttgtgacgtacctactggctactgagatacgaatcgcattacagggtcaatgcgaacatgatctgagaggtatagtgcgttccatgtatacttatgcatcctcagatcagagagtttttctattggtgtattgcacgttagctcagcgtacacaattgtgcaaacaaaacataatcacctttctaattattttcgtctgcatcactgcaaagacgtttgagattttcagtacggaatccgttcttgaaaggaaatggtatcttgttcttgacttgtaaatgttaagaactttcggcgtttgacttgagcaagtggtggtatcttacttgtttactccgaggagcttagagcgcgcgcgtctcacttctaggacaggaaacatcgtcgtgcgaagcgctcaaccgcctgcaactaaaatcatatgaactgtaagcaaaagagttcaacaatatacagccttgcaagagaaaagcatgaaaatccttaaaaatcaacaccaataatcggaagatatctgccgtccacacccaaagtgtctgccgtctccatttaacaattcatgatatgcatatcacatttgtcattttcttatgttttttgttttaaattaataccatgcatattgcatagtctcctcctaactactccagtaaaatttaattagtggagatattaggattgcacttggtcatcatttgtcaagtatggccacaaacatttccaatttccatcagatttatggatgtggcatggcatacatatctcgaaaaatactacataatactatatactatgttttagaaaatggaaatgttttgcacgtcacttgaaaaagtccaatttacaggtcacatcaagcttccatgagaccatgaccttctcaccactaattgcaagcatctcttacctttgactattgacttgcacacttgccagcccatatgcccctacaagtatatataatgagcccaccgtgtcattacttgctcagcttcagctctgtgactgcgacgcgaacccatggccgccatggacgagcctcctcagctattcctctgcccgatctccatggagctcatggaggatccggtgacggtgtccaccggcgtgacgtacgaccgccggagcatcgaggagtggctcttcgtctacggccggaccacctgcccggccaccatgcagcctctctccaacttcgacctcactcccaaccacactctcaagcgcgtcatctcgtcgtggctcgatcgcggctcgtcgtcgtcgtcgtcttcgtcgccgtcgacgtcgacgctgtcgagcccgatccacgagctggcgacgccgctgtcgcgcgcgctggagcaggagcggttgctggctgcgctggccgagctggaggagacgccgttcaaggtgaccaagctgaagagcatgagggcccgcatggcgggcgacgtggcaatgcagggggagttcgtcgcctcgggcggggtgcgcgtggtggggcgcgtgatggcgcaggcgctggcggagagcggcggcgacttctcggcgttcgccgcgtgcgaggaggctgccgcggtgctcgccgcgctcccgctctcggacgaggcgtcggtgcgggtcgtccttgcgccggagtgcatcaggcccgtcatggcgctgctccagcgcggcggcgccgaggcgaggctgcacgccatggacatcctcaccaagatctccagctccggatcaggcggcgactggaccgccggcgtcgacatcgacgacgtgatcaagtccctcctcgagctcctctccgacgaggcctccacgaggctcagctcgcgcgcgctcgacgtgctcctcgacgtcgtggagcgggcgcggggcgcccgcgccaaggccgtcgaggtcggcgccgtgcacgtcctcgtcgagctcctcgccgacgccgacgaccgccgcgtcaccgagcgggtactgctgctgctgaagcggctgtgcaagtgccccgaggggcggctcgccttcgcggagcacgacctgtcggtggcggccgtggcgaggacgatgctgcgcgtgtcggagctgtccacgcagctcgccgtcaaggtgctgtggctcgtgtccgtggtggcgccgtcggagaaggtcctcgaggacatgatgctgaccggcgccgtcgcgaagctcctggggctgctccacgtcgagagctcgccgtcgacgaagcagaagacggtgaggatggttaggatccacggggtagtctggaggcagtacgcgtgcttccctaccgacttcagggactacctcaggctgctcgattgattctttctcccctctctttctgattaccgtggctaagctgtaacaacaaagcagatggaaattgtgtttttttttctggtccctcgaaaaaaagaatgtgtattttttacagaaaaaaatcggaaatgtgttttctcatcacgtacaaaaaaaaagggaacgtaatgcatttcaagtattcaaggatatcatcgagattttcaggcgacatttcccctggttttttcgaacaaaccaatcaagtttgattcggatattatcccccctgatccaaattctagctgttggcaccaccaatctataaattgcggcatcggtattgatgaatagagcttttttacaggccacatcttctagcgataatacgtgacacttcgttcgtttcacaatataagaatttcttacctgtatttatatagatattaataaatctagacacatatataaaacatatacattcatcaatgaataaatgtaagtaacaccaaaaggtcttacaatataaaacggaaagagtacttcttaactccaacacttcgatggtaagttagtgttgcataacaaaatgttcctatgcgtgagcccgttgtctacattcagtctggcttttgtcacatgtctcatacaaccttcatcctaaaatataattatttctaactatgtactctacctagaagtatgtaaaagtatatagctaaaagttgctatattttgagataatggtagtataatattgatgacaaacttagaagttacggttgagtttgctaggagcttgtttagggagcaggaggagtaaattctagagggatcttagatggtcttattgttgaggctgcatttgaaaagaggcattaattagataataattcacgaccttttagatcaggcacataatgcggtaatgcccatgaaaatagagtagagtaggctagacatcctcgtaaattatggtatagtctagtccatgtaagttaattttatgggcttccaccacgaacaataggttgttgggaaccctcagtgagggaaaggagaggctgagagggtgtattgacaatatcaaacaagttataagtgtttaaaaccttatattataactatcgaatctttttaaaaccttatattataactatcgaatcttactttggtctaacaaatataatcatatcgggccatggaaatcaagaaaagtggcaattgatcacttacatgttcgaatggatgaatttatgtgcaaaagaatgtccatatatttccttttaaatcaaaacattctcttaagggtaaatagacgataccacaacaaaagtataccaagcatcttaccctatgtcaagactttatttaattggcaacaacacatgctactcatggtgtaaatctcaacaaaaggaatatcatgttatgagctaaataacttgaatacgaccctacgttaatcattaaaaaaagagtgaatttcgtataaccacatgttctatggtcaaaattgcagaaaactgcatgcattatgacttttgacttgtgacacatagtcacatatttttatggtctaaatgtttcataaaaccccaccttgattcaaatttcaatttgatttatcatatatgaaacaatatttttcaaagtagtaaaaaattaagctaacaaccttaatcaaataggagtagacctacttaaaagcaaatgttttgggacgatggtttttccatgtcttaataggtattgaagtctttcttacttccagtaaaactatgcaactctgtttgccttctgatttttattactagtagcttaattaagaatgaacataattttacataaatttcaataaataacttgaaaaatttagaaaaatacttccttccaataaagtctaattacgtatgcatgactaattgacatatccattatattggtctatctttcatcccaaaagagagaaaaaattgtcttgtttgttaaccaactccacaagactacattggttctgttcttgagaattattttcaggtctacaattattgcattctggatttgggactagtaaaatttcttcaggattattgctgctactactgtttcagatgcgatgaaatttgaaacttctcgtgggggccatcagtccaacaccaaccgagcttacctacaataggcgaccacggaaatatgctctcttgcgaggtccatctcgaaaaagtacacgaaaaagctccccggaagggaagacgacctggggctggttgctcgtgctgcccccgagatctaaccaaaacccgcgtcccatctcacctcgcctcacctcaccatccgacgagcccccggatcaccggctccgacctgtcgccggcggagagcgccgcgggatccaggcgttgaggttggggagcggggtgtgtgtgccaggcgctcgggcgggggcgagcgggcggcgacgatgccggtggcggcgtcggccatctacttcctcaacctccgaggggacgtcctcatcaaccgcctctaccgcgacgatgtcgggtgcgtagtaccgttcgcaatcatccccccctcgcctcgcctcgtcgtctcgccgcgcctcctgcgcccgcgccgctcgtggtttggagtggtagatctgaggccgttgggatcgattagctccgtttcctagctcgccgttgcgcggatcgcgcgaggtctagtggatagctcgtgaaattccgctcggaaaggcttcgattagcgaacgggatgcggggattgactcgttgcgtgctgaaatttggcccctaccctcaggttgtcgcaataccatgtggttgaatttcggaatggtatctcgttctttagcttgtgattgtggaagctacatgttttgcagcatgaaggaagatgccactgactgaaatactgaataggagaattagttcgatttcaccttggatggctgtgctgtggtggtcgattatctgaaacaattgactttatactatttcccctccacattctgaattcgatgttgtgttgactgaagcatttcatataagctgactgctgcatagctcatatgatctttcctagtggtttactatcgagaaagatatagcaagtggccttgttgtctttaatacgatagccattattttctaagggtgctaaaaatgtaaactaccactaaacattttcggtttgcttgtcttacttaaaaccctcttttttttggtatttggttgcgtgcaagtttactgaccacctgttttgctcattatgtatgactatacaggggaaatatggttgatgcattcaggatgcacattatgcaaacaaaagaactgggtacatgccctgttcggcaaataggaggctgttcattcctttacatgaggattagtaatgtctatattgtgatcgtggttagcagcaatgctaatgttgcttgtgctttcaagtttgtcgtggaggtatgcaatttatatcatctttgaataatttggaataaaataaatataacatgcatacatattacatctctatgatctagatgaatatgaagctcaagaagtcaattgttgttttttccgctagaaatggtatgtctatgttagtgtgttgtagcatagatggctagtctaattcctcaataagtccagagcaaaagaatctattagttactaaagaggcatatgatttttctgaagttacctgtttaataataataataattttaaattgcaatatgccgtcgaaaagtttagacagttttaccatctaatgatggtatgttttgggggcaactagaattttctatcgcttaagcgtaattgcgtaaatggtgatgattttttgaggaaccaaaagttttttttttccttgaatggctacatggtcgatgttccttgttaatcattgctggaaaatactccttaagccctgtttcgatgctttctataatttcttaagccctgtttgatgaggctgactgggcgtagaattagtttaactagttggtagatgtgagtcaataatgaagcttcagttataaattctagacatatatccttctgatacctgcatatcatcctctagtgttttgaacggttttttatgtatgattttttttgtaaattaccaggcagtggctcttttcaagtcatactttggtggtgcttttgatgaagatgctatcagaaataactttgttttaatctatgagcttcttgatggtaagggacatcttatttttggactttgtttcatcaatttgcactgtggatgcttctatttacctgtagaactgtctctctcatctaactgtgcagaaattatggacttcggttaccctcaaaacctctcacctgaaatcttaaaattgtatataactcaagaaggagttcggtcgccattttcctccaaggtgagaaaaatgtgacattgaaataagataaccggataaaaagtcacatcaaatagtttgttgctcatttattttgtgtgaaagcatctgaatcattttttttttgttctctgcactgatagccttcagataagcctgttccgaatgccactctacaagttactggtgctgttggttggagaagagagggtcttatgtacaagaagaacgaggtgcctgttccaaatgccacctccaagtttcatctgtatttggacatattatgcattgctagctagctagcatttctaataatcccagctcagcatagatgctagtaatgtcagaacgctgcatgtatttcgacatgcagaatagttttcatacatattgtcaatgtgcactagattgcctgttacagaagtagtccatactttatttgttgatttctttgttgccattttggttctgcatactttatttctttttagcactttgcatgactctttttagcattgagatacactaatatagtattcttttctcttgaaaggttttcttggacattgttgaaagtgtaaatcttcttatgtcttctaaaggtatttcatggattactatgattttattgtactgctctgatgtttttgttgtccttaatgttgctttgactgatgtttaatgtggaaattgccttctctgcagggagtgttctacgatgtgatgtgactgggaagattcttatgaagtgcttcctttctggaatgcctgatctgaaattgggattaaatgacaagatcgggcttgaaaaagaagctcaactcaagtccaggcctgcaaagaggtatcactttatcaataattagtacatgaagaaaaaaaattgagcatctggtttttctgattagtatagtttatatggtatgtacacaatctttactactttaactgaattgtctgctggtcggttctcctttttcctcaacagcggaaagaccattgagcttgatgatgtcacattccaccagtgtgtcaacttgacaagatttaactcagaaaagacagtcagctttgtgccgccagacggtgaatttgaattgatgaagtaatattatgatccctccttatgcttgtattagttttcccctgtagtgacatttttattctttacttggcttttgaccacaaaattctgttgtagatatcgaatcactgagggtgtaaatctcccattccgggttctaccaacgattaaggaattgggccgaacacgcatggagataaatgttaaagtaagtgtgcatatctgaaattgtgaatgcatgaggccattatcacgttttctgacacgatgaaccttttacacaggttaagagtgtttttggtgctaagatgtttgcacttggtgttgtcgtcaaagtccctgttccaaaacaaacagcaaagactagtttccaaaccacatctgggaaagccaaatataatgcttcaattgattccctagtgtggaagtaagtgcaaattatttctatatagcagtttatctatgagaaagatgttctttggcttttctttttatgggttaggtcttgttctggcagagcataaacataaacctaccaatttttgttggttacggtgtacaaagctgtatccgatgctatattggctcaattttcttactcttgaagagctactccttgccaattttgccacaaatttattagcatgccttttgcactcataagtcttgacacacttctgcaattataggatcaggaagtttcctggacaaactgaggcaaccatgagtgccgaagttgagctgatttctacaatgggggaaaagaaatcatggaacaggccgccaattcagatggaattccaggttaattttacctccttttgaacaaccctcttatcattagcaaaatctgtcagccagttcattttatttttgagcttacagaaaatgcaatgttagagatatcataacagttatgaattaaacttgagcatgcacaagaaaaaaaaatggtattccatcattcgttggcctttgagtatgtttattatccgaggtgttatcttgaagtgttcttacaaaaaaaaacatcttctgcttcattgttatgctgataaaatgtgccttcgagtttggttatcttgtttaaccatgctttctgatttgttgtttctgtaggttcctatgtttactgcttctgggttacgagttcggttccttaaggtacgtgcagggaatgctaatatagaacctttttaacacataccagacagttcagaactcatgttgagatgcatattccaggtgtgggagaagagcggttacaacaccgttgagtgggttcgctacatcacaagggctggatcatatgagataaggtgttagcgatgaagaaaaaagtcccaggtatttggcacggttatttcaaggattcgcggagctttctttctagtacggcgtcatgaatgatcataaagcatgtatattacatatgacaccactttttctttaagctattactttggcaaagggtagagcagagcagacaaattttcctgggttcttgtaatcgttttgacacgggatatctagtatcccctgagtcttgtttgtgtggtagggcatattttcatttgtatatgagaagatggcggtagcgtttgttcttgttgatcaatatacatatactcattggcagtttgtattgctttcttattaaattgatgggtgaattcacttgcagaagcaatgtgtataaacatgtgactcgacggtgctcgagacatcgactcctgaagtatacagtgtcttaacattttttgaggttttttttgcccttttgcgaatgactatttgtgattgccaccggagtccatgcgttttatagggcttacattggtatcgaatcaattttcgtaggaatctgaaatatttcctgcgtttcatcatagtagttgatgggttgagatagagatagagaaaaactgaggagtcagctgatttttatgatagctatttattaagatacaaacgaataaattaattcctacagagttgaaatcaaaaggtattctaaaaaaatattactacacctagtacaaaggtgaaaacttattttagaaaaatattttaagaatagggtagtagcgcatgagcatccgattcgatatggcacgcatctccgtggcgtcgttgacactaacaatgtcgcgtgattcgtacgggagtcgggacagcctcctcttgatctcgtaaaaatattagaacttcataaaataacagaaaacctatacaacgatatcccattagattaggatacccttttatgagatagtatctgattcttttgtgatactagctgtatggtacccgatacctgtaataccatgttacatggtacctataataccgaggacatgaaacctgtgatactcgcaagagaatagttaatatgtctatcccgttgtagtgggatcccgttttatagcagccctcgataataaagttagatagattttttgaactttctttttttctctaatttgcaaatctatttttcgatctcgttttcatgtccaactttaattgtccattttatttaattttttttaaaatctaaaaatataagtcatgcataaaatactattaatactttataatatactaatagcaacaaaaatattaatcataaaatttttttaaataagatgaataattaaagtactattcatgttttattctaatatactaatagcaataaaattattaatcataaaagaattttaaataaaacgaacaattaaaattaaacacgaaaacttatagctacgcttattttggatagagggacttgattggctgagtttgagagtaaaggaaataagaagattaagaagagacgcaaaataaggtgagctattagcgcatgatgaatataactattttaaaattttaaaataaattaatatgattttttaaagtaacttttcaatagagttttttttaaagaaaaacacatcggctagtactcctccgtcctataatataaaggattattgtttgaccactcatcttatcttaaaaaaatttgtacaaatataaaaaacaaagttatgtataaagtaatttgaataataaaataagttaaaaaataaataataattttaaattttttttaataagacgagtggttaatctttatattttatattagggtcaattgcatatttgccatcggtttgaaccggtacggtgaatttgccattataaaaaattttattgcatatttgccaccaaacacagatagaacccaacaaccttgccattagactcacagatcagactaacactgttagaaggttggttttgatgaaaattaggacaatgttaccttgccaaggaaattgaagcaacagagtctttcctctcctttttcttctgccgccatggtgctgctacaacatgttgctgttactgcagtccgaagcagcaagccgctgcagctgcccaagatgcagccgtgctcgccgatgttgtttgccgcagcttcacaagcctctgccgtgctcgccgctgctgcttccgtagcgtcacaaactgccgccgcgccgtcacgccgtggccgcccgccttgctgccccgcaaaatccatccccgccttgctgccttaccatatcctactttattgcaaccaatttttgtttgatttgctcttgatttggaagaagagatgagaggatttggggatgtagtagggttcgaggatagggaagggaatcggccaatcgggacctgcctttctgggagatgggggcttctgcgtgcgagaggggtagggaggggggcaaaacggtcttgttgtgcagctttgtttttcacattagttttatgaattatttttgtcttcttatttgcactagctcaaacggtaatggtaaacggaaggtacacatatcagttttaatggcaaatttgcagtttgcgtttttttaatggctatttcgaattagagggtaagagtagtggtatatttgcaattctccctttatattatgagatggacggagaagtagtttgggaaggtgttttctctcactcaatctcccagcaacgaatagcaacctaggttcccatcgcaactgaccgatccccagccgccgccgccgccgccgccgccgctcaaggaagcgcatcagatggcatcgccgtcgctcagggacgccgtgggcggcctcgaccgcgaccccttcgtctccctcctcgggaagctcatcggcgagtcccgccgcctgcagaacgacccgccggccctcgtcccgcaggaggacctcgtggcgcagcacgtggtcgacgcgctcctcccggtgtccatggagaccgggggcggcccgctcgtcgtgcggaaggtgagctacgccgagggccggagcaacgtcatcgtcgagtaccccggcaccgtccccggccgcgccatctccttcgtcggcatgcacatggacgtcgtccccgccaaccccgacgaatgggtaggttgctatggagattgttctcctgacgctgtcaaaaattgcttctcaagtttatgcttctttatgaattaatgatttgagtggttgcttgatttggtgtgtttctgccggatattttgattttgtgatcttatctaatttcgttgatggttgcctaaattgcatcattctcatatttacgggtggattatcctggtgagtagtgaccttgtttatgtgagctggtgatttctccatagtaataaccgctttgttgtgtggttgttgtaagaaaataataagttgcatgctagcgttgcataagcatattgatagatatgatgggatatagtaatgtgaaaaatggcatattgtttacttccactgtgttgtatactgcaaaaatctttgctcaatttcatgatgtttatttttgctcgtgctagctttgttgcgtcaaattactaaaaggtttacctcaagtaaatttctccttggttctaattggtggcccaaacgtctctacttgtccaggatttcgatcccttctcactaacgtttgacagtgaagacaaggacaaacttaggggccgtgggacaaccgactgccttggccatgtggcgctggttgctcagctcatgaggagacttggtgaggtcaagccggtgctgaaacattcggtcattgcggtgttcattgccaatgaggaaaactcacttatcactggcattggtgtcgatggccttgtgaaggatgggttgctggataagctcaagaatggacccttgtgagtattgtgctgtttgatgcatggagggaatgtccgactaaactaatgtgttgttcgtgaggaatatgtgctgatttggttgtcattgttgtgtggcattgtgaaggttttggatagatacggccgataagcagccttgcatcggcaccggtggagtgattacatggcatctgaaggcaattgggaagctattccacagtggcctcgcacataaggtacctgatttgaacttgtcagaactcagaatagtgtacttgttgtgttatatagctccagtaggttccagcaatacactgcttcgtggaaagaatgcataaagcatatggttcattttctatgacctgtgttcttttaaattgtatagctgcataaattaagcttgcatccttgtagttagtgcaaaagcaacaatttatattgatcaatgccaaattgaaatgacacaaaaaggataaggaaagtgactgcttaaacatgagttatgttgcaacttacagcgtgatcactctgcttttgaaatgttatctgttgcaacattaccccttggattttttttggggggtaaaaagtgcagaacgtgtcttcatcatgctagggaagattcattcgaatattcaattggcttagagggacaaaacaatttcaaacatacaagttgggagacaacaaatattgtatttgtatatgaattacttttcttttgtgtgtgtcaggccataaatgccatggagttaaatatggaagcactgaaagaaatacagactatgttttacaacgatttccctccacatgagaaagagaagctctataagtttgctaccccatctacgatcaaaccaacaaaatggagctgtatgttcaagttttacttgtgttttctaatgttacaactttttagttgtgtttcctaatgttaaagaaaaccactgtgtacaatccatgcaattaacaaatggtgatttgcagatcctggtgggggtctgaatcaaattcctggagaatgtacaatttcaggggatataaggtccaactattgctatatggttcttgaatgcactttaattgtactcaaaagaaaaatggtccaagcttttgttttattatgttcatacattgttataggcatggggacatgcggttggtgaggctttgttcctcccaggggccctaccataaatttgcttggtcatttaggcggtgttcttttctactaaagatgaagttagggcacataaaataagaaagccaatagtgcatgattaattgagttttaattattaaaaacttgaaaaatggatttacatgatattttaaaacaatttcatatagaaagcttaagcacaaaatgcaccgtttagctttttaaaaagcgtgctaacagaaccgaggtaaaatctatgtcttaatcagaaaagaacggggccttagtgttacaatgcagcagagtatcactgcacaaatttttatatgtttgcaggactaggggaaacaaaataatgggatcaccagtatttcacaagtcacaacattcaataaagactgatgcttctgttgtttcttccatatcattgaaaaatagttttttaaattatactgaccatatttttgtacatattacaggttgactcctttctacaggtaaagcccatttttcatgcatggactgttctctctcataattttgtctccacttctgccgaatgttgttttaatttgacagttgcatgttgccattcatacagcacgacatctgtagtgaagaaattacaagagtatgtacatgatataaatgagaacattgaaaagcttcctactcgtggtccggtatctaaatatgttcttcctgatgaaaacctccgaggaaggtgaagcatatatgactttattctcttatggcagtaacagtaaccatcataatttacagattgattatcaattcgccattacttaccattgatcttgctaggcttgagatcactattgatgaagatattatgaatggggtggcctgtaatctcgagtcgcgaggctttcaagcattatgcaaagcaactgaggaaattgtcggccacgtggaaccatattccattactgggagtctgcccctgattagggaattacaggtttgagaggaaactggtgcaagtgttatcttgggaacaatcgccatttaactaaaacaaattcctcttcaaactttgcaggatgaagggtttgatgttcagactgctgggtatggtaagtaccttaccaaaaaactgtttcctgatttctttaggtcatgtcatcaatgaacaattaatggaaaagtctgttaacagtattcacatggttgagagtagtatagattaaattatgtataccgttcattttttgttgagttccacttggcatcctattatattgatatactatcgcggtaaacaagtggaaatgtagacagtgtgctgtaaatgtttatctgatgcttcttctgttcctgtaggcttactcaagacataccacgcaaagaacgagtactgtctattttcagatatggcccaaggctttcaagtatttctgagcatcatttcacagttggaagcagatgtttgagtcttgttttagggaggaaaaaaatgagcgttcactggtacttattcctgttacttgttgctctaataaaggcactcacagtgcaagctacccaaaatgaggaacctcaggctaaggccacacctcctctcccacggtgcaaagatgctttagggtgttcttagtttttcatgtaaacccttgtcatcttctattctagtcctcacatgttttcaaacaacataacatacaaaatttaccactaaacaccctaaaatgtacaaactagtataaaatttctcccccgccctcaatctctccgttccccaatccaccacaacagcgccaacggaagccggcggctccccgacctcttcccagccagtggcttggagggcgacggcggcgtcacgagaactcgctggggccccttctctccctgctggcaacgagggtgacgggggcgccgtgagagctcatcggtccctccacttccggtcggcgatgagggcgcagaggggggcggcggcgcgagagatcactagcccctctactttcggccgacaggccgatgacgagggcgcggagggcggctgcggcgcgagagctcaccggcccctccacttctggccgtcgacgagggcgcggagggcgacggcagcgcgagagctcacagggcccctctactcctagccagggtttgcaaaaccgtcagtaaccgcgcggttaatggtaaaagaaaaaccacgataacctccttaaattcaaataaatttaaaaattaatttgaaattttgataaattttacacggtttcgtatggtttgccatggttaccgcgcggtaactgtgtttaccatcggggcgtggtaacctcggcggagggggggggggggcgacgatagatccacaatgccgtggaggctggggacaagacgacagtgtcctcggtctcgtctccacggcgcgggagcggagcacggggacgaactcagcgaagcagagcggagcaagggggcggcgacggggtcggtgacgcagagcgggagacggtgacgaggtcggcggcataggagcgggagatggcgacgaggtcggcggcgcggatcgagaggcgattctcccttgaggtggagccgacgagctcaccggttgccgctgaatcaagtttccctggcgacgaatcgagtaagctcgccagagtgggtctacctcctcgccctagtcctctcctcgttcattcctctccgcccattcctccctagccatcgccatcgccgcgacccaacctgtccccgccgctttttcccgtcctttggcttctcctcttcctcgtcagcacttggcacccggcgagctccaagcctgctcagatcttggcatggcagcgtgggttggcggggacgaatggggaacatttgggagtagcaacagagaggggaccgctcgcactttctttttcaggcatgaggaacccggaccctagctaggaggcgcaaaccttgcaagggcacgagacccacctccttttctcctccacgtcaacaaggtaacgctccacgtaggagcattgtgaaaggcttaatagttctctgctcttggactcagtccattgtactaggaaatcgagctcatgttagagcataagcaatgggtggcttagggtcgtgcccttgctcatggccgtccgacccagttacctttcgcgcctgagccgtctcctctgctaggcacgcgactactagcggggggacacgcccctcggtcacttttcgttgagacggcgtgggggcacgtgttgggtgcgcggtggcctggcgtgtgtccagtggacaccgctcccacccctatattttaccgttccacccctcgccctcgtcgttggaagtaggcaagaggcacacggcagtgaggaggagctagaggaggcgaggtggtggaggagccggcgaatctgcgatgaccccgcggtggcgacggccccacgacggcgacgggctcaccagatccagggccggcgacgaccccgcgatgccaacgggcggagggagagcggtggcggcgcggcactcaagatccaacctccgcgtgccgctcgccgtggtggaggagctgttggccaccctgcgcaccatcggcggccccacgaagatccgcgacagcgacgacctcacggcagccgacgacgggagagagaggccgatgggagagagaggccaccccgcgctcccctcgcggtcgtccaccccgcgcgctgctcgcctttcgccaccgtgcaccgttcgccatctatggaggagacgagaagaggagaggaagagacaaggacggcagcgtcggtgggctgatgagccctttagctgggctatagaagggtactttcataatttttcactttgtgggctggagtatctttatcaagtggtctcagattttgaagaacccattggaggtatccttcagtgagagatgagttccctagaaaggatcctcagttagtgaagacactctaagggtggctttggatgtagatgcccttgtaccacgtagaagctcttgtcaatatcgaacaattccattgtgtgtgacaatcaaggatggtgcttttccgctgggccattttcgtgggttgttctgacaatggcccgaacttatgaagtctgacaggcagcatttgttcagtttctcgtttcatgggctgcatacctgatggtcatcctcaatagccaggttgcaatggaaatccatcatcttggtgcacgaaatgggaatatgggatatcactacatcctgggcctagggttaccacatttagggtccatttgattgttagcaaaaacataggaaattagaagattttgatttgtatgaaaaacatagaattttagaagattttaatcgtataagaaaaaaatccaatgaagtcttttgaagcaaaggattaaatcatatcttttccttggagattcgtacggaatgaacaatcctatacgtattttgaagaaaagttagcaagaattctaatatctttttcatccgattcctgcgtttatctcacgtcctaaccaaacaaccatcttgtgtgtttgcaattatctattttgcatttgttttccttgtcaaaaaccttttttttctattttttttgttttttttaatttttgttttctattcgtttcaaatgaacctttacactttataagctcagtaagtcattgacttgtccctagactgtcatatgttcctaagtaacctggatcacaggacgagctaatgttcctgtcccgggaacgaagcatctgtttgttcctaagtaacctggatcaccagatgagctaacgttcatgtcctgtgaattttgttccctgatcgagggtcgtgattgatgtatgggatgagcagggtgttgcacctagcacaaggccaatcgtcatagtaaaaaaactagaatcggtgggtgacccgaccgacctctcagttcactagtcttggcttgggcggtcgtagttcacgtatacatttatgttattattcctttctattcacaaggtgaggaatagtatgatggttagggaatgacgtgttggaaatatagtcatatatcggcatattttaatccaaaatattaagacaataataatgcatgaacaatgtgggatgatctagtgataaaatctaacataacaggagcatgcttaagatagaataagcatcatcatcatacaaagaacgcaatagaattgcgactaacaaagatatcaaaaattgaaataacagtaaacgcagaaggttatacctgtgaatgtccctccgctggattgtgaggctgaaggtgtggaagaaccccacggcctcggcccggcgcgccgcgcgtgtggctttccgatccccacctcaaccggtcaatagggagcctccaataactccctatttaagttgagatactcctcttttaattcccaaggtggtattattatccttaacatttattatgggcctttgagatttaatagaataaatcgggcctagcccatttattctaacatgacattgtcaactcgctagccaatcagtagcgattttgctatatatttgtcgacaaattttctcccaaaaatttgacagatgtaattacagtacaatcgtagtgtaattacgctgtaacttgcatgtaattacactgtaactatagtgtaacttgtatgtaactttcaaaaatctctctgtaatatgttatttcggtaaaatggaggttgtgggaacaaatccttatacatatgtgtgtgccgtgattttttttcttcctcagcaaaacaaatcttgtaatagatataatgatttaaaattacatgaaacttacgtacaagttacactgtagttacatgcaagttacagtgtaattacatataagttacagtgtaattacactacgattgtattacaattacatctgtcaaatttttaggagaaaatttatcgccaaatgtataggtggtcccatcagtagtggtttaatgtctggttcacctgaaaaccaactggttctctaaatgcatgtctagcgagttgatttttaggtgaaccagatattaaaccgttactgtttggcagcgagttgacaacgtcattccctaaccatcatgttattgctcaccttgcgagttgactagagcatttgtgcaattattgttcattcatccataatacaaccaagcaggagtggggtttattatcttccgatgacccaacctaaaatatttttgtatttgatttagtgatcatagccccaaaaccccttttgccaaacaccaggtccctcacaaatctatctgtcgactacagaacatcgacaacgaccatcacattgcctcagccagcagacatgttactagcaggataaaggaagaggtggtgaagagaagaggaagggatggagatggaggttctatgttgcctggtcgtgcaagaggcactgactgatagcaaccgagcaggagaacaaaagattgggagctgcttggggaaataagtgaagggggattatgttaacgggccagacaagtccatctgccctagctaacaacacaacgagagaaagggaggagcttggcactagatttgctcgcaccacctcttcttgtgcgagcgtcactcgagttctctggtctcgacgctatgttataccttgccttcttctccaatgtcctctcgttccgatccatcgtccccaagaatgtatatggtcatcgagccacgtccctaactagcatatcctaaataagtagtatacccctgttgtcccatgctttcgaagatgtcgtcccatatttctcgttcctgttcctcaaagcatcaaaccccgcgggagcattagcgactagggttcattccagcaaggataccaaagcaagcgcgcagacgcagaccagaccatttgcgcgcctcgcggtgcagcagcatgcagtgctacctcatctactccctccggctaaaaaaagacaaactctggatttccgtgtctcgtttgactgtccgtcttatatgaaatttttttataattagtattttcattgttgtcagatgataaaacatgattaatactctatgcgtgacttgtctttttaatctttttcatattttttttaaataagataaatggttaaacgttggacataaaaaaccgagggtttactttttttttttgggtacgaagagagtagctgttacgaccacctagcaggctagcagtaacatgtgttgatggtgcgtgcggaatgaacagccgcatgtggcgaaccacgataggacatgacatttcgtttcacgtaccgtacgccgtcggtacgtgcaggtctatcgaccgcgaccgaaaacagccaccagatcgatcgtggtcgtggatcagctcaaccacgtaccagattctctgcccgaccgatcgatcgattggcactacgtgctgttagtactagcctagctagctcgatagctgcaggggcagcgtcacatatgcacgagatgagagacgcgcaagcgtacactccgtgcactgcccagtttccttcttttgatgcaccagggggtccagggccggatcgagctgcacacgcaccaattaacacgtacaggatgccacagcttttgtaccaaattacaatgtagtagcaaggctcaccagccgcggaatgggttaagctcccgtgcggtccccgacctgggcgcgtcgtcggctagagtagcgctgggtacgcgattgcatgggagtactcaactggtcgggtaattggggcatggatgcatgagctgtttcggttggttctgcggttggctgtgacctgtcacgttttgttgctttgcttggacacatccacagcccctgccacgcattaccccacgactatgcgactgatagaccactatagtgtttttactgtttttacagggcatgcagagacctcgtacgtccttggggttacttacgcatattacttttcgtgatactagtattcaaaaattgagaatggatacatctcaagaaaatgagaatgcatcaagcaatggcggagaccccaaatgaaaggggccaactacagagatgaaatcgatcgcttctagagaaaaaaaaaggaaaatgaatcaattacatcagataatcgttcttaagcatgaatgataatgtgtgcctgagagcacaaaacctctgtttccatgtttgattaatacatgatatataatatatgaccgtcatggacatgtgatttttttaatggaacatttaactatttaccatttttaagacgtggcgtgaataatttatcatttatagtttatgacaagtgggtccaggtaaactgttaaacatcacatctaacattggtaaatagttaaatatctttttaatgggtacgcaatgtttaaaattattttgagcaatgagaaaatattccatgatataacaacggaagaatatataaaagaaaatattttcatatcgctaaaagtatatcaaagcctcttatttatattcgtagtactaggatgagactcatcttataataagttgttaaattttatgccggagggagtgaatagtgataaatgtttcaaaaaaaatagtaatatagtcatataggacgcatcattaattgatgctatgcatgtcctaaaatgtcatctgtctaagatccaggcagtactccctccgtcccattttaaacgtagccatgacttttcgtgtccaaatttgatcatccatcattcgaactttttatgattagtaattttagtgttattagatgataaagtacttttatgcataacttatgttttttaatttttttttaaaaaaaattcaaacaagacgaacgatcaaaattagtttgcttggggtcagaccgccaagaatacatttccttatagttagctgccaagaaatctgaatatccctgactctttagacttagcggtatttacatggcggtcggccaacggaataattaaccttaatggttttcaggctatttttgaccgccaaggacattatattttcttgtagtgcacacgaaaacttatgtctgcgtttaaaatacgacggatggagtacttaactagctagcccctcctgcaaagtgcgaacttaatttatcttaacctgtgtatcaaggaggttccacagaatgacatgtaatcgatgcatgcatggaattaatggatattggacccctctatgtcttaaatatatatgaaaatgacgtggagcattgtagtccctaataatatgccctaaatagtactgtgactatgtaatgccgctaacgtactcagggacactgatactcttacactaatttgtctcaagtactgaaacccaacaccaacagtgcatgctaagcgcctaattaagcatctagccccatgcttggcgactggcagagcgttgaggagtgacttcaccagcttttgctgaccatccagagctagccatgacgatcacgaattcgctgatatatcgatctgccagccagtgtggatagatagatctgcatatatactagtcacgcatgctccttggcagggcgccccccagcgtagggcagtgtacagtggctagcgtctgcctacgtacggctgctgctgcgtgcaatcgagcaatgcatcattgcgtcgatctgcacgatgcatgcatgtctccgctcttgtgccagccagcgaatgtaatggacacgtactatacacacaccattgattgatctcgagcttgtatagtacgtcgtgatcggccgatcgaacgaacgcgtgcgaatcgcatgcgcgcgtgatggccaatggatcatcgatcgtatgcatgcatgcaatgcattcgcgtgactgttccatccaacgggctaatcctttctttcttctgttcctactgatgatatgccacttgccacgccaatcaacgcatttcactgtcccagaacaagggttatagtactgttagcgtacgcgttagggccccaagtgcggtgcatacattattaatgaagaccatctgacatgaaggtactcacgctattagatctacagacccacctctgctcggtcatactgacttgtactgagctctccatgcttcaaacagttctgtgtatggtatatagtatgtaagatctgtctaggaggttacaacgacttacaagttgaaaccccccatactcgtatgcgtgctttaatccaatgcgatgctggtgctttcgtacgcaggagagcaaggaccaccacgtgaccggaaccctctgtttcggagcacggacacgagcgattgtaccgagatgtggcgtacgtatacgttcctatcaacatcaccgaaacggacgtagacgaccaaaaaccagaaggcggaagggtgggtgtggatgggccgtcggctagctcgtcgcatgcgcaccgcgtacgcctacgttatcgagtcagcttccacgcacgtacggttccaccacgaacgaggacagcgcggttggtatacgtcggtctaaccatccaccggtccactactagctcgccatgcatgcagctcatctgtctcggcctagaaaccgggccggggcgcgcgccggtgaacctactacttgctggctgccgcagcgcccccgcccgcgcgcgcgcatatgcgtccgttcgcgtggcaccaaagcgcattgattccatcccttgtctcgcacaggccggagggggggccatccgcgccatgcgatgcatgcatgggcgcgcgcgtctgcctccccgcccgcccgctgcgacgtccctccaaaaaaaacggccggccgggcggcacggtgcgcaactgcacatgcccacgctgcatgcgcctgcgccgagagcgcgcagcccggccggcggcgcgtgtcagcgagggagggaggggtgatggtgggtgagcccggcctgcctgcctgcctgcatgcctcgcgcgcgcaagcgcaaaccgcacacacggcaggcaggcaacagagcgccttgttgttggccgccgggaacgagaagcccgtgaacgaccgagcgaggccgcgccctcctgcgcgcgcacagtgacgcccgccgtgccggccgggaggatctgtcgttgcgctgcccgcgcgccggcccgcgcgtttcggacgcttgtgcttgtccacacgttcgtcgctcacgaaaaacgtaccgatgcctagtccaagggctgatgttacttactactactactactacaactgatctcgaagtagccggttctggatacatgtagccgtggaccgtttgcaacgtcagatcgagtgcgtacagcgtagcgcgctatatacagtgtgtacagagtaaccgtgtatcgatccaaggacatgggtagcaggaggagcaatacagagaactgactgtaagatagagtttctttctcttcgcttctatacgcagtacaagtattagagcaagtttaatagtacatccaactacaagctccaatttatttatagctaatttaatagtcgatttgtacaatagttgcttactatactattaatacctggtcccacatgttatatacacatcacgtcttgtaatccgtgctgtagctggctacagatttgtagcccgctgatcttctctcctattttatcactttaaaatatgtttatagctggcttatagcctatacctgctcttatactgtactactattgtgttctaagattggaccatgtggtccaatttgtcaggggaatccatgtgacgagcaacgatctcgaaaaccgcgtcacagagcagtgatgggtacaaatctcgggcagcatagacacgaacaaacttgcgagtgtaggtgtgccatgcactcatgcaggcagccgtaaactttttgggacaggtcagtctcaccaaactttctacgagtactttgccagtttgcctggttgaaacgtcgggattttgtcaatttaaatgcatcgattcgtgtgaaatttaggggttgtttgttccctcccaaacattgccaaaccttcttgccaaacctagccaaatatatggcttataaattgatggacacaccttagacatggtttgactagaaaatggttgtatgacacgtgggcctttaaattagaaaactgtggcatgccacaagtttggaagtgaaacaaacatatgtcttaaaaagtgtggcaaagtttgttaaagtgagggagtgaaccaaactccctccgtctcacttacgagcaactatgagtttccgtggctaattttaatcgtttgttttattttaaaaattataattagtattttttattgttatgacatgatagaacatgaatattactttatatttgacttatgtttttaaattttttaaaaaactttttaaataagacggacgatcaaagttgagcacggaaaattatggctgcacttaaaataggatgaagggagtacaactatgtgtttaatatagtactactagtattccctctatcccataaaaattaatctagtactccctctatactcgtaaaggaagtcgtttaggataatgtttaagtcaaatcttatgaatataaattatgaatatctcttaagttgttgagtttaaaaatgtaaaaattatatgaatagatttgtcttgaaaaatactttcataaaagtatacatataccaattttcaataaataattttatagaaacaagaagtcaaaattgtgttttggagaccgtgccgctgtccaaaacgacctcctttacgagtacggagggagtactggatgtgacacattaatttggacatacctctatttagatccgttgtactagaatatgtcacacccaattctaagttcgttttttatgagacgaagggagtacttagagtgggtttagaattgtttttttcttatttttgtaagaaatgtactcgtaattgtgatgttagttttctaaaaaaactaatgggacctggttttcatatgatcctggtaaaactttataaaaagaactgctcatctcgtttggagtacaaaatcctaaaaatgcaagaaaataaaagcacaagattggaatgtcacggcatttcaaatcccatggaaaaaaatttgtaagaattattcaaagcatgtattccgatggctcatagaaaaaagagtaaattacacgcgaagatgtcatattatcatctagactcgtaaacttgaaaaattgcacattgagatccactatcttgttttaatgatccataagtggtccaaagtgtgtttgactatagccgaacgcctatgtggcgctccacatcttaacgtggtggtaattttgtaattaccccctattgctacaatagtcatcgaaatcccccaaaatattctaaatccctttgcattcccccccccccgccgcgtgcttccatgggagaggcctaagtatcacgaggatgatgtcggcagtcatcggcggtacgagatgattgaggtgttaatttgggttgtgcgacaaacgatgctcgataggcgacggacaacgcaccttcctcgtcgacacgacggttgcgatggacctcaactttaagggagaagattaatcggtgtccctaccgtcgttacctcatcgtttcctgccgcctccgaacagcatcctcatcattgcaaccctagtcgtcaggggaatgcaaagagacgaagggattcggggggatttcgatgactacattagcagtagggggtaagtacaaaattatagcctcgtcgagatgcggaggaggctggatgcaaaatgctgcctacgtggagcgccatgtaggcagccaactctggtcaaacgcgctatggaccggctatgatttattaaaacaagattatggatcttaatgtgtaatttttcaagtttatagatctaagtgatatctttgtttaagtttaagaaccggtcatgtattttactctagaaaaaatatagaaattttgtgatataggttagttaccccatctgtctctaaaatacttagttcctagaatccaaatgcacattttgtaacgagagtaaattactctaatgcctctaattaatagaaaattagtttggtgagttggtagataacggggtattgaaggataaattttcttgattcgtgaaccaatattaagtaataaggtactacgtatgagttagatttattttgaacaaagtttaagctctataaatttattttttttagacgaaaggagtagattagagtgagggtaaagagagaaaaggatattgcatcgatatatcaaaggaaatgaaagccatgaggttggagttcacgtttaaaatctaaagatttgaatcacacttggtattccacataaatttgacaaaccctaaatcctatgatccaaatgatttcactaagaaatttcctatgaattcatatccattatttttcctttaaaaatactataacccaaaggtctcggtcctacggaaattagggagacatcgtgtttgggataggctgatttttcctttactactcaaaaatcagaaactacctaaaattgacagaatctgacctcgggtatccttgtactccctgtcaaaaaaatttccaattctactcccttcgtactaaaatataacaacttcgtattcaaaatttgttccagaatatatataacaatttcttcacctacattctcttcttaacctatcacaatcttctatcattcaaattctataccaactttctcttctcaatcaatcacaactttcttccatttaattctaccatcttttttaatacctgtgtctgagcctaaaactctttatattttaagacggaggtagtatatatgaaaataactcctctctcggtaaaaaaagaactataaatatgaatctacatataggacagcgggagtatatgatggacggaaagaacggcggactgaagctacaagtgcagaaccacaaaaaggatggttaagcacttaagcttatctaatccttcttgctttggaagaactgcctgcttgcgttcagtatataaaaaatttaactctcctgtattaaaaaaaaaaagaacaggcagttctcctgacgatcttcactaaaaaaaagcaataaaagctgaaaagctgggcagattcttgcagaagattatagtactcgtatgatcttgtctgttggagtagtcgctacttgtactggcatgtgcacgcttccatgtttctactcctacaagtttaatactagtactaatatatataccatgtatctactctacgagttcagtactagtatatgtacaactcatcgtgacagtgtgagtagtaagcagtgcgaataatacttgatacacggtgaccgaatgtagtaaagtaaagctagcctagcatgtaattatttttcggaattgctaaaagactgtcccaggttttttttgaggaaaaaaacttttaaatgtaactatagcagtacaaacacgcccaccattattcttaataaacgcacactatacatctaacgagaccatatatgaattgaagtgatttgttctttaaaatttagaccagtacagaccggttttgcaataattacgtacactacaaattttgaaatgaatatgcttatatgcctcaattatttgtctctgtctggttcctgcgacccagtgctcattgtgtctccatagcttggacaaggacaacaatgggtactgtggcaaaagtagcatgagttaattaataggcaaaaagttaatcgcacgagttaagctaagccctgaattttgggcgatgcatgattgattgctctagggcttatggagctatggtcattgctcgcatcactgaagtactgcttcatgttactcatgtggcctccttgtctcctcgtcattccctgtactgttaatccatgtgacattggtgtatatctgttgttcctaccctgattctcgtccttcatctagctggaaatgttataccttaagaataacaaatcacaaagttggattgttaactttcggagactgtctgctagctgcctagctggaccagttcctcaataatttacatattcgggaagataaaaattccatgtgccaacatttctgtcttgttttcaaccttaagatgaacatttcaggtcttgaaacccatctagaaattgggaataaatttttgacagaactttacaaattcaaacaagaactttaggggcaatttcctttgcttcgttgctcacgttgaatatcttttgtcccttgttgcctaggaaggagcccattctacgatattaaacttctgcaaatgtctaaaaaataaaggaatcataaacttcaagctttaatatagtttaatctgaataattacatcaaatgtttcgttttccaacattggcctcttctctttgccagcgtgtatgccattctctgtagtgtgaattgatcaatcttcctcaaattcactacttcttccttgttctctgcagcttcaggttcttaggtgtagttttattttgcttgtttaggacttccttaaagaattgaatgggtaggaaacgctcattctcaaggttaaggctgtgttcgtttgtgtgagatagggtgagaaaacacctcgttttccgtgcgcacgcttcccaaattactaaacggtgtgttttttgtaaaaattttctataggaaagttgctttaaaaaatcatattaatccatttttgaaatttaaaatagtttatactcaattaatcatgcgctaatggctcacctcgttttgcgtatcttcccaatcttttcaatcccctatctctcaaattgtaacatcctgaaaattctcaataataaaaatcactaaaattttgaactttttaaaacttttgcatcatgctggttgttataactgctattgctttccaaaccgtaaatgattacaaagaaagtaaagaaaagaactacatttaagcaatagatataatttaagagagtatattatttatgtttaaccctacaagtatttatgcacaaaagttccaaattgcattcgggggttgaaatttaatagattaaacccctccataaaataaactaacatataaataaattgagctaatgtgttactgcgttaataacggtctcattaggaaattatagaatctttaataaatcttaaatatcggacaatattaaattttgggaaaattcacatttggacacttaatatggtcacccaaatgcttaggagtaatacaaatttaatttataacttttcccaatttataaatcaaccaaagccctaaaagtaggaaaataggaatacttagaaaaatatataataaaaataaaaataagttcaatattaaatttgaatacaaatttcaatggaataacttaggattggtgtatttttacattgtgacaaaattagtggcaacaatatatttttcctaattgcaaagtaccctctaaattcaaaaatagttggctagcactgttcattagcccctaggtgttcgatttggtttctagccatcctagctctctttctccccactgttgcgccgccctagccggcctcgagccccgcccgcaccggcgccgtcgccgtcgcctcgctctgccaccgctgccgcgccgccgcatcatgtcgcgtcgccgtcgccgcgccgtctccaacccgccgtcggctgcgccgcgccgctcgtgtcaccgtcgccgtcacccgcgtcgcgccgagcctcgcaccagtcgcgtcgccgtcgccgtcgcatcagtgcctcgcgccccgtgcgccgctgccgcgccatcgcgtcaccgcgtgtcaccgtcgccgccttgagccccgcgctgccgtgcgccatcacgtcgctctcgagccccgtgtgccatcatgtcgtcctcgagccccgtgcgccgtccgtcgcgtcgactattaagccacccttcccacaccctataaataccccctcccatctcccttcctccccacacaccatgttggctgccatcacaaggccccaagagcccccacgagctcgtccacccctctctgcctcttcttctcccttgtatgcattttctcaaacaccttgtgtgcatgccggcagcttcttctccgctccaccaacgccgccgagcttcgtcgttcctccatctctcggtaagtcctcgctcctatgtcctctctagttccgtagaaactagagccccctttaatttcgccaattagcaaccgtagccatgccggtccggccaccgttttgccgccggtgagctcgctgtggacaggccatcccggagcccctcctctccatctagccagcaaaatggaaccctcacacgccatagatgctgacgccctcaccaattcggtcggaaaccctccttatcgccttagcacctagctacccgtgcccggccatggcgtccttgcagcgccgctcgcccccgcgccgtcctgcgccatgaccgccggcaggtgtgcgccgtgaccgccggcaggtggacgccagagccttgccgctcccttccctggtcgctgtcgggtcaccctcgcccgggcctagccgcgccgtgctctgctcggccgatggctggaggtagaagacgataaagaaagaacgagagagagagagcagtcgggcgcacttgtcaatggttcataggatttgctttagaaaaataatccagtaggaaagcaaatacaatcctaaaccccacatgtcagtcacttggagttttggataaagtttaggaataaaaataatggattaggaacagtacctttttacaatttctcagatttattcaaatttgaatctttaaactagcgtaactctctcattttaactcggatttgagtgaaacttgaacctaaatttatctaaattcataagctttccaatggtatataattcactatttgataaaatacatttataattattaaataattaatactaagataatgcataatagtcaacttaaaaatgtgctaacaaataaaattagtactttacagtaaggtagatgtaagaatatttgtctttaacatgctttgtcaatgtaacaaccacacaaactaattttaaatgatgtctcaaattaatgtataggaagatactagtactattaaatggttgtataattaaaccccatgacttatagattatttaaataataaagttagccttataattaggtaaatcaaacatgaatacagatagatgagtctttaatttatttatgaggaataggtacagaattgttatgatagaaccacccaaataaggttgagtcggttagcatccaataattactcaaagagtaaaatcacttgccaacccacttaaatcacatatattgtacaatccatttaaaatcatacataataacaataacctacctttagcatatattaaaccaaggagtatatgacaaacatgtatggtggataaatactagttataaatcttgacctcatataattatagttcaactgtaagttaggattgttcattaagggataatctgtaactataatatgattaacctaaacaactctaacatacaaagcatggataattattaaccttttctaatttatcgtgacaagtaaaatattttcataattaaagcaaagcctccatcaataaaataataatacaaatggttccctgcgattaattgcttgatcccaaatccatctaacaacagaacctctggtatgtaaccgtgctatttagatagatgcatatatagccataatccttccatagccatttgatagaataaatcgccgattagccaaatatatatgtatcccataaatgctatgttggttaactcctaaatcgaccacgatgacaatagaaagattaagaagccttagccctagcatgattgaaatccattagcaaacacgaatagtatgagcaaccctaggatcgaccccaacaattatcttttgcttgtgcatatttgcttgttgtttgaatattggtttttctcgcgtattatagaccttgtgtatcggttagtcgtgaggcaacgtctacaacttccaggaggtgaaggttgatcaagattatatcaataataagaattatcctgagcaggcaagtcatcactattccttgaacatgttgatcccaattgcgaaaattattttgtttacaaataaaattgcatgcaatgatgaacatcctacttgtgattatgccatgccttgattattgtttacccttattcccttgtaaccatgattacgtatgagtccctagtcaactatgacaaatgcttagaaatgctactctagaatcatgcattctcatatttatcaaatgctatatgcttgggcaattacctttgggaaggtattgagatgcggcatgtggagacataagcgccacattgccatgatgttgatgacatgatttgtgaaaggagaaataaaattaaacaactgttttcgactggggcggacggaggatttgggtggtatccggaaaaggctagtatcgtccccggtcaattaaggaccgagccatgaagttaagcatgaaactacccccgtacaaccgcacttctcgtatgggtatagacctagcggagtagatagctgagtggaatccatgcatagtggtttcttgatgtgtgaggcaggggctctacggtggggcagccattggtagaaccgcgaggtgggtgtctacagtggtgtcgccatcggtaggactgccatgtgagaatttaaacataattataacttaatgcatgtg

SEQ ID NO: 79630 - DNA, 72514 bp, Oryza sativa
tgctcggtccgctcaaggtttgtgggatcccatcccttatccactggataacttcgattggaccggttacatgcccagtggtccacctctctcccgattggtatactaacatttctttacttgttcttttttacttgcaataattcacttaataacacttcttttttcttaaaatgctaatttaggctctacgttctatcaaacaagttgcgtggagaattaaatgtgctatgagtagaggatggagaaagatgggcaagattcttatctgtacatgttacaataacgtccaggatatcaatatggaggctaagttaagcagcatgctaagcgagtcaggtctacctttatgtgtagatgacattcgatctgatgatagtgcatcaccattttctacccctaaaccaattaaacctgaggagataaacatggatgtgatggatgactggttgtactcaaacaggggatttacaagataccttagtttaggtacagattctgatgtgctggaatctcaggataaacattgagcatagatcagggcaaagagctttttgttactcctgctgttagacaatgttattatttggtttatcaaagcttgtgattttctttgtttatctgtaagttctataaattagaatctatttttttacatacatatggtttaacctgtatcttgtatttcctgttcaacgtatcaaaaaaaaaaaacctcctgccatttccattcaaatcacattgagcgaaataagacaagcagtgttgtccttgtcaagatacaaaaataacaactaattgtcaatagggaactttaaaaatatcaagcttgttacatgagaatgaagtccttactcacagaaaactaaatccaaattttataatataagctagaagtagatttgctagataaatttctagggcgatgcagcggagtccatcctatggattgtatcacccttgatgttggtgagatggcacacctgcagtgttaattctatattagtaggaagcatagatatatcatacaataattaaattatgacagaccggcttgatttttatcttgggttgaacgacgtgcttgatgtcctaagcgtcgaccttgcatttcatccatatacattggaattcggttatgtcttcgtcgacccaactgtatcaacctagcatcaggctcaataattggaccattataagttggccactccgattgatttccatatgggtgaaactgaccagcccaagtgtttgcgagtgttgtagaagagtagtaaggatggataaactgattctcattaaggtttctatcttttcaaacagcaagcacatgagcacaaggaatactagtaaggttgggcttttggcactcacatgtcggaatagcattgttgcgcataactagcttatacttgaaatcccttcgaacatacacaacacgatctccttgatgcaatgcaactcgttcacggtcaaccttcacctcatattctcctctttcatcaccatatgatataacatgcatggatccggccttggcccctcgtttcactaataacttctcaacccgtcgagaccacattttccctgagtttgcaagatcaagagaagatcttcttctatcaataaaccattctaagcacttgttaaatgtttcctccactattgccatgactggtaatctccttgagtacttgaacacattatttagagactcggagccattacttgtcattatcccccatcgatgtccaccatccatgcactggaaaacctttttagatttttccggctcattcttatcttcttgccgatattttcccaccttaccaagataagcaattgcatctggacaagtttttgaaatagcttccataccttcattgaatctacgtggtttcttcttcttgacaacccaattaaaagtttttaccacatcatcatctttacattgcttgtaaagattctcagcaatatgttgtgaacaaaatcgatgcacacactcaccagcactttcattccatccaatatgtggctgcttgaacacccatttgatagctttgtggcgatcagaaataacacacacaaatttaccaaaaccaataacctctttccgcaaccatctcatgaaccatccccaattgtcactgtcttccttctccactattgcaaatgcaagaggtaataatttgttttcagcatcatatccacatgctatcaacaacctacctcggtaccttccagacaaaaaagaagcatctatattaatgacaggtcgaagataaggtactgcttcaatacaaggtccaaaagcccaagccacgcacttgaatgctcgatgcccttcacgagtcatcggttgtgacaaaatttgatatcttgttccaggattagttgctttaatagcctccaataatggagtgagcaatgcatatgatccttcccaacttccaaaaagttgagcaattgctaactcccggccacgccataacttgttgtagtgtggctttacatttttataccgttgccgaactaattgccgtatgttcattatgctcaactccaagttctcttttaagtcatcacgtataacatctgcaataactgcagatgtcaattgtgcacgatcaagtcgatcagcgggagctcgacatgtgtgaggataggggcaagtttgtatcttccaacttgaaccaatttttgttggtttcccatatagcttccacaagcaagtattgtctatgcacttcatacttagtcttgacttgttacttgtggtaacctttacttcttgattggtactaatgtgaaattcattaatagcaaactgcaaatgctccttggaatcaaaagttcggcctttagctaatggactgttaaaatgtttcctcgaaccaaagaatctctcatcggccgttgtattctgtagcacagatatatcatggaaggcacttacagggtgcttgtcagacctgcccacgagtggcaacgatttgatcaatttgaccacaggctgaccataggtgttatcattcacatcctcttcggcttcgccatcgctctcatcttcctcaatcatatcaccctcacgttctgtctcttcgtccacatagccatcatcttgagaattttcttgcgcttcatttatgatattatcagaagacaagcccacaattggtgcagaattactcacatcatgaattttaggagatataccatgcttaggcgactgatgtgatgctgacacaatattctcagcaactgtagccatagttggttctaggttttctcttattatttcactaacaatgtggttttggctgaatccactatttgttggagtgaactcaacatataattccaccatacgccaactgtttagtgctaatgtcatgtcaaaaatcatttgccatgatctggtcttatataatgggatcaactggaaaaaatgtggacttggtgctcctacatcatatcggccttgtataacaagtgaatattcagtttcagaatattttagccctccataaatctcattctttacatcttcgaaagttgtagcttcggaagcaggaaaagtaatcttgggtggaatgctatactctgcaccagtcgctccatatacaatttcacctccagtgtatacaagaacaattatcatggtctgatgacctaatagtaataaagaaaagaaaaatatatatcaatttccatattcgatttattcatgatcagaatatttagtatatacatggcacagagcactactaacgtggagcacatagctaatgatgatataatcatttcatgcagtaatttactcatactttcgattagcagtgccgcaacctttccatgatagaagaataaaatgatacaacagatctgctagttttttttacggggaaaaaactgatatattactcagctacagcctcattcacaaaatgtgagatgagattacaagaaccatctggccagaactcggagagatatgctacttgactagtactaatgtctaatcaattccaaacaacgaaaagtaaacataccttgcaaataatcttactcgtgatctctgcttaaactctaatctcatctgatataagactagggcatgacttctgcagtaagggaaggttagggatagaaagaaagacactaaccaatgcgtagatctgtatttcttttctatgttgcgggcgtgcagttgctcggcggaggccgctgttaagttttggcgtccaagttctgtccaggaacgcagtaaaaaccttgcgtccaaattagtcgctgccaaatgacagcgtccctatcaaacagatggacgcttcttgaatcagaacgtcctgcttattaatagaattagatggctgtggtgcttacataaaaaaatatatttcttattttgctcagaattaaaaaaatcggtgaaaattctgtgtgcacttttgaatggttggaactggttgctttggcagaatcacctggctacaagtcattagtgagtagtgactcgccattttatttcgatgatccctgtgcaacctgcgtcgtcttttaaatcttcagtgagtaaagttataaacatttacggtctctgattgtatgttagtaagctctttggttgcttgccacagaatatgtttttcttatctattatcgtcgtgtgtatcttttttccggaaattttgtcatctatgtaggtcggtcaagactcaagtgggcagcaaagcactacttagaaattggaattttgtgatgcttgactattacctgtatctggagtatttttttaggcttgtgatgccggtgtccaactgtgcaagcggtgctggtagcgaactagtaccaatgtcatttggactgctggactcgtggtgatctgggctaacgcccggccgctctgtacatttggagctggaataagttcattttaaatcccttatcttgtctccgagtttgaaatgtcgtccttgaaatcgtaatactggatataacgagtctctcaacttgcaaaaccggtgtacccaatatctcaaacagcgcatattaccatctcccctctcctctctcgttcccacccaattcacccaattccgcagcttcagtcgaaccgccgtcaccatcacactaccacactataccatccaagttatgtacgccaacgccttatggtcgttcgtgccgtgccccctccaagagtagtgctccgtcgtcgccttcatcgtatcccccaagttgttgatggcagccacctccatgataccgcggatgttgagcatcaacgccatcatggtgacctccctgaatggcatgacgaagaagaacctcacgtggaataggagatggacgagggaaggttggaggaagaagaactagacatgacatatggggttcactcgtaatgtcagccaaaaccggatagtacactagttttgcaagttgagggacgtgttatatctagtattgtggttggaggacgaaatttgaacgcgacgttaagatgagggacccccaatgaacttattcgtttggagcgagacaagtttgttccgggcctggaaaatcaccttccttttgtattcggccaacaattaacatacggttcgtactggccctactatccttattttagattagtactggtcatagtttcgccttttttttcttcgtcatgtgtttacgctgctagagacaggttcctcggccccgttcctttcggggaaaaacagagcagctcaggtacagggagacattaggtcccatgcatgctcgggggagcctcggaagagaagataatcaaaagtaccaaacccatgaaacgtacgttgagatcagtttacgaatgtgtcgccttcgcccctgaaacagaagaacccaaaagataacagctgccaaccagtgaagagcagccggaaccaccgcttgaatcgttcgtcctgtcctgccgctaccgatggtgatgccgctcaacgattgggcacttctccagcaacacggctcctaacccggtctagtacgtgtaagcttagccagccaagatacgcacgcacaccatacgtgttggaattaatgaatgggccttagcccactcgaagattaattctttggaaaatcacaaaagcccacctcatgggatggcatgcatgtggagtttagtaccaccttgcttattctaggagagggggacctccttaaaagggatgatgccctcctagtcgcttgaagcatgtgtggtggagagaagaggggaaacacacgcgtgcgctcgctcgcctcgcctggcagggcaggcggcgcgcgtgcacgacgtacgcgtcgaatggtccgaaaaattggctcctcacccttgcgcagatgtgttccgaaaaatctggtgcgtgcaaacggcgtggagtccggataagttatgcgcgacttatccggttcggttacgcgcagtagagatcgtgcgagcgccctgatcaagcgacccttctctatataaaccgacccgccgtcttcacgcagtatatacgcaaaatcaatctagggtttgcctcctactctgtactgcgctgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcaccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaatttggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagcgccaatgttgtgcacaaggcccagaacaagagcaaggggaaatacaaagcttagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactattttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacgaatttaagatggtttttgagtctaataaagtagtcgtgtctaaacatggatattttattggtaaaggttatgagtgcggaggcatgttccgcttttccctttctgatttctgcaataaatctgtaaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtgtggagagtttttctcgaacaagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaagctgtccgtagtgaaatggattccattatcgctaacgggacttgggaggtgacagagtgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaataaggcagataaatgtgtgtactatcgccatggtaggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactcttgacggagcgtggggctcctcaccgggagactgcgcaggcccccctttgccagttcggccgggggccctgggtgagattctaagctcctagtctgtgtgtggaaggttcgcgagaatggaaacacacaagacacgggcgatgtatacaggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggccgagacggatgcggtccgacccctcggggagacaaagagaagggcggccgtatcaccctcgggcccgacccccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtccaaaaatcgggacaagccggttcgtttttcctggagatatggtgatggcgcttcggtcggcgagcgtaattaacgcgcgcacgagatgttccatctcgactgccacggccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttccttcctttcgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccacgggggccggtgctgaaccgctacattccctgcgtcctccgcaagaagtgggatgactggaagagcgactggttctacacccccctcgccgacgaagcgcgcctccgacttccgagctagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactaggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggtgtcggaggagcgggctcctcgaggccacgatggcgtgggcgggagccgcagggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaaggtgggggggacagaaccatcccggggaaagctcatttcccctccaaggtggtcgtttaaccgaccccctcgcaggttcgtcccactcccatcgtggccgtattcattctctcaacgcgagttttcactcatccatcttgtttgtcttctggtctttcttctgtttcagcgagatcccgtcgcgtccctcccgccattccaagtccggccagcctgaggccgaggacccggcgaccatagaggcccggaggcgggaatctgaccggcgagaagccgcggatcgccttcgagaaaccgaggaggccgctcgggaggccgcccgggctcgccagaccgaggaagccgctcgggaggaggccggactccgccaggccgaggcgacgacatcctccgaggcgacccgtgaaactgacgggcaagaggccgcggatcgccttcgagaagccgaggaagctgcctaggtggccgtccgagctcgccaagctgaagaagccgctcgggaggaggccagacttcgccaggccgaggcgacgacgacttccgaggcaactcgtgacgaggccgcgggcgcatcgcttgggcccactccctcgtgcgacgctcagatcaaaccaggtccgggggacatccctgagtccggcacgtccatcggcgggccaagccgcgcggcatcctcttcgaggcggctcttccccacgccttccgttgctccactgagcgcagaaccccttctgcaggccttagccgtcgcaaacaccacagtgttggacgggttaagtgcccaggtggaggccctgcaagcagagcgggcggagctcgacgccgcatgggtgcgtgtcgatgaggggcgacgctcggtggaggccatggtggaggtgggccgcaaggcacaccgccagcacgtctcagagctcgaagtccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaaaaaactcgacgcagcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacactggcggtgcacgaagccgcctgtgccgaagaagagtccgcgctccgcctccgcgaggacgcgctcaccgagcgggagcgagctctcgaggaggccgaggccgcggcgcaacggctggcggacagcctgtccctccgcgaggctgcgcaagaggaacaagcgcgtcgcaatctggaaagtgcccgcgccgagagggccgcactgaaccagcgggccgctgaactcgaggcgcaggcaagggagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggaactcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggtgacccgggtgcatcggagtgagcccccaggcccccgccaatctttaaatagtttcttcttttcttcttccgagtccttcgggcccccttcttgtatagactaatttaatctgcaatcaaataaagaggaaattttttgtgtcaattctatttgttgtgtgtatgagacgaggatgcctgtgccgcggtccttttgtgtcttggcttgaacaagggctcgtgcccaggtcctagtcctcaaatggctcgggttggggctagtgcctggggagatccacatgtcgagactggccaggccgggagcgtggtgaccgagggttatgggttacccgattgtgggtttttgccgattcccccccggagttcaccacgccctggggcacggctcggttctgggccccgtttggcgattttagccgacccgagcccccgagggcaggattgaacacgagtgacctatttcaagtcaatatccttcaaaaggaaacaatagcacagatacagcctttaggaaatcgaaaatgcttttattgaaatacagatataagagaaataagaatagacatatgtggtagcccccggccaaccctgcacgcccgaggggggtgcggggttggcccaagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatgatagcgccgtaggctctgctggtagcgcgcggctcggagggccgcgcgccaccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatgatctgcagggcctgggccggctgatggatttgcttggcgtggaattgacacgctctgcatcgccggaccaggtcgaccgcatcattgagagctgttggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggcctgtcaggcgcgtccgtctcctctaaggggtcgggtcgcgccgacggctgggcaagcctttcttcaaaagcgcccggtggggtctgggctcgcgaggaagcgagccgtgagagttcgtcggcaaccgtgttatcccgtctgggcacgtgccgaagctcaatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagatagggagccgtcgaactgcatcacccagtgggcggtgtgaggcagctgcgaggggcccgagctggcctcggggactgagacgggctcgagagctggggtccattctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgtttggctcgggggcctcttctccctgctctctcccgggtcgagtcggcacagggttatcctcggggtcagagggcgataggtgcggccttcccgcagtggccctctggccatcctgggggtcgggggcacctggcaccgtctgacaagcgggcagagggcctgctccggtcgtcgggggccttgggccactgttcggctcgggggcctctcctccctgctctctcccgggccaagccagcacagggtgggggtgcgcggaatgaggatcgtcctcatcgcgctccacaaccaacgccgcactaaccacttgcggggtcgccgctaagtagagtagcaagggttcatttggctccgaggcgaccagaactgggggagagctgagatacgccttcaactgagtgagggcacgttcagcttcctccgtccaagtaaatggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttcttggggttggcctcgatgcctcgggtagagaccaaaaacccgagaagcttgcccgcaggtacaccgaacacgcacttatcggggttcagttttatgcgggtggagcggagactctcaaaagtttccgctagatccgagagtaaggtctcttggttgcgcgtctttacaaccaagtcatcgacataagcttcaacattacgtcctatttggctacccaaagaaatccgagtagtacgttgaaaagtaggacctgcattatttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggcattgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttaaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggagataggcgtagtggactgccgccatgaacttcaccaacgcgggcctccctaggaccgcattgtagggcagactgaggtccgccacatcaaagttcacccgctccgtgcgaaagttggcggatccaccgaaggtgaccgggaggtcgataggacctagcggccaagtgtgacccggcgtcacaccgataatcggctgggacggccggagccccatccccggggccttgatagcgtcaaaggctgcgggggaaaggatgttgagggctgctcccccatcaatgaggacacgccccagcttcacgttgcaaacagtgggggaaaccaccatttcgatctgtcctccccgggcaacgcacggtgggtggtcggtctggtcaaaggtgagggcaacctccgaccaccgcgtccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaagttttgactgcgcggcaatccgcgaggtcgtgaagggaggtgttgtggacgatgcaccacttgccggttgggcgctccctactgggagcgccggcctccttctttttgtcgctcgcaggcctcccctttcgggtggcccgcgaaacgccctcgacggcgaggacatgaccctcgtcgtcggaatgggctgacctcttcttcctcctcctgtcacgccgccctgtccgagcagcggatccgggggcggccgaagctgccacactggaaccggaggggttccaggtccatgcctcttccttacgagccactcggtccgcgtgctgaaaaagctccgcggtagtctggggctctttggaggcgatcttttcgagcatgcggttgtgccgcacacccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgatcctgtcgtcacccccggcggcctcgatcccggtcgtgtagacctggagaaactcgacggggttgacgctcccgtcatatttttcggcgatggtgggccggaaccttgggggccaatggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggcaccccacgcagatcttcctgggtcggaggcgttgacgaaggagtggcggccgaatggcgagcaaccgccgccgctcgccgcgcccttcgccttgacgacacggagccggtggtagcagcgccagaggttttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgactctctcgagcgcctcctcccgcctaggactttggcgtggagggggcggtggagtacgagctcgacggcgtgggttcggctccccttcgtcaccgctaacactcggagagaggttgtgcgcctttgcttgttcagccattgggctgaacaggaaaagcttggcgcacacgaaagagtgcgagagcttagaagaacacacgtagaaccccctacctggcgcgccagatgacggagcgtggggctcctcaccgggagaccgcgcaggcccccctttgccagttcggccgggggccctgggtgagattctaagctccttgtctgtgtgtggaaggttcgcgagaattgaaacacacaagacacgggcgatgtatataggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcggaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcaccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggctgagacgggagcggtccgacccctcggggagacaaagagaagggcggccgtatcaccctcgggcccgaccccccccccccccccccgagggggttaggccgcgtgggtgatcgtgtctgcctcaagtctctaagtcatgatactcccggtcccatgtcaccgacaactctcatgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttaagtgaaacttgcttgcacaagacttacaattcaaggcgtagtccattgttcaagttgtgagtaagtgtagcttggagttctaggtggatgttcaaccttaattggtctccatcgaaccactggtatataaacagtacattggaaaaggcaaatctcagtgggattttgagatttggtgggggattgttggaattaatgaatgggccttagcccactcgaagattaattctttggaaaatcataaaagcccacctcatgggatggcatgcatgtggagtttagtaccaccttgcttattctaggagagggggacctccttaaaagggatgatgccctcctagtcgcttgaagcatgtgtggtggagagaagaggggaaacacacgcgcgcgctcgctcgcctcgcctggcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatatgcaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatacgtgtaccgctcctagccatacccgggacggcagctgcccccgcgccgacgccgtccgcgacctgtcacccaagcgcgcctccggtggtaggccgtacccgcgctggctgtgctggtacgaggggccccgccgtaccagcacggcagtcgatcgccgaagtcggagaagtgtactccagctgctgcctgctgcgccgaaatgtcaaaccggagtcgagcagagctgaggagagagagagagagagaggcagggcgactcttgcgttcgggaagaggcactctgccacgctgcttcaccttcgcgatcccatggctgatcagcaagagaagggtgcaaaatgtctgatccgtttagagcggactgaaagcagcacaccagtacgtggcgctgcaagcgtggatcgtcttcatgtcatatactcatatcctgatatccgtggtggatgtgattggtcaggaggaaaacgacgcatgcacagcttgatactgatacagtactgctagtatgaaatagcatcgtatcggagtaagatactatgagattttattttttaaaaaagtttaattaagatttgtattaattacaaatagccattcaataaaaaatacatagtaataatatatatcatgcaaatagagactttatcaagagaaatcacattagttttgatatatttaactgatttttatataaacttaagcatatatatttacgttatttttcaaaccatcttattttaaataatattttgtagaatcgtaagaatcgtagaatcaggatactatctataatttcgtaatatcgtgtcgtaataaatgaaaattaggatactatattgtttcgacttggtaattacgatacggatcgggatactaacaaccttggatatagtagtgaatatgtcgccatcacccctttcacttacgtgtgggcccacaatgctggcagtgttagtgtttcatcccgaagcaacataaatgtgtacctttagctcagcctaactcagtaagcatccaaaaattgatggaaaaaatggcttataggtggacatttttaggctttaaaatgaatcaaaatatattttttaatattccatggcaacacacgggcaaatcatctagttattctaaagttattactaccatattgtatctgaaaagcactctccttccaatcttaaatattattgcgacataattctcactgtctaaagggagggccgaatttattccctttatttaaaagatcacagttcactcacttaacacgttaatttacatgtctatagataattttcttttaaaaaaagataagtacaaatgcatgtgctcacatacacatgtacacgttgtgcacatcctatatctccgagagactggaccgatatatattgagattgacaaagttataataagtgtcttgctgttgacggggacatcatctatcaaaaaaatataattactcagaaaaatgatcacccatattaaatctggaatttaaattggaatagatataagaaatctaactagttgagttatatttgctggtatttatgaatcttgtttcaagtgaacaaggccacttgagacattgtttttaatttgtttaagtcaaatatcagttctaacaacttaggcagaacaaaaatctcaaatatatgagcaattttgaagcttctctgcagttatagcctggtttaattcctaactttttctttaaactttcaacttttctatcacattaaaactaattttctacacacacaaacttccaacttttctgtcacatcgtttaaatttcaatcaaacttttaattttcgtgtgaactaaacacacactatatatgtgaaactaagacgccgtacgtttggtctaatccatgaaggaaaggagaacgtggttttgagctttcatatgccaaatttgtcactatcgactcacggttggtgtttgaatgtttgttaggccacagcaacagaaaagggccggcaacttgttcgtaccactctagcctagtactccaacaatcttactccatctattctaaaatataagtatttttagatcatggcacggtcttcgagatgctatattgaccaacaatatttataaaagtaagatattttaaataaaaatagttgtatattatgatagtttgtttattgataaatctagtaacatcaattttatatgattgatgttctttactctttttttttttgctattaatagtcaaacttaaaaatgtttgacttatcactgtgctaaaaatgcttatattttaggacagaggaaatactattgagttactactggtattcctagtatttggtaggctagtattcataatttcctccgttttagaatatagcaatttaaaatcagatgagacttattctaatcatataaatttagagggagtatatccagattcatgctattaggatacgttctattcgatattgctatatcgtggaactgcggaagcacatggcaattgccaacagcccaaaccgcgggacacgcaagtagtacgtgcttgactacccgttttttttatgtgcatgcatgtgctgttgtgataaaagcaacgggtgcagatactagaagatatctgcctgtaccattcgatatcttggagaagtgccgtttatatatactccaggcagcatcacgaggtgcttttgtttcttcttcagacgtgcaggcgcaaatgggtgagatattctcgacgcattcattgagccgcctccttccggtgagtgggatatttctgatttctcgtcatgttttgatcactgcgtattcggcatgactgcctaggcacgtcttgcttttcagagcgatgcaaactcgcagatggaagatacacgggtgacgggttacggcccatgtttgatgggaggtcaccatttcgtagctttcccttgtgcgttgctcttcggctgtcacctgtcatgcacctgcatcccggatgtgttcttttccactgaaaacggaagataataggaatacgcgctctagctataatttaatgctgcgaaagttaaaaaaaaacgttctgcatatgaatctttaaggtgctattttaattctattttgttcgtttacttcctctatcccaaaaatcttgatgtttttagattcctcagcaaaattatcttcatgccaaaatgattaaattgctcccgtcaattcgattcagttgccattttatcaagtctacacgcactcatcaggttatacagaatcattgcatgcaattaattaataaattctttctaaaacacattgccaaataacttgacggaatagactagataaggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaatagataaatggtctcacttctccgatcaaatttactactccagcgactttttttattggtagaacggctcgtttgtagggtggatgaaaagaatcatcggttggccatattttctaataagttaaaacaactttattaagaaataaaaattaatttattggtaaaaaattgtatatttgctctgcgacttaaaagccaacataaaaaaatacattaaaaatatcttaaaatcaacttaaattttagcttttgctttagcttattaaaccaattgatagggcttgaaatatacttttaatcatttgaccatttagccatacaatgtttccttccattttattctgtccaaaataagcttaaagtactactatcttcgttctactatcttcgttctaaaatatagtttatttttaacacagtacattattccaaaataaagttatctgtttaatacctatctcctcccttctactattcacaactattttccttcactactccctccgtcctaaaatataagtatttttagttatgaatctggacaactgtgtatccacatttatagccaaaagttgttatattttaggacggaggtagtattttctattctcaaccaattacaaccatcctctaattcaaactatattgtccagattaatagccaaaagttgttacattttaggacggagtgagtaacatttttaatgcctatgtcaacaaaaaaaatgcttacattttgagatagttgtagtcctatgatactagagagtactttctctgttttagaataagttaatctagtactaactccgtcccaaaataattacagccgtggatattcgtgtccaacgttttaccgtccatcttatttgataaatttatgatttttttaaaaaaaagtcagacataaagtactattcatgttttatcatctaataataataatactaatcataaaaaaatcaaataaggcgaacggttaaacgttgaacatgaactatgcaaaactacactattttggaaggaataagttcacttcatgaccctcaaaagtgacccgaatctaatccatgaccctaaaccgcaaaaccggatatcttcacccccaaattattgaaaccggtgcaatttgactcccttggtggttttggagggcggtttcgctgacgtggcgctgacgtggcagtattgactcggtcttctttccacgtggcgcttaggtggcattagaaataaaaaatatgcgtgggacccattagtcattcacacacaaaataaaaattgtggggcccactgacatgtgggccccacatgtcatcctctctctccctttcttcttcctcccttctctctttctttctttttctcttctctccccttcggctggccacggggagcacgagcggctggagctggagcgccggccggcggggccagagcagcggcggctgcggcggtagcctcgctatcagcctcgccaagtggagagaggagaggagaggatgtaagggaggaacggaggtggtgggttacacgagaggcggcggcggcgcgtgagggcaggaagggagaggggagaagcggagccgctgagctcgtgctgtcgccgccggtgcctcctcccgcactcgtgctcgcccgcacgccgccggagccgctgagctcgtgctgtcgccgccggtgcctcctcccgcactcgtgctcgcccgcacgccgccggagccgccactcgatgcctccgtcgtcgacgtcccgtgcccaccgccgccgtcgacgtcccgcgcgatgcgaggatggatgcggggaggtggtggaggacggcgacgaggagctctgatcccggcgatgcggatggatccgaagccgtagccggcctgtagaccaccgtgcccccgctcaatctcgtcggcgtcggcgctgccgtcctctctcgcgtcatctctagcccgccgccgcttcagctctcgtcgaccgccaccaatccggcccacgccccccgctgccagctccagcccaccgccgctcgctccccgcaaacgcccgaagtggagagggagaacagaaagaaagaagggaggaggaggggaggtccgggaggaagaagaaagggaagagatgacaggtagggcccacatgtcagtgggcctcacaatcttgtgtgtgtgaatgacaaataggtcccacatatatgtttttaattgaaatgccaccacagtgccacgtcagcacacagactaggtcaacaccgccacgtcagcgccacgtcagcgaaaccaccctccaaagccaccaagggagtcaaattgcaccggtttcaatagtttgtgggtgaagatatccggttttgcggtttaagatcatggattagattcgggtctcttttgagggtcatgaagtgaacttattctattttggaatggagggagtaggactacagcaaaagtgcatccagattaactgcatcccaacaaatctgatgacgtggaccgaattatgtccccgtctgaggactgagagcccacgaagcaccgagtgcacgacgctattctttactccccgccacgtcatccccctcccccaccccacggcccacccctgtgcccctgtaccaagacaaccactgccacatgttgcgcctcggacgagtcccgccatggccccacgcgtcatccaccgggagaaaagaaagcaacaaaaacacatggccagcgatttttcgtgaattttctggcgcgcgccccacacctttgtggccaggaggcgcccatttgtagcaacccgggaaaggcggccttggtttttactatcgttctatccgctccccgctcgcgcggcttccggaggcgcgacgcgcgtcggccccggacaccaccagttcggtggtggattgcggctcccctctcgggtcggtcgctagcagcggcgtggcctgacgtgtcaaaaaagcgcagcgaaagtcccaaagtcctcgcccccacccggcgatctttgcgaccggacccgtccacacgagcgcggtcggtcgttgcggccgcatgccgctccaaatctagaggctgagatatttcctcggattttcaaaaggatttttactaggaaaatactccaattcctcgatgatctgtatctgtactccgtgcaggataaggtaggagtagctagctagcaatcccgtattctgtgaggctcgataaaagagagtactgctgctcctgcttgtgttgccatacatgttgacgtggcatcacgataaggtggccctttttaatcttggggagataagatttagcccttggtgatttaggaatgttcacatgatgctcgtcatcgaaaacgaatactctttttcgtcgctactactactctactctgcaagttatcttcgcgtgtcaagtttagtgagcgggggcaattactaatggcgcattagcaacacatgacagcgaggttgccggaggagcatccccagccacaagaacgagcggcttcccgaattcccccaccggattatttatttttcttttcgcgcgaggaaggtatagggggaaaaaaataaagaaaaaggagaaaaagagacggggaaaaaacgcagccaaaagaaaagagaagagggaaaaaaaacgagggaaaaagtttggcggaaaaaatcgagtcctacgtggcgcgtctcgccatgctctttttctcccgtcccctcctccctcctcctagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccggtaaattgagtttgatctttccgtttcttttcttggcgagatcgtttttgaatgaactttgtttttcggattaaatgatgttactgggaactgaccgtgtgctgttttttcccctctttttgtggccgttctgtgctattcagggaaacgccatggcaaccgacgaaaacggtgccgacgatcgcgccggcggcgagagcaccgtggatcatctcaggagccatatgaactacggcgacatggatttgtcaggggaagagcacgtgccaaaggtaaattactcctccccccgaatcgcggcttctccgctgcaaaatcccgtgcggttcttgtgtgcttgagttcgttggctgctcgattccctcttaaaagattgtgttccttccttgcacgcttgcccccgaccaggcgcgaaagccgtacacgatcacgaagcagcgcgagaagtggacggacgaggagcacaggctgttcttggaagccctgcagctgcacggccgcgcatggcgccgtatacaaggtatgtctcatcgaacagatcgaattttcatggcgatcgatcgcaattgtccgtattcgcctgtgtgccgtaacgtttgtgttcgtctgtgtgtggatgcagagcacataggtaccaagactgccgtgcaaatccgtagccacgcgcagaagttcttctctaaggtcgtacagcctttcgttctcatgtaaacaacaacaaaaaatctctgatctctgccatgaaaaaacaaacaaacgaaaaaaaaaaaaccattggttgtgttacttgattgcccaaagtaagtcgccaatttttcaattttttttcatgggagagaagaacagatgatgtcatgtttttactgcgggttgtttcacagagtttcctgacgctgtgattgcgcggtgctctgcaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaaggtatattctttcgtgggcagcacatgttggacaactttgtaaggcattagttcttccaattttgcaagaatacaagatattccccatcagaaaagcaatatttaggaccaataatttcagtcgagaatttctgacatcactttcagagaaacacaggtttttttagccttttaggtaggagtatctctgaatcaaattgtgatatgcaatctgatcatctgcagttttacatggtattaatttgatctattgtcgccaatggaaaaataaccatacccttttagtgttattggcacccttaataaattctgtttttgtttttcgaatgtgaatttcagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgcaatgtagtctgtacttgtgtgcatcgaatcagcatagatatctggacttggtttcatggtttgttaccatagtacgattttggaccatgtcagagcaggtacaattctagattataaaccatcgataatataataaacacatatcgataatataaatgagaagagatgagaagagataagagtagcgagttacagatttatagacagctgcagcgtagactataagacatagtgtgtgtatgacaggtggaatcaggtggtagatgtgacaaatatagtacaatgaatctggacaaacatttgtctagattcattgtattacgatgcttcacatccacccaaaatctcttatattatgggacgaatgaagtatatgtttatagggtactacctccgtcctaaaatataagcaactagttgggtggccaacgcaattacgcggctagcacccaaacaaaattatatattttcttagtatgattttacttaaaatttattaaatagctatatcattgtcttaagactttgaaagactaaaccttatcatcatcgtgtttctaattatatagtttttaaaagtcataccagttgctaccccttgtgtcatcttcttctttatttgcttgctcgatctaccattatttctattcattctttttggaacctttaaaaattggattttatagtttttagagtttattgtcaagttggatttcatttttataatttctaaatgtcccgtcaaacgttgccattatactcctctacggcccgtccactgtctcttctctttattgtcattgagattttaaaaatcgaacataattatcgtttgggttcattttttactttctagaagtccagccaaaccgtcagcagctttgccattgtactcctctacggctcgcccgctgcctcccttctttattgtcattgagattttaaaatcaaacattattatcattgttttttttttatttttttagaagttccaaacctttaaaaatggacttgtagtttcactttttataacttttagaagtcccatcaaacgatgccactatgcccctctatagcccgtccgccgccaactctttattgttattatgattctaaaaatcgaacataactattgttggaattcatttttttattttctagaagtcccgtcaaccttcggcggctctgcaactatactcttatacacccccgctgcttctcctttttattgtcattgagattttaaaaattgaatatgattatcaatgagttttttttttactttctagaattcccggcaaccgcattactaatttgcttcacggcctgcctaacgtccctccttttaattgtcattaggattctatttggtgttttattaacaatttttatatctcgtatcaaccgccaccactctactcctttataggcatgttacttaatttatctcgtcatatgttttagatggtcttttctttcaataatctttattttatcacaaattttagttatttaaaaattgtattcctaattgatatcttatttttctttttttaatttcagaatttttttaaaaaaattttagttaatatcatattgtattctttgaatgtttttattttttattttcaatttcagttgttttaaaattgtattcctacatgaacttttgtcatgtgttttagatggtcttttctttcaataatctttattttatcacaaattttagttatttataaattgtattcctaattgatatcttatttttcttttttaaatttcagaatttttttaaaaaaattagttaatatcatattgtattctttgaatgtttttgttttttattttcaatttcagttgttttaaaattgtatttctacatgaactttcttttaatttttctaattttaggtattattttatttttattctcaattttaattaatatcgtattaggttcttatatggattcttctttcaatattgcatatttttaatttcgaatttcagcaaattttaaattttattcctacatgaactcttcttttattttcttttgctaatttcagatttatttatttttatttcgaattttagttaatctcgtattgggttcttatatggactcttcttttattattccttatttttaattccgaatttcaactatttttaaattgtatttctacttggactctcattttcttttttaattttggattttattttatttttgttttgaattttgattaattccttattaggttcttatatggaaacttatttcaatattccttatttttaattccgaatttcagctatttttaaattgtatttctatttggactctcctttccttttctaattttagattttattttatttttatttcaaattttgattaatctcgtattgggttcttatatggaaaattattcaatattgcttatttttaattccgaattttagctatttttaaattgtacttctacttggactcttcttttttttctttttcttttatttttatttcgaattttgattaatctcgtattgggttcttatatggaaacctctttcaatattgcttatttttaattccaaatttcagctatttttaaattgtacttatacttggactctccttttctttttttttctttttcttcgattaatgtgggaatttcttttaatttttctaattttggatattatttttttaattctgaattttaattaatcacgtattgggttcttatatggagtcttctctcaatattgcttttttttaattccgaatttcagctaattttaaattgtactccgatttgaactattctttttttttgctaatttaggattttatttttatttttactcccaattttaattaatctcgcattgtgttcttatatggactcttcttttaatattccctatttttaattccgaattttagctattttaaaattgtattccgacttggactatccttttcttttctaattttggattttattttatttttatttggaattttgattaatccctcgtattgggttcttatatggaaacttctttcaatattgcttatttttaattccaaatttcagctatttttaaattgtatttctacttggactctccttttcttttctaattttggattttgttttatttcatttcgaattttgattaatctcgtattggggtcttatatagaaactattttcaatattgcttatttttaattccgaatttcaattatttttagattgtacttctacttggactctcattttattttattttctttttctccgattaatgtgaaaatttttagcccccagagcgaacgtggtgcctcctttcaaagctgttttaataatataaatagctgggtggcccgcgcaattgcgcggctagcaaaaaaatcatatatttttttaagtatgatttccttgaaatttattaaatagctatctcattgttaacactttgaaagaccaaaccttatcatcctcatcctcatgtttctaattatatagttttaaaaatcacaccagttgctaccccttatgtcatctcattctttatttgtttgctcgatctatcactttttctattcattcttggacctttaaaaattggattttatagtttttagagtttattgtcacgttgggtttcgtttttataatttctagatgtcccgtcaaacgttgtcgttatactcatatacatctcgtccactatctcttctttttattgtcattgagattttaaaaatcgaacataattatagtttgggttcatttttactttccagaagtcccgccaaaccatcagcggttttgccattgtactcctctacggctcgcccgatgcctcccttctttattgtcattgagatttcaaaattgaacatgattatcattggtattttttactttttagaagttccgaacctttaaaaattagacttgtagtttcattttttataatttttaaaagtctcatcaaacgatgccactatgcccctctgcagcccgtccgccgcctactctttattgccattgtaattttaaaaatcgaacataactatcgttgcaattcattttttattttctagaagtcccgtcaaccgtcggaggctctgcaactatactcttatacaccccgctcgctgcttctcctttttattgtcattgagattttaaaaatcgaaaatgattatcaatgtggattttttttctttatactttctagaagtcccggcaaccgctttacttgtttgctttatggcctgcttgacgtccctccttttaatcgtcattaggattctatttggtgttttattaacaatttttatatgccgtatttgttagggttacgggttaggcttaccctttactgtcacgtcccaaaacgaccctaaaatacattctctaaattatgcctagaataattaaaatccgtgtgaaagcctccaaaaattaaaatgtgcaaagtaaaagtcaaataaggcttagaggatttttgtatatttcctaaaagcctaaaatatgtaaataaattttagtggaattttcatagcacaaataataattgttaagaaataaacaaagttaaaaaggttttataaaaaaaaaccctaaaaatcccccttccctctcttgggccggctcggcccacttccctccccctctctcctcttccctcgcggcccacacggcccctccccgcgtgcgctgctgacgggcgggtccgcctgccaccctcgctgacgggtggggcccacccgtcatctccttcctcccgccgctcccgccgcctcgcccgcgcctagcgccgccgccgccgcgaatcccgccgcctccggccgttcccgcgtgcaataaagtggggggaaatattccccgtgatcccctccccctttccccccatttttccctctctctctctcgcatacaaacgggcggatttgctcccgcaaatctcgccggcgccattgatggcggccggacctcccggccggtttccttcctctcccggccgccctctcccccttccaaccctatttaaaccctccccgcgcctccctcgcctgtttctgccccttgccgcaccgtctccctgccggaatcgagctcgcgccatcgccctctctctcctccgtcgcagacgacctccggccggccctctccgctcgccgggaccgtctcccgcctcggcgtcgccttctccggcttcgccgcaccgtcaccgtccccgtccaccccctcgtcaggctcgccgaccgccggagcgccgccgtccccgtcgacccaagccgcgccgccgccttcctccgctccggccgcctttttcgtcgtcgccgtcgacctagggtgagccgtggaccgccgcctcttttcccccttcccttcccctctctcggccgctgctccgccgtgcctatggccgccgccggcgaccataggggcgcaggtgccgcctcccgccgaccgcgccggcatggccgccttcgggcgcgccgagtggccgccgcgtggggcccggccgtcagccgcctacgccctcgggtgcggctgacgcgtggggcccacggcgcaggccggtgtgagcccgggagcgcccggtccaccgtggaccgtgaggctgccgcgtgggccccactcccatggacccggtccgcgcgccctctcccctcggctgacgcaataaaccatttttaaattaaaatttaaatgaagaaattcgcaaatattcacttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcctttttcctttccattggtcgtgtagacgctgcagcttcggaagatccgctcttcgtgaaggttgaagccgacgtttgggaaagtgatcaaggcaagtcacatcatccttgaacatattgaatcccagtttataaaattattttgatttaaattaatgcattatcgctttatttaaattcccgcgttatcactgttttatttagccatgcctatttacctttgttatgacctaattattattgctattgttattattaccttgttcaccctagactaaacaaaacccccaactagtaggtaccctatgcatggtaccactagtatgaatttaggtagatgcttcgctgcttaattaagcaacattaggtggttttacaactctagactttgggaatgttcatatcacctagacactatggaatggttggattattgtggaattggattcacacctccccctctattcaaaatcctcaaaatggttttaggctgggctcggggtgcatggttttgattgtagcacctcggccacataaggaccggtcttcgggcctatgttgcaaagcactaccgtacttccacatgtctagtgggtaaggcttagtttgtggctcagtctggttataaacaaaagtacacggatggagatggacgaagtcaggggtcgatggacatctctagggcaaatgaaggctacacgagctgcggcccggtagtcgagatgtcatggcacagggctggtgtcctgctgctaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgattagagtataacctattcgaatagccgcgccctcggttataggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggtcttgggttaaggcaggttcgtgtgggttcacggccttgattaataatattgcatagctctaggatcgtatttacaaaatagctttgagcaactaagtgtcttttaatgctgtttactgcaaaccctaaccccctatgttataactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttttttcgtttgtcttcctgtgtgctgggccttcgccgcccatgtaataaattatctatttacacttccgcttgttaaactctgtattgtatcaacttttggtgtaccttgcctcctgggacaaggaataatacacgcacgtaaggaacgcccgttgggttatttccggtcgtgacatttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggccccccggggagggtttaggatcgaatctcagacccaacacaacctccacagcctacgaagccggagcttgcgaggagccaagtcatcgagagctagtcgaatcaactcgactacaatctcgccggatccgacaagttcccttgttctctttgtaacctgtgttttttaccatataatcccacatcaactggattagggctattacctgtcaaggggcctgaaccagtataattcttgtcttttgtttgcttgatgtcatactacgtagatccttgtatcaacgtaccccaataccctctatatccagtctacgggtatcacccgtcgacagtggcgcgctaggtagggggccttggtacttaaggttctactactatgtcatccagcttcgtcgacaacaacgtcagcaccagcctcagccaagtactccctgcttcaacaatgctggtatggactcaagtcggcgaaatcgtcttcccggtttacaccacgacaccgatctcaaccggtcctccaatgaccggagacgagaacgcagtggctacgaaccaaggcgattccatgtcaaaaaatcctctcgtcgagacggagaacggaatatcgacgacatccaagctcaagagggattctgatacggccaaaccttgtccttccgacatgaaccacgagccgacaaagatgacttccgaagccacaaggtcttggtgtcctatccacaaaaccaagaaacacaccttgcaagattgctgggttttcctcaacgtccgtgctgaaattcgcgcctgcaaagaacgtggaattcagcgtacttctccaactcgggatgtctattgtcctattcacaagacaaagaatcaggacctctcgagctgcaaagtctttctcggcgccatgaaagctcagtctcctaagtcatatgtccccatcagggataatgacaaggaacaaggagtgactccaacttcagatcgattcgttggagtaatcgatatcgatcctcacgaaccatcggtcttacatctcctcgaggactatgggtcatcgacaacgagcacgccgcgggaggtattggctatcgatgatgttggcacgtcagcgcacgccaacgcagaagcggggaaacaatcgactactcaagcccagcacatcaggcccgttcaagcgatactgagggaaactccttacgatcccgttctgaacgttgacctcgagcgttggatagaacgactatgggaatcggtgactaacctcagcaacgcgtttgaagaagccgctaccgcagcacaccaggagcagccaccaactggcgaggccaatagtgaagatccggaacggagggaatcacctcaacgagctaccccttcacctcgcggcactggcgatcttcgagatcaaatcaacggccgccgggaagcacgacgcacacgagacaacgtgaatcgctcttgacgtcatgtctcttcacggcgccatgataacggaaatcgaggagactgctcaaacgaggaccgggaccacgacaaccaccacgatcacaacgatcgcgaacgacgggtgccagacaatactggtcatggccgccaccgtatcgacgacgacgatggagatcggcgccgagacaacagtggaagacgacgacaggattctcgagatccaggccgtcatcctcgtaatcgtacgccggaaccaagtgacccatcgtcatcgtcatcatccgcgtcctcctcatcgtcagacagatatccacgaaggacacacgatcgccaacaacccaccgccccaacgctgggtgtagggctttcggtcgttccctacgtgatgtctgatggtctgagagattccgacccggagcaatagaaaagtatgatgggagcaccgacccagaggagttccttcaagtctactccacagtactctatgctgccggagcagacgacaacgcgatagcgaactatttaccaaccgcgttgaagggttctgcacgttcatggctgatgcatcttcctccctactcaatctctttgtgggcagacctgtggcaacaattcatcgccaatttccaaggaacatacaagcgccacgcgattgaagacgacctacacgcgttgacacagaactcgggtgaatcattgagggaatatgtttgacgtttcaatgagtgcagaaacacaattcctgaaatcaccgacgcttttgtaattcgcgccttcaaatccggtgtcagagatcgctacactacccaggagttggcgacaagacgcatcacaatcactcggagattattcgagatcgttgagcgatgtgcccacgctaatgttgtgctaagacgcaagaacgataggccgaagaccgggggagagaagaaaccagccacggacacatctgagtcaagcaagaagaaaaatcgcaaaaacgggaaaatgaaagctcaagcggaagtcctcgcagcagaatacgcaaaccctcccaaacacccagacccacaaagcagcgacacaaagaaatcatggtgccccatacacaagacggacagacattctctggaagattgccttgttttcaaaaagtcgctcgagaagcacatggcatttgaaaaaggcaagcgagtacgcgttgttgagacgaacgaagagacggctcctcacgaaccggactcagcgtatctagactccaacctccacgtctcacacatcttcggcggttccacaacgtactcctctaagcgagaatacaagaaagtggaacgtgaagtctgctcgacatggcagggggctgcccccaagatgaagtggtctgagcagaagatagagttctcggaagaagaccaccccaagaccgccgttatcccaggatgatatccgatcatggtcgaacccactattcggaacatcaaggtagcgcgagttctcattgacggtggcagctcaatcaatcttctttttgccagcactttggacgcgatgggaattccgcaaaacgagttgacaccaactgatcaacccttccacggaattactccccaatcatcgtccagacctttgggcaagattacatttcccgtgactttcggccaagccaacaacttccgaacagaacagatcacctttgatgttgctgaattcgatacagcttacaacgccatcatcgggagaactgcacttgcgaagttcatggccgcatctcactacgcatatcaagtgcttaagatgccgggaccaaagggaacaatcactatttaggggaacgcaaagctggcggtgcaatgcgacaagcggagcctcgacatggtcgagcaaacgcccagcccacccgccacgactgagccacccaagaaagtgaccaagacaaataagacgccgaaaccagacggcgccatcaagattgttccactctccagttccaaccccgacaagaccgtcaagatcggggcaacactaaacgagaaatagaaactcgcgctcatcaccttcctccgcgacaatgccgacgtgttcgcttggcagccgtccgatatgccgggggtccccaggaaggtgattgagcacaaactcatggtgcgacccgatgccaagccagtaaagcaaagactgcggagatttgcaccagaccgaaaacaagccatacgagaagagctcgacaaacttctcaaagctggcattattagagaagtacttcatccagagtggctagccaatccagtcatggtgcggaaggccaacggaaaatggaggatgtgtgtcgacttcaccgacctcaacaaggcgtgccccaaggatcactttccacttcctcgaatagaccaactggtagattcaacagccggttgcgagttattgagcttcctcgacgcttactctggctaccaccaaatcagcatggcaaaagaggacgaagagaagacagcattcatcacgccgtttggggtattttgctatgttaagatgccattcggactgataacagctgggaatactttccagcgcacggtccagggcgcacttagcaaccagcttggcaacaatgtcgaggcttacgtcgacgacatcgttgtcaaaaccaagacaggcgactcattgattgacgatctgcgggaaacgttcgacaacctccgacgatatcgcctcatgctcaatcctgagaagtgcacgttcggagtaccgtcgggcaagctgctcggattccttgtctctggcagaggaatagaagcaaaccccgagaagatcaaggcaatcgagaacatgaagtcgcctacaagactcaaggaggtacaaaaactaaccggatgcatggcagcactaagtagattcgtcgctaggatgggagaacgaggacaacctttcttcgctctgttgaagaaacaagacaaatttgtatggacataggaagccgaagaggcattcattgcactcaagtgctacctatcaaacccccctgtacttgttgctccccaacctaatgaagaattattcctctatattgccgccacgccacactccgttagcactgtcattgttgtcgagagagagaaagtacagcgactagtttattacgtcagtgaagctctccacgacgcaaagacaagatacccacagatccaaaagttgctttacgctgtcatcatgacatcaaggaagctacaccactattttcaagcccacagagtcacagttgtctcctctttccctcttggtgaagttgtgagaaacaaagacgttgtcggccgcattgcgaaatgggtagtcgagctgagccagtttgatgtccactttgtgccacgaacagccatcaagtcccaggtactcgccgacttcgttgccgattggactatgccagataacaaattagacaaccaaggcgacaatgaaacatggacaatggcgttcgatggcgcactcaacagccaaggagcaggggcatgatttatcttgacgtctccctccggagatcaattcaagcacgcaatccacctcaacttcagggcaaccaataacactgcagaatacgaaggactactcgccgggatacgagctgcagctacacttggggccaagcgactaatcgtcaaaggggactccgaactagtcgcgaaccaggtacacaaagattataaatgctctaactccgagttatccaagtatcacgcagaagtcaggaaactagagaaaaagttcgatgggatcgaggtccgacacgtctaccacaaggacaacgtcgagccagacgacctagcatgacgtgcgtccagacgagaatcgctcgagcccggcacttttctcgacatcctgacgaagccatcggtgaaagaggttagcggcaaagtcagcccgaacacccccgacattagctcggaggtcaccgaggcagaacgcgccattgccgacatcgaaaccacagacgactggcgcatcccactaatcaaattcatcagcagcgaggagttgcccgaggacgatacagaggccgagaaaataacccgtaaagcaaagatctactgtacggtcggcaatgatctatataagaaagcgccaaacggggtacttctcaaatgcgtctcgaccgacgacagcagacacctcctcctcgacatacatgaaggcatatgtgggtcacacgccgccggtcggacattggtcggcaaagcttttcgacaaggctttttttggccaaccgcccttaaagatgcatgcgacatggtccagcgatgtgaagcctgtcaattccacagtaaacacacaaagctacccgcgcaagcgctccagactatccctctgacttggccattctcgtgctgggggctagatatacttgggccattcccacgaggacagggcggctacagattcctattcgtggcgatcgacaaattcaccaaatggatcgaagcagtacccacgggggaaatcaaggccgacaacgccatcaaattcatcaaagggatattttgcagatacggacaaccacaccgcatcataactgacaacggctcctagttcatcagcgccgatttccaggactactgcatcgggttgggggtcaaaatatgcttcgcctcggtctctcaccctcaaagcaatggacaagtcgagagggcaaacggcatagtattacaaggaatgaaaacccgcgtctacgacaggctcatgtcacacgacaaaaggtgggttgaagaactcccatcagtactatgggccgtacgcaccacaccgacaacgtctaataaggaaacacccttcttcctcgtgtacggctctgagaccatgctcccaggcgagctacaacatcagagtacacgagtacagaagtactccgacaagaaccaggaggagtagagagatatcgatgtaaatcttctcgaggagcatcgggaacgagttgccgtccgagcagccagctatcaacagaccctccgccgttatcacaagaagcacatccgtgcacgcatactttcgatcggcgactatgtcctccgacgagttcaaagccaagcagggcgaaacaaactctcacctaaatgggaaggaccttacacgatcacacaagtcttgcagccaggcgcattcaaaatcgtagacggcgacggtcgtgaattagcaaattcttagaacattgaccaactacgtaaattctatgtatgagtcaataccatccatacctgtaagcacccttacagtattaataaaggctatttctaggcccatattacaatcaacgtgtttcccccgatgatccctcactctgatgacacctagtgttgaaacctgtccttatgtccctttacgccgtctcgacaaggcctctgaggaacctaagggatcttcggctggggacgcccagagccgataaggccttgtcagatcctgtagagacgaaagaccatataagatctggtcgtgtaagagttctcgccgtgcgtattaaccaagccgtgaaatcggaaattaactttccaacttcacggctgggggctaggatcaaagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagagacatttgtcaaagatagatttctttattcacaaaatactccttacagttttttcacaaatctttcgctacattacatcttttcctaagatatttgtcatagggtacgagtactaccaagaaggccaacgccagtccatagactagaagatcttctcggccaacgacgacattgaccttgccagatggtctatctccgccggagtccttcgagaacgagcaaaaccctcacgaagatattcgaggtccaggcgcgggcgatgatctcgtaggcaagccaacacgtgccccccagcatatcggctcgatcgatgacactcctgcttcaaggcctcgtcgatacgctttccgattccatcgagttgggcacaggccccattaagccacgagatgtacccggccgccgactcctcgggatctccgcggactactcgaagctccctgcatactctggccatggatgtgcagcaactcttcaagtacgagttaaaccacacctcacgacctcggagcgtttccacagtctgctctttcttcatggccagcatggttctctcgagctctgccacttcaaacttcgtcttccagtattggatacaacgatcttggctagcaaggacaccctcgagatctgctaaacgtgataaccactaagtcaagctatacatctctttcgggatatggctgacctagtcaggtgggcattaaggggtgaagggactactaacctgaggaagtcgtcgccgtccttccctctatatcaaggggttgatccacatggtcaggcgagacgtgtggttcaaactcgagtaccggaattactgccagtgactcgagctgcccgcgctgctggacatcctcgtgatcagtatctctacagaggacaaaagttcccgaggtcagcataccaaagtaagccgggatagtaatcgcacgcacgaaggcggtcagagttcgagttttacacattatctaggaaatacaagaagtcctactcttcaaaaagggggagaacagactcccccagatcaccgacttcttccatcacctccttacgcgtgtcgctggccgccccctggtccaagatctcacgcagatcgagttcaagacgcgacagccttacacacgcgaggacatgacacgccccggtgtagattccgtttgacgtctcctccgcaatcctagccgcatgcttggaggggatttcccccatcgccgtcaccaattctgcgagagaggaggtcagcgaaaactcatcgggattcaccgggatcgtggacgtgacgccgcattccccgacgagctggtgaaggctagtgtaggtgaccctcaacgagccccggatctcagataggttgttcccgagttccgacattcggtcctcgagccccttccgttgtcgctcgttgccggctgccaactccctcatcttcgtgaggtcttcacgggcttcaaccaactcgcacaccagtctgtcagcacgcgcgttcgccgtcgccgcttccgacctcgcctccgcaatctcgcggtcgatgccgcgagcaccggcttcgaggaggcgccccatctcgacttggagctcctcccaggtgaggactgcagctggcagatcacgacctaccgcggggtcgctgactgggccactaggcatcgcctcccggctctcggctacgggcacgacatccgttgaggccacgacgggcgacgcactggaagctcctctagacttggctcgtgcagcctttgtccgcgcctccctacaggacgaccatgagtcagacaataatcgaataagaagcgcggggattcaagaattcatctacttacttctcgccgatcgtcacaatgcgttgtcgtcgtggaggtgggggagacgcgtccgaggcctgaaagacaatcaacgcaaagtaaggaaaaatccttcttgctgcatgatttaacgacaaaataaattaccgagggggtcgacgccttgcgacgatgtccgcttacagacgagaatttcctcggctttgtcggaacattgccaccgctagtggtggcagcatcagacacctccttgacgaccttcacttttagagatgacgccacctgatggtccgcgagcggtccgatgacatcagtcaaaggaagagcctacgctcaatcaagtcataaagtgatttcgaaaggagaatgcaggatgtttatcgaatatacttacgttgatggctttatcacgttccgccgcccccttttcacaaaggggcacagggatgtcactcaccgtggtcgggccactgatcatcacttggccgacgcggcgctccacggttttgccgctcagacctgttaatcgagaaccaaccttcgataagtcaagaggaatgcaaacacaagtatgtcaagataaatgcgagaaagataccccgaggagaaacccgggtcgcgtcctctgacccggaatagttataagctggatgggcccgagcctgaagcggctggatccacctaccaacgaagtctgcaacgacttcatatcccgacaaaccccgtactcggagatcgtcgatgatgtcgataaacgactgaagagagggggtcaaggggggctttgcggtccaagacggaatcttatccggttgatcttcgggaaccacaaagacagggttcgagttcttgatctcaagataaaaccacctattcctccacttgctgcgagaagaaggcactggaagggaatgtaacgcgacttcaggccatcccgaagtcggaacccgacgcaaccagataccctgttggattccatccaacacagttcgtagtaaaagcgaaaaagatcaaggaaaggctctaccccaatgtaggcctcgcaaagatgcacaaagatgctgaggaaggcgatggaattggggttcaaatggagaagagaaagaccatagaaattcaaaaccaggagaagaaattcggaaggtggagggagaaaaccgcagagaacataatcttcgatcacaaccatgcgacccaagatgggctgaggattagtacctcatgcttccctctccatggttccacagccaggaagagtgccatcctcctggagtttcttcaacgttgcactggtggaagccgatttgccgaggtccattgctgatcgaaggtcgccggaaaacgagcctaggttgacgaactagggtttcttgcggcggctgagaaggcaaagagttcttggaggtggtgcgtgtataacaggtttggcggacttcaaaatggactcccaaaattcctttaaataggcgcactaccgacggtgcgaattccagggaacagagagagatgcccaccggaaatttctggtcccgttacgcgcggcggttttttggacttcagtttaaaattcgctcgtgaccgttgggcttcaaatggcgtgctcgactacggtctatctccacggtcctcgcaccgggaatgacaacagtctcgacacccgaagtcgcaaatggttgcacgagttcattttaagcagaagtcggggactactgtcagggttacgggttaggcataccctttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggctcccggggagggtttaggatcgaatcttagacccaacacaacctccacagcctacgaagccgaagcttgcaaggagccaagtcatcgagagctagtcgaatcaactcgactacaatctcgccggatccgacaagttcccttgttctctttgtaacctatgttttttaccatataatcccacatcaactggattagggctattacctgtcaaggggcctgaaccagtataattcttgtcttttgtttgcttgatgtcgtactacgtagatccttgtaccaacgtaccccaataccctctatatccggtctacgggtatcacccgtcgacagtattaaccgccaccaactctactactttataggcatgttacttaatttatctcgtcatgtgttttagatggtcttttctttcaatagtctttatttttatcacaaattttagttgtttataaattttattcctaattaaaatattttttttctaatttcagaatttatttttttctaaaaaaattagttaataacgtattgtgttcttttaatgtttttattttttattttgaattttagttgtttcaaagttgtattcctacttgaactctgttttaatttttctatttttggatattattataattttatttgaaattttaattaatctcgtgttgggttcttatatggtttttctttaaatattgcttctttttaattccgaatttcagctaattttaaattgtaatcctacttgaactcttctttattttcttttgctaatttcagatttatttttatttttattctgaattttaattaatctcgtattgggttcttatatggaatcttcttttaatattacttatttttaattccgaatttcagctatttttaaattgtattcctaattggactctcttttccttttctaattttagattttattttatttttatttcaaattttaattaatatcgtattgggttcttatatggaaacttcttccaatattgcttatttttaattctgaatttcagctatttttaaattgtatttctacttggactctcctttccttttctaattttagattttattttatttttatttcgaattttgattaatctcgtattgggttcttatatggaaacttctttcaatattgcttatttttaaatccgaatttcagctatttttagattgtgcttctacttggactcttcttttctttttttttctttttctccgattaatgtgggaatttctagcccccacagcgaatgtggtgactcctttcaaagctgttttaataatataatagatagatagattttttgctgtgaatctggacaactgtttatccagatttatagctaaaaatgcttatattttgggacagatgtagtaattatatatgtattacatattaaataaattgattataaatgatttagaggtatttcctgctatacttgctctaaagataacaactcagataatgatgagctagtggcaagcgcaaaatggaagttaggaggacgaaaatatggttccaaacagaaaagccaaaggctaggatttattctaatagcgctttaagatacgtgcaggccgcaacaccggatcgaccaaaatccgcaacatgatatcggaatccgcctttgcgaagcgcggcggcggtgaggtggtgtgggcacgccaccgtcggcaacgacgaggcgagtagccgaaacggggaggaggaggaggaaacggaggcggagggaggcgcgcaggcgtctgcgccgatcaggtcacggcgccgctctggaccctccggtacgtctcgtctcctctgtcctttgcttttaatctctccgatcagggaaggccaacgcgtccacgctacatactaaccctcgcgtaatcgaaatcagtccaaagaggcgtcaattcctaatccaattcaaacgggtggagaggttaaacctagatcctactccaaattccgcaagccacagccgcacaatccagatgcagtttactgttcagagctggtctctcaaagtctcaacccctttttctgatttttctccatgatccccatcctatccacgccagttcatcgagcagtagcatatttctatctacttctactgtgtcctattaacaatttggcggcagagctgactattcctttatgttcttcatttgggttgcttggagttggagaagagattaccccaccgtttgttccatgctgctgtattttccaaaaatcatgctctcattggcttcccaccatttctgcgcctgatcctctccaaagtgcttccgactgcgagattgaaagagttagttattgcaaaggtaagacatgatgccatcgttgacaactgattgattataatctaggttcttgggggatctcacctgaaccggatgcgcttgatgcacttcttcccaccgggggatgtaaccactgtcgcgtaaaccccgcgctcgatctgctcgatcacaccgttggaatcggtaggagcagtggtggcatctgttccctcggtgcatctggtgctgccgttggaagttcttctgcaattctgatgcgtaaccgagtaattcgccatggaagcaattgaaggttgtgtgcattccctatccacctgcctgctgttgtggtgatctctgttgctcttcgactgttgaaattcgctggtgaatacatttttgtcaggtgggtctggtaattctgcttttagtgattttgcactggcgatgtggctaggcatgattctggagttgtctaatttctcaccagccaaaaggttctttgataaaaaatcatgctgcacaattgggcaccccacacaacttatttagaaaaaaaagccggtaaatctgtcaaatggagataggtcatcggttttatacctgatcgatcaaaaccttaattatgtctttagcagctttgcacttcgcagcctcatccttggcaattaaccaagtctcctcgacttttcgtttgtacagctgaactttcaggctcctttggcggcactgttttgcaagagtagttacctgcttatataaaacataatttccatctttatcactaaattatacgttgcataccagaacaaacattcagtgaaaacaaataatttaaacagatccacgaaacatgtttattacagagaatatggtatgtcagttacctgctcttgaagctgtttcacttcttccaataatatattttccatcaagtctaattccgcttttgaatcattagcagatttgagcaaagagctggcaggtttaggtgccattgtctcattcattacccgtacaatagaaccagagactgtctgtttattcaatgttgaacaataaggaatgctctctctcacacatctgaattgactggggcactctactaggccccatcttaatgtcctcacatgatctggcacagccaaattctgacttctctgatgggggctttgtgctgatgccattttctccataattgcatttgcttccttgaatatgcgcgccaattttggcgtatatgatcttatttctattggacatacctcatccttttggatcttctgttgtggatctaattttctatgctcctcaactttctgcatttgactgaaacatgcatcacaaacacggtaccttttgctcctatctggtgcaagagctgctctggaaaccttgttattgctgcaggaattgcagaacatggaaccacagttgtaacagttgtgcttcttcctcgtaaagccaaatgttagctggcagttgctgcacacagattggtccttgcttgagagtggcctatgtaaacaaattgccatagtgaagttgaaaccacaagctatactatgcacctgcttgtcttccaaggcctcgaccagagtcgggtagctcctgtcaacatagtcacctaaaccaagttgcccttctgttcctttgccccatgtaaacacctttccattcattgtcaaaactgctatatgtgaagagcctgatgatatctctctgacaaactctgtcttaagtggcccctcaattaaacaaatagatgtgtcctcagacagagggttccctaatcgtccgtgttccttgcttccaatggtaaaaacaacaccggttattgtaagcacaatggtttgtgcttttgcacaggatacctgagcaaaatcaaaatcattgagtggctcaacacaagttggtacaagtttcatctttttgtcagcatgacccagcttccctctatccgcatcaccccatgtgaacagcttcccactaggagcattgctcttgacagtgcccattctttctacaatagcagctgtgtgccatggtccacacgcaatggccttggctcgtacccctttcagggactccacttgtttgggccgagcaacggtcagcgtgtcaccatgtccaagaacaccaaaggttccatctccatatgcgaagagctggccagcagaggatatgatagccgtgtgccaatgaccacatgcaatcttcaagattgagatgccatccaaaggaccaaacaatttatgtgggaaccattggcttctttgatactgatcaccccacaaacccaagcagtgagtcccttcaccccattcataaagttctcctgaaattgaaactgcacaggtgtgctttgctccaaatgcaatagccttcactcgtgtagaggcaagagactcgataattttaggatctgatacactgacactcactttgtgccccaatctcccaccattatccacaccccaggagaagacctctccctgcttagtaactatcgctgcgtgtttctctccacaagcaacgctctgcacatcaataatatgtgtcgtgtttaataaccttggaagtgaaacattggcttttgatacatctccatgatctaaaacattgccaggaacttctccccagacaaagatgtccttcagagaagttgctccatatgcaacatgtaacccctcagatgatttttgtttaggcagttgggtaattatttgctcgttaagtttgtcagcaacttttatatccctgcaactgtgttttaccctattaaccacatcgggagtgaccttttccatgtagtagtctaggtctgaccatgtcctctgccttggagagaagaatggttctgagaaatccagattgctttgcaaaacatttttctgcatcagcctaggactgccatatattgagtgtaccttgatggagaaatcatgtagaaaaacatgtcatttcaactaaaaaggtgaaacacactttgtaactgagaacatagggcaacttatgaccaatcgtaggtcgtatcgctctacttagtttcatgatttgcaagaaaaaaaaagaggtgtcgcttatcatttatgcaaaagtctgtcaatgtggttgtcatttagctgtatcattattgttatatttggataagaactaattagttgaaatgaataatatttcaacacaactagcatgaccatcatttgaaatattacatatttacaatttcctgagcctatggatcaaatcgtgttacttagcataacttaggaaaaatcaaaacacacttgtagttgtggtaagttgcaaaattatcacatagaaatcacagcatgcacaagttatagaatgaacctgtttaaactttcttgtgtcatgcacagcaaatagcctactcctttgctgaatatagctaggagggctatttgtacagctgtttatccgacggctacttgttgagtcaatcaaaagtactggactgcatggaactgatagtaaggttgttaggcctatataccaacattcagcttgatccctatctttgcaaatctgcgaaatgtgatttagaaaaatgttacggaaggtaataatgtgaaggataaaatttacaaagtctaaacaacaggcctagtgagtaaaaataccaagtcaagtgaacattcaccattcttgtagaagactgacaatgagtgggattccttttctggccaatgcagacgtaaaagttttgtctgtaaaatactagaatcctcagaaaatgaacgtgttctatccttaatgatgtactatggacaaagaatagcaatgtgcttgagaaatgaaaaccacatactgtcttatgtccaagaactacacttgagacagagctcaagttcaaacgcttttccctgtctttggaataccacatgagcattttctcatcctgcaaaagaagcatgttaatgttatttagaggcacagcatcttgaattctaatgttttaaaaagataagacgttaatgtgcagtttactcaatctacttatctgaactggatacgttccatgggaactgggaagaagtagatattgcagacctaattttagaatatttaatattcaaacatcataccttgttgtgttcatagtgttacaatcttctctacattacggaaattgaattgctaatttcagaataaaggatggatggtgggagtgcagagagctagatttggagtaatctactgacgtagctgtatgtatggccataaatgttaatctcattgtgacatgtcatctgtttatcagcggtgggaaaacaaggaacatctttgaaaggttgcggaggaacatcgtgagatcttgatatgcagatagatgaaggagaagtggataactgggcggaattcatctaagagttctggtcatggctctgctcaacggaacatggtgaagaacttggaagccaaaacaaactaagtagcatcagttaatttacttggcatgagcttcatgcggacttaatttttatttgtttaattcaagtggctgaatagttattatacttcttccatcaaagttccgtgcattaagtaaataagcctgtaatggagtcattcatgttaaatgttcagaacattcagattaacacaactaaataaatatctcataggcactgaacatatgttttgctacatgtctctagtcgtcactaggttgcatgcgtaatccatgaaagttaatgaataaaatcgatctttagcatgctgctaagcataattacagtaacgaagctactcactgaagatagcctgaatgggcataacttgggcttccctctcttcccacatttcaggagatgtgcacccttcttcagagcaacaagcgcctgaaggaaagaaccagaaaattaaatcgcgtaatggaggaagatgtccttttcaggtttgatgtcttctgttataagtgaaccccaaaaggatacagacaagaaaatgaaatgacattatattaagcgcatttggaactttgggcggccacagaagcaaatgtcatgctcactcaacatcttggaaaaaaaatgacgtgcatatagcttactatatcctgaaaatgaaataatggtgtctaatactttctcaataagaatgcagtgtttattggctccttgaagacaaacaagaagagcaaatccatccaacttagcaaagatgcattgttggaattgtaggagagcaaaagaagaatcattggcataagcatgaatataccacaatgctttaaaagaagatgcaaaagaaaaacgcttcatgttgcatacctgctcgactcctctagctgcagggctcctcccctcaaagctcccagccattgcagccaggaaagacgcagcaaaagaaacggagagcgatgccttgcccctgagctgagctcaagttcaaacctcctttgatcaacagtgggagaaagcaaaagatggcagcaaagtgacagaaagaaagaaccacgcaaggaaagaagcaaagcaagagagaggacggacggacgggggcagagcttgaggacggacggaggagggagaagaagcagcaccgtcactgaaggcgacctgcgcaattcaggggccccggaaaaggaaacggtggcaattttattaactgctgggtttaaagatgagagaggcaggcagtcagtcttcgttcgacacaacctgcagaggtaaatcctgttctcccttttgattctgcgcccctcgctttccgtatattttctcttgggtagtgctagtgcggcatctctctgtagtttgtgacttcgagtgtaccgaacagcagtggcatttagctttcctctgttagcgtgagtaggcgcttcagaaatcttggatttcatgtcaaatctcaggatttgccacaactgcatgccacaagccccggaaaacctggtcactgccttccttttccctagcatctcttcatcagtcggtacattaaactacctcagttttgctgaaaatcttgcataattggatcatccgatctctgattaccatgatcagcatttctcaaagaatgcatcgaataacagaattactccactaccgtaacaaccttacattgtttaaaattcacgggcatccgatctgtctagggtggccagttaaccatccttggctccttgcccagctgtggtccagaaacgtggtactagtatcgtgatcatgagtttggacgttttagatagtaatgaggttggatttgcagaggcaagcatccacgcactgctgttaggattttgggacagcacatgatggtccgaaagaagagacgatggaggggggtagtgatgcagcacgtgtgcagcgtaggcaggcgctgcccccgttctggcctgcacaactgtttggtcactcctgtctgcaaatgatgccgtctcggtcgcttttgctgacttgatcttgctggggtacgttttttctctccctttttctccaacgagcagcgatcgtgacgtcttcgtagctcataatttcgtattctacctttcgtctccccagtactgtatgtatcagtatcactgcctacaaatgtactatgtctaccggtgctacgtgcatttatgcgctcacctttgctcacgacatgtctattcattgcgcatttatcctattgcagtcgtactgtgatcagttgtactgctggtgctgctttggtcgtgtgcatccccaaggattttctgcggtgtccactgatcaggtaggagttgaattcgtcaccttgttctcgcaaaggttagtgttagtgtttttgcaagggtagattgcttattaacaccagtggtcatggagccatggagatgcttaaggtgacgatgttgttacagctggaagtgaaaagatggatggtggggaagaaaaggtagagaaggcaagtaggcatgtgaaagcaccaacgagacaagcatgacgggccaagggaaaagataaaacttgtcctgcctcctcaacagcagtaaatgtgttgatttgttccccttgcatttcccgtgtagcgtcatggcattggcagtaactcgtggacgatttctctagcgattgttacccgctgttcatgctcaaaatggcaccataatcttatacacagccctactcttgttctgcagctatttgcacttgttctgcacctacggtctcaaaaaaggcatatttgtatgcctcctacacgggtaaaaacaggtgcagcaaatagtaccagtaagtccaaattaacccttttattactgtggatgagacaaaatgtaggagctagctgtctgctggcatgtggagtgactggaaggcatggcatgtgaaacttgtgaagccatacagtacgaagtaggtgaaaaacatacacatcccctcactgggtataaagtttgatttggcctaaattgaggccggtggttgcgctactcgtaggcacgtactacatacatcgggcacggtcccgaataattgcgtcaaatcggtcgctggtgattggcacaatggcacgtactaggagtacgtcttgctgagttcctgtcatgtgacagggttctgtgcaactcggtgttgttgtgatgccattagatggagaatttaggacgtaatgcctacgtgcattgcaccatttactttctgtaagtgcatgcacctcggcggaacctttatgagaggttctctctttggaacatgcaagagtgaattagtggacaataatgccaacattggttaatttagttagtccatgtagctcggacacatgccgcatccatggctgatggctccaccgctccatgtatcaaattggcttttcgtgcatgcgatgagttgctagtctcctcaactctctcgctcttagaaggattatattgcaattgtacgtttgtatccattggatgcatacacgcgcaggtgaaactttttttttttgaaattttgagcagatgaaagtgaagaacagcatgcaatgcaggggctgatccgtgatctttgtacggagttgtcaaaatgcgcctcaaagctgtccttggattatacacagatacacttactagctgtgtccacgcataaatacatacgatggcctacgcggctgtccatgtcctaccatcttaggttcacaatattgatctgttagccatgtaggagtaagactctgtttggtttccaggacttattccaagtctctgtcacatcggatgtttggatactaatttagagtattaaacatatactaattacaaaatccattccataagcttggactaattcgcgagacgaatcttttaagtctaattacgccatgattttgacaatgtgatgctacagtaaacttttgataattatggattaattaggcttaaaaaatcgtctcgcggattagctctcatttatgaaattagtttttttattagtctatgtttaatactctaaattagcgttcaaacatccgatgtgacatgggctaaaaagttttagtcccatctaaacacttcccgaggagtagggacctctcccagctcatgacatgcgtccttgcttggagtgtgtcctagcggtaataattctatgtcaaaagaagcaccgctggagtgatcagagaactgcacgctctcgctctttgaagcactgcatgcgtgatgcgtatgcgttcgtgttgggtcccttctaatgagtagtgatccatggtctaccggcaaagcctagtactaactcgcaccagcataatcttgatggtcttttattagataacaagctactaggatacatctttgatctctgcatcatcagtaattcatataaccataatctcgatctgtgcctagcatcatctttgattctttacatagaatccacattttaacgaatggcattcgagttattaaggcctacaagttcagatgggttgcatgctgggtttacaaaaccgcacgattatcatgcggttactatgcatggtaacattttcagtttttaaaaccatgatatgtctcgcggttaccacacagttttcacggtaaccgcgcagttaccacggtacgtaaccaccttaccatgggggtgtgataaccgcgccaataacaataagggaaaccctggttgcatgcagagtacagtagtttgagcagcagcatgcatgggaaaggaggcaaacaatgaggtggaaaaggagggacacggatgatggccgcggtttcccgggcacgggcacggccacgcgtgccggacggggcgtgaacagaagccgcgcccgtggtgccgggaaggaacagcaacagcctggcccggcatcgcccgtaaatggagagtttgggtacttgggtgggtcaccggcggctggaccctcgcatgtgcatgtggtgaagaaaatggagtttgtttgtgtggtctctgtacttgcttgtatggttcgtgcgtgtacatgccgagcaccctggttgctcggtgaaagctttaattggatcacgcgataattctcactttacggattgatttgtatataactactccatccgatttcttaattcttgattgatatttatcatgttttagacctgggttaggaggagaggagaaaaggcatcgggtgcatgagaaggaggcggagttctgattgccgtgaaaaaaaagacatacgtattagggaatgacctaatatcaaataattagaaggagtgaggctttaaactcagatcgtatagcccaccaccttgtgaagctagccggaaaacccctgggcgtttctcatttagatcaccaggataccagccaccttcatccacctagcagaaatgaatgcctggtacgagttagggaatccgctgttgtcttcttcctgatgcttcgccttctcaattgaccttctctatgtatgttttggcacgcgctggtgatggtgcatgtgggtagtgggcggcggtggtatcgggagaggaagactgcgacacctgatcttgaacaagctgtcgcctatcactgttcatggcactggcatgcatatcctccaatcctcgacccgtggaaaggtggtgcacgaccagtgtggcacacaggctgtgcacatccaactgtcgtcccacccaatagaccctgacgtcagtctccgtggctccctttgcaccgagctcctgccgtcagtcgttttcattgtcccaccgctaggtcttgcatcaacttaccgctccatccccatggcgcaagaagacctccttatggcccctggtcacctacaccaccatcgcttgtgctattcctcggctcgttatcgaggaggagcgacggcggtgcgcacctcgtgcgagaagcacactactaggaaaaccattttcgcaaaacgagacccttccatttttctaggcgggtatcattttcggaactaaatgtcctcctgtgaaaacggcaacgggggatgggatgctcgtccgcctgtgaagatgcattttggtagacagacgaaaatgcatcttcgcaggcttttgcttacaggtggaccggacggccggtccacttaggaaaaccgttttcatccgctggaaaaaatagttttcctagtagtggcagatacaaggatgggatcccgtacttttgcatttcctataggctaacacctttatcatctctaatcctagcttatagcaacacaattagtagatatgggatggatagctaggtagagagtctccacacaaacaaattttggttgcttgtgggggtgttcccgaggcttagagggataaccgaagtagtggcgaccggcggtggtgatggtgaggccagtgacaactttgtagattgggagagggcaggggatgagtttggtggcaggagaaaagggcgccaaccagttagggctggacgtggtagatgatggcaacgctcgttgctggaggctcggagcgatgattaaccttcttaatcacttcggtcattaatcatccaatatatgtcagatggcgactacaatgcagtgtaacgtaggaagactaattcattaacaaatattgtgtgttcatgtatcaccttatctgacgtgtcttgagtgatcaatgactaaagcgattgacaaggttagtcgtcattcgctatatcagctgtggtgcgggggaaaatctggttgcccaaacaaagctcgtcagagggaggctgtggttggcatccgaaggtccaagaggaattttgattgaaaaaaaaaaaaagagaagtgcacaggtccgagtgaagtccgagtcagacacctcacagtagggcagacgaacgtgggctgttttagacgcatttgtgcgtgtggcccggacacgcgaacattcgtgcattagcccccaacccgtgcatcctgcctgcctgcctgtgcacgttctcactaaagccatgggaccggcaagcgtcgcatcctctttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatatagttgtacacactggtacagtggtacgtgcctacactgcctgtgctacgtactggctgccgggggtcggtgcaaccgtgggcggcgcgccaacctgtttcgaaaaagtcaccactagctcgaagcagagggaatcgatcagggtgttttttttttttgaaccatcagggtgtatcacttgcacatactccatcgtttcttcttatattaaaaaatttaccctggctatgaatataaacaaattagttttttctgataatactccactcagaattattcatccagaaactcaagcacgaaaaagacaacatacataccggacattagctctttctaaaacatatataataaacttgccaaataaaaatcaatagtttgactatgtcgagtatgagtacagattaccccctctgtctaaaaaaaataaatcaaactctaaattaggtatgattacatattacccctccgtctaaaaaaatcggtttgatttattttttttagccggagggggtaatctgtactcatacctcgacatagtcaaacttagggtttgatttttttttgacaggcagtagatgataaaacgaagaggaaagggaaggcagaagcagagcatagaggactccaggttcactgtggcactgtgccatactgtacaactgttatgcatggatcatatagttgaagttcagaacaacacgtcaagcaagtactgtaaaggcgttcacagtgcaacaccaaattttggtgagcctcacgtgtcacctagactaagaacaatattagctacttgttttcacagtgcaagttgtctatagtgggtcctactagtactaactttatcactttaccaccttttcctctccccctctctctcctcttctcctttccccacagcaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcgggggcccgcctgcaaatgggcggcgagggggcatggaattttgcaggcggcccccttgccgccctgggggagggcgattttgtactgtgctctatatttttttatataaatatcaatagttatcaaatctttttatattgaaaactatacaagattaaaatctccaagattggtaaaatacaattttattattttttaggccatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtaagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctgacgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacacgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacacc

SEQ ID NO: 79631 - DNA, 1752 bp, Oryza sativa
agaaataccaacaagcatttctggcgccgttgccggataactgttgttaattttttggtcatcctcctatctttatttttatttttggcttcttttattcctttccttgatggagcaacccacaattcaaaatctttctgctcctcgggctgatctttgtattcgcagaacagagtgcgtatcggttgcggaggcatcggctgaagtctgcattggctgaaatggatcggacagaagatagccgatttcattgagatggttataaaaccgtttctggacggctgaaatggatcggacagaagacagccgatttcataaagatggttataaaaccgtttctggaatcgatcaacgtgctacacaaggattgccacgatggagataagctctcagatatgcaattgtatctattaattatgatattttaaatagttccttagagatatgtttgggtaagagtctgccgtaaagacttatgtgtatcttagagtttgctagagataagagtcgtgtccggcaaggacctatcatgtatctcgggtataaatataaccctaacccatgtaattaacaacaacagttcaataacatttttggtgcatcgccaccctttttacttgctttcaataacagttcaataacaacaacagttcttgctttcgggttgagctgcatcgatttcaatcttcaacaagaggtaaacttgtcatggcggcttgcattctcgtgattagtgcttccatctttatgacattctaatcttgtatatgtaaatcgtcgagttatcatatatgctctataatctttattagttgcgccatctaacctgcaatcggctggtttctactgctagagagtagccgatagatctagattttggtattaatctagattatatagcatattgttgatgtgaaaaggaataagttcaccggaggtccctcaattgacaccgagattttttaaggtccctaaactagaataccagaaatgtgtacccctaaaattactaaatccgtccgtagaaggtccctcggcagtattgactcagtttttgcccggttttgctgacatgtcgcgctgtgggacccactagtcagtccgccgttggggagttaatagacggggttaacggaggggagcgcagctagccagacctccattctctctcctttgctcgaactctagctgagctgcgaccaggaggcgacttgaaggcgacggcgggtttgtcggcggcggcgagctggccatggcgctggcgacgagcatcgttttcgtccaaacgcgtggcggattccaccccggttagtaccttgttggctcggcattgcgtgctattgtagctggtactgtgttgattttgggggaagatttaaaatgtggtagattcgttttttgtttgggattcggtgtagaggtcaagtagtatattgtcccatatgctttaggtgtagtaatgcttttgtatacccatgtgaatctgggtgggttagtgttggggtggtccttttttaatcggtgttaggtgttaactaggtattagggatctggatgtagtgtagttttaatagtagagtagtaaagtgcttctttttttaatttttcagagctggcagcatggatcccttcggcactctagcagttaggttccatttcaatggggaatttgttaatagagggagacagaagttgtattgtggggggagagaagcaatgtcatacatagacagggataaagtgtcattacct

SEQ ID NO: 79632 - DNA, 629 bp, Oryza sativa
agaggaacaaacatcacacaactcttggtcaaccctagtgctcaagatcgagtgaaacacacactaggccctcaaaccccaaatccacaaccaccaagatcgaccacacaaagaacaagaggggatttgagagagggagagagagctcaaagatccaaagcaccttagcaccaagctcaacccaaagtgaatgtgaatgaatgagttgggtaaccctagaaaagggttaggtggggggtattcatagaagcccccaaaatgtggccgttgggagagaatcttttcatcccacctcggaaagtctgaggtgacatcggatagtccgatgtttttgacccccaagcaggccagagacagagaacgaaattctagagaatttcggacaatccaatcgatcggatagtctgatgtcatatcggatattccgttatttttgaaccaagaatttcatcctctcacagagactcaagttccattgaatttcttagtctctggatcattagatactccgatcatatcggatagtctgatttaaaactcactcaaaaggaataaaaagcaattcaaaacagagagtgaagttctgagaaatttcagatagtccgacgtatcggatagtccgaccttat

SEQ ID NO: 79633 - DNA, 4597 bp, Oryza sativa
atatatatatatatatatatatattgacggagcgtggggctcctcaccgggagaccgcgcaggccccccctttaccggttcgaccgggggcgctgagtgaggttcttcaccctcgatatgtggaacgttcgcgagagagcaaatgcacaagacacgggcgatgtatacaggttcgggccgctgagaagcgtaataccctactcctgtgttctggtggatctgtgtatgaagaagttacagagcaaatggagagccagagagttcaagctctagaacccctctttttccttctcttctggttctctttccctcctccccttaggtgggcaaggtcctccttttatatctcaaggggataccacatgcactactttctatctacccttcttttgagtggggaccaaccctatcttcaccaaatcttcgactcgcgccttcgcctggaagctaaatcaccgcttgcccttgagtgatgcccagcgccgtcactcgtcggacacaggggatcactctgtcatttcttcattaataggaggagatctacaatggccgctgtctgaatgaccctccgatgggatgggtcatacctacctccactccgccggaagcagatgcaacgtgggagcacggttgtctgccgatgacgtgaccggcgtcagtccagtcacagaccggtcattcttctccaccacgtgtcagtttagcatgccgcacatctgcccttcttcatacagtgacttccttgcaatggttgcgatgaagcctggcatgaatcgagtcgggactgacgtgctaactccaggagttaccacgccggctccagctagggacgagtgccaagaggctctcatcattccgacgggacggggcgaggcgtgtgacaggccgcctgctgccacctaacccgcgatcagaccgatctgtgaccggtcacacactgcgaccggtaacggaccggatatgtgtgcgccgtgctgcattaaatgcggcgtggcgcgcttgtccattctgcaataaatgtggtttggtgagcgccgctgtgcccacctaacccacacacgtggcgccaataccacagggggtcgtggcgccccagccctcggggccgaaacaggagcggctcgaccccccgagggggtcaggccacgtgggtgactgcggctgcccaagcctctagtcatgatactcccggtcccatgtcaccgacatatatatatatatatatataaagcctccaaaaacccctctctctcatcctctacacaacacacgcgtgcgcttgccttctacacgcacgataatgcgatgcaccagatcgaggcaactaagtgatttcataaggtgattacgatcaccacaacgctaccagtttgtcaaggtggggacacatcaaattatcgatggataatgattgtttgttaataaagtgaaaacaaattaaacgtgtgttgcagaaggaaattaattaagtccagtgggttaagtttttgcagcatgcaactctatgtaagctaaaacaaagggttgattacccaattgtagttataatacagtggagtcttcctgtttttcctttcaatctagattttggattttcatttgcacgtttcccaagtttctaaatgatgcgtttcgggaaaacaaattctatatattttgttcttaaagcgctttttctataacagggtgaaactagaacgtaaattaccctatgtcccgcacgtatataatatgtagttaatgttctagccacatgtacggttaatgaagaacatgctttgggcaaatcattttgtactctacgaccatggatgagaaaggagcattgtggtgttgccctttatgttaactaaacaaatagacaaatattgtctatatgactttcacgagatgattggtaagtggaggacactactgagcaatgagtggacatagagtaacgataaatagcgtatagctatatataagctatggcatgatgtgtcactttttctttgattccgagtaataacaaaggcaccagtaagtaaggagaaaaaaacaaaataagcaaaccattgtttttaagtaatcatattttttaactaagttttgttaattatgatgataaatcatactggacttattgattataatttacatgataaaactatagtctttgatataattggattacatgacaagagccactttactacagaaaacttcaaaatttataagtacactacacatactaatcaatttatacaatttttgatattttgcattaccaaaccaagcaattgtgtgggtgatatgtatcctaacatacctttaaagttcttcaaaactgtggaagaaaaatgaaactgttgtacttcgacagagtaaaaaatatacaacatttaatctatccttaatttggttgtcactatatcatgtgccttcatgagatgattcaatccaaagaactttgatttccttggtctcacaagttttgcttatagccatattacacattatgtgtacggatggtacaaatgataattagctatgtcagtttattattaagtcaattcaaaagtcatgccaccttaatacatcaactattcaaatgtcgatgaatggtttttaagatgcgtgtgaccttgagttgcccttaatttatacgacatatatcctatcttactataaaattatcccccactaactccttaagcttaacatgcaaagatgccacatcatcatccactaacaagataccacatcatcattcactaattaacaagatgccacatcatcatccactaacaaccatcacatttaaacatcatacaaacatgctatatctttatagtttttaatttaatttaagaacttttcaaatacaaacatgttaaattatcatccaacataattcacataatatttcaatgtatatctttattatgttttatgatatcctatatacttatatagttcatcctcacttagttagtgcttaaatgattaatctatggtccaaattatctttctcctttttttttctctaattaagtcatatcacatcaattgtttttagcctttagatgattaatctacggtccaaactatctccctacttttcttcttccataaagtcataccaccttactttttatgtttgaatcaccattctacatactatttaaatttaagttatcataaaccatattaatttacttaatctgatattatctagctattttacacgttatttttttattgttatcatactaaattcccgcagcaatgcgcggggtttcacctagttataaacaaaatataatcttacatttaaacaatattgatgcccgtgcatacacgcgggccaccttgctagttagtttaacaaagcagaagcgtaaataatatttttattatatgagcgagagaaggcccaacacactagggcgaagaacataggcatgagcggacttcaactagtaattaaataatacttagtgttctgctctgaccgattccagttaagccaatcaacacctaatcccattcggctagtttttttggaagggcgggtgatcgtggtgcgcaatcggtccacgcccgaagcgcacacgactcccgccatagctccgtcccctccgatagtgcaacttataacaaatacttcctccatcccataatatagtaacctaggactatatgggacatttcataggacaatgaatctagacatccttctatccagattcgttgtactatgaaaagtcttatccagtacaagattgctatattatagggcagatggagtatattttagattaattttaaaaaaatgtttaaaacaaaaaaaaaatcaaatgcgctaaaaatatacatgggtatagactttatacatcgaaatttatacattgtaaactttgcaagtacaaacctttttaataataaaaatatttaaattcatatatgaatttgaactggacatataaacttttgactgtaaactttaagtgtgtaaacttttggaatataaagtttggatgtggcttccctgttcctctttcctgttccttgccagatgactatcacttattggtttgtattttctagtagcctccacacccttgcgcctccttctcagccacgtatagatagccaaaaggcccgaggcccgacggcccggcccatggcacgtcattttggcccggcccaagcacagcacggcccgacggaggtcgagcccgcgccggcctggcccgaccaccgggccgtgcctagacccctctaccgacacgttgggctggcccggcacggcacgataggctggcagccagacccgatacacaacaaaataggggagtaaaaatagacatattatatgccatggacgaaagaatagggatgtgtgtatatatatatatatatatatatatatatatatatatatatatatatatatatatatatatatatatatgtcagcccaaagaggagggaggaaaaatagacttattttaaaaaaggcccaatgttccacccgtgccttcgggccggtacggcacggcccgacagctggtgggccgtgtctgggcgggaggtgcatcccatgggccgg

SEQ ID NO: 79634 - DNA, 8556 bp, Oryza sativa
aatgtcagatccctagaatgtatagtttagtaacttgcaagtgtaaattgtttctatacttaatatattaaataaatcaattgaacatatagggaaaatcagtgtcatattgctgaatcggcctcccttgatgcaatccttgactttcttgagtcagtaacagaggagtatgaaatgaagtatgtgtggatgcatccagaacagcgctatactctgatacgtgtaaaaaagcgtggttattgggaacctctagatgatcctaaccaagaaaaagtaatggaaaaagatcagcgacaataatcaacgcaagcagtttcttttaagaaaaacgattatgtgatgagtataccattactgtatgtatgtactggttgtggttgtggttgcgctcgcatctctacaggttgaggatgcggtgattgggctgagacatcattgatcttctttcttttcctccgtgatgaagctctgtctaagccgccaataggtcttgctgatccacgaatttcctttttcttaagtttaatacctaatggcttcataggcttctgattttctttcgcacctgcaaagacaaattacaacatgcatatttcaaacaaaaaatatgtgtcgggtctcaaaactaataacttggatccgactgagattaatgtaccaatccttggatcagtaaatattgatacatgtaatacaactgaattttcattgcatatgttaaattttacaatactatgggttttacaagagtaggtactcacttaactatacttagacctaatgttatacaacggaaactttaatatattttaactaggaatgaataaactctagggattttctaggttatcggggtcatcatagtaatagttataggggtccttctcttgacccaaatctgaaaaaaggagtaataggagcaagggtgagtatttgcaatactcagcaagttattgtggaaacatgtcatgcattggtataagtatggaggggttcttttgcacaaagcaatagtagacaatctggtcaattaaagcaagaatttataaaataaattattcaagtttctaaccaaagtaccatatgagtcccgatgctcaaatccgtgagcacggctattcaaatagtttcataatcattctattgcagtagatatacgctttacccgcaatccatgacttgccaataaacattagcttagttatgaccaagtcattaggttactaacaacagtggcacctattccatgaactctagtccccatgtgctttgaacgtacgttatcagcaatgtgaagagttctggtgtttccggggtctttagagaggattgattgtatgacactatgtcatcgcaatcagggtttaaataaaattttcccttgctcgcatagcgcgcaatatatttacccttgctcgataaatataacattttccctcctcggcataaacttgcctcatgctcgtggacttaaaaacaagaaccactatacagaggtaccactttgttaattaacataatagctaggtctgtaccaattcgagaactgcggtcatacacgttcgtttgtcacaagtacttggtaacatttatggcgactgagacagtactagccacccgaaaatcaacccattcttacgtactgtctcaatctaagtataaagcattttaatcagattgtaagcaaaataagcaaagctaaattatctgggtttctatggttgagttatgcatatataaaagagaatatttgaatagaagggctataaataaataatttataaaatataggcttaaatgagcaagaggtgaacaataacttgccttgctcgatgtcctaagattgactaatattatctagtgtgtcagaaaaatcctcaagacctagggttaaatatataaaattcaaattcaaaagggattcgaatgaagtccaaaaataggaaaaaataaaataaaatgagaaaatagtaaaaatagcctcaaaagatagagaaagattttagaagaattttggtccaagtttcactagaattggttttatatttcaaaagatatgggcttctaaagattaggatctgaattaaatctagaaattgtgaaatagtagtgtgctggggcccacctgtcagtaactttctttcccttttctttttctctccttctttccggaaatgcttatcatcatatgtccgggcaaggaaaaaaaatcggacaccccaacagagtggtaggtgcatgcagccagcatgcatgcaagtcggatagatctaaaatttaaaatttaaatgatcttttctgttgaactatttatccgaactatgaactaattataccattagatttgtgacaattaactctttataatgagatctcatatgactatgttccgatgatttttttattccaatgtttcaataagtatttattgttgtttcactgattcatttataatgttgcacgtggtctttttatatgtttcagtaaatatattttttattttttaaaaatttcaacaaaataaattattttcaaatatgttgtatcatattttttatgtttctctagttgggatctaatgtttcatgtaatggtggttattgttgcagtctgtaaattttatatagttattgttgcacgctatatttctatatgtttcagcaaataattttttatgttttaaaaattacaagtggacgtttcaatagtgatataaattttaacaaaatcaatgtttacaaatatactgtatcatacttttttttatgtttcactatttgggacataatgtttcatgtaacataggttcttgttaccgtttgtaaattttataagttacatatcactggaacattttataaagtgggctaaaacattcgcatctatgaatggtgcaacaaaaggttgatttttctagaacacatatattttcttaatcaaaatatattcgtgtaagatcttcttataaagatttaattataataaataaaatggtataatcaaattatagattagatacatattttagttgaaaattttgtttaaaatttgattaaacaaaaagaagagagagagaatgtagagtcaaacatatatgtgatgctgtgccaaacctctgtcacccctaccactcgctgcaccgctacttctcgctgcaggcatgcacacatgcagtatgccatgcaaatagataggcagagtgtgagcggcgtccgatatttggagaaataacggacgtccgattcctagcttgctcgccttctttctctcgtcttcttctttcttctttcttcttccagccgagcaactgagaggagggggaagaaggggcgccagggctctggtggctgggaggcggcgacgccggcggccggtggtgtttcagggagcggagcacctagggtgggcagtggccggcagagggagttaagggaatggtcggaacggcgagagcaagactgtgaagtgtgaaccggcaagagagagagagagagagagagctccggtggggcttgacatgggacgaaaaagaaggggaaaattggaaaaatgggttcgccggagtgaggcaaggctggtggtgagaggatttggttagtggtgctccggtgagggagatcggccgatggtggcggcagctggtcttgaggaagagagataaagacagagctcgaggggctcggattgtgaggaaaaagaaggggtttcgccggctatttataggcggcgaggggcggtggtcgatggcggttcaggaggaggtcgacggcttggccacggcgacggcggcgcaaaggaagaggagatggcgccggctctgtactccgattggatgtcgatggcggcgcgcacacgtggtggctgaaggggatttggacggcggggagggggagcacggcacggcggcggcggcggcggcgcaaaccgtgggcggcggcgctcccatggcgcacggcaacgacggctgcagcgcgtgtgtggcgtcacgcgcgcccacagagaagtgaaaagaggcggctgcctcttggaccgacttgggccaagacagggaaaagggccggaagggagagaaacggatttcagcccaaatgaattatttaggaatttttgaatattttggctaaggagaaggaattaatctaaggcctttgaaatgttttgcaagggttttagtactatggtaaggtctcacaaatataagggtgaactaaggaagttctctaggttttgaatttgaaagaaatttgctagaaaataggttaagggaattctaggggcaatacttgaaccaaaatcaagaataaaaggggaaattttaaaaaggattttgattttgctaaattagggttaaaatcaagtcaaaagctagcatgatgcgtcaaattttaattttataatttgaggatattacattgtgatccaatcataggactaataattactttatagaattgttaaacgaaccttctgaagacaagctctctaaatctggatttcatctaatttcaagcatttctctatgtcttctgccaatttttcagcacaattagtagatatggaatatgtttcttcaaactatctgcacaatgagaagtatcaatctgataactttattctattatcatcatgcgtgttaccactgccacttatatgtagtacttttgcatcaattgtccatctttttagtatatacatttgaggaaccgatatgatgttattgatgtcaagtactttcagggcatgagagcacaggatgccagcaaattcaaacttcttgcagctgcatttgacactagattccaatggtgagaatttaacaatgagtctttcttaagtgcagtcagcataaagctacataaaggtaggcacgaccaatgagggagcgccacccgtcagctgagtaaataatgaggttaatttaccccaggggtattacggtcatttggacaccggcgtaaactctaatcgttagtttactctagtcgtgattccacaccggaggaacgtacgcagtgttagagttcgccggagaggacaaaggaatccccggaaagctaagaggcgagtggaatgttcaattatgtgctagtttttatggtttacgctctatatcgcgccgctattgtagatcgcgtttagagaaagccattgcatcggcacacgtaaatagtggtacaaatgatctaatgtagaagatcctagctaaaaccaagcaattgtggttacatccgtttacgttggtctacaaatagaaaatacaaagtacatagccacataagatcgatagcactcctctggtatacaatatgagaacgaacaaattttatggtaggccaggctcacctaaatttagcaggtaatcctctcaaccgtgtactgaataacgataggagtaaatcccaaggtcagtcaattatgaagcccattttggcagtaaccgttttatataatagtcctttatatttccactattacaagccaaacacagcatcgattttattgttagccccttattattatccaaaatattgaaaatgtgatatatataatttataattttgtcaaggtcttgtcctcgggtcaccaccatccacagattgcggacgtaaacacatcgattctactcatacgttcaacgtgcctgtttatgtgcgcaatcccatggtgtgcgtaaaccatccacgtacgttgtgaacgcctagcgttaaagccttgtaggcacgggcaggggtgaaccttgtaggcacctagcgatctctgcgtacgcatagagcgtgcatgactcgcgaaatagcatatcagccatcacgcacgtgtaaaccgtgttgtaggcggtacgctctatgtacgtttttacatctgaaatcctgacgtaggcgtaatgcacacagctcgggcacaatgatgttgtatgggcgagacgtgcgtgaaggtttacacgtacgcgtgctgggatcgcaagttgcctacatatggttcatgtctgcccatgcatcgtggacgtaaactccttcttcgtgcgcgtacattaacctttcgagagtagcatggatgtgtttacacccgagatctacacatgggcgtgtagcatgtagggcacctcgcgatgcccacgtacgcataaaccgcgcatggcttacgccgaattgataggccggtccttagtcgtaccatacgcatgtgcgcgactgcaccttcctcgcggcctatttccctgcatcctgggcctggcttgcacgatgggcctaatgagctgatgggtgctggctggctgggctggggcatgggggaggggtcgatacatccaacatccaaagtacttaacaccagaaatatataactgctagttcaactatgtaaactacaatgtacttgcattttttctgcttcttcctcggtggcaagtctccagatgaactgtcgtcctcgtcctcgtcttcgtcgtcatcatcatcatcatcatatgatgcgagcggaggacttcatgttggcatttcagtcgtccgatatgtaagcgcagggggatcgcgagttgcctacatatggttcacgcgtgcccgtggatcgtggacgtaaactcatcattcgtgcgcgtaaattaattaaccttgaggacagggaggacttaagtgctcttgagggttgtcaccacctttacacctacctcaaacgatatgtgggatacgcagtcactggaaattaactacctaaacaccacgtttaagcaattaactattactctagtgtttataactcactaaagtgatcactataaataagagaataatagtgaacaatgatccagtatacttataggaactaaccaagaataattctcataaagtaaatcttaattacttagaaggatattactattaaactagagtaattaaaaaggtacaaaaataagaggagaattaccgacaactctggaattcctccgacttcttctaccttactctatcactaatctagtatataataaagtacaatagagactcttatagttcagctcaaacttggagtgtgtgttgtgaagtgagagagtgaagtccttacataggcaggtaatgacggttataacaatgtaaaatgtctgaatagccccgcaaccaccagcaggacatcatctggagcgttcatgccaaacctcaggatcaacggtggagatcagggttcgaccaaaccctggcttggcccaactggcccaagatttggtctgggcctcctcgtaagtcccttatccatttccatagtaccaactcatgtatggttgaatttcttattcagttaagtcttaatttcctcccaactttgatggtttattacatgcatccaaatatacaccaacactcgtggaatatggtaaaattaaatcctaacactatgttggatgtttcattatctatatattatgcgggtatcagcagcataaaattggcatttaacagccgccaatagtaagttacttttatcatatatataaattactttataatgctctaagttgattatttttattattgttttataagtcaattctttaatttatggactttaaatttaatttttacataggccatatttttctctctacaacgaatttacttctaatgttgtaactacttaccttctttttgtgctaagttacttttatgattgatgtaaattacttttcgactttattcaatttacttttagactttattaattttactttcataaaagcattttcttataaatcttctctacattttacttgtgaatttactttacatggtttcttattttaactcagtcacaatataattacttttactacattacatagagttacttatgttgcatagctaaattatttttataatttaaataaattatttttaaattaataaattattttaatatattcaacatggttcttgttttgtagagtacaatgatacaaatagatattgaaaataatacgtgatttaaaatatataagttatcaaataggtcaaatctaaaagtaatgtatatatatgataaaagtaacttgcatctataataaaagtaatttacaacatagatttttttatgagaatataataatgtaaaatcttgttgtaaagatttaattgtaacgaacacaacagtataaaaatgcatggactattgagtgtactagtagcaaccaaagtgaggttgccggatatgcctaaccagtcacgttcaaattttatgcgtataaatttacctaaaaaggaaaaatattaggtgctaaaaaggaaaaaactaattagcaaattcggttgtcgtgggccgtaggcatccgatccggtcttccgtttataggaaataactagacagagatgtatatggaagtcgggctgggagaatgagctgctgccgaatcgaccgaccgagtccgactcgttctaggacacctagcttgctccaaactccccatatatgttgtactcctactatatcggagaaacaaaactagctccactcctgcccagccaagaatcaccgatcctgccatggccgacgccgacgccgacgcgtgcc

SEQ ID NO: 79635 - DNA, 12125 bp, Oryza sativa
ggtttcggcctagttcccaagtcgcgcctgtgatgattggttcaagtcctggcttccgctttccttttgtaatgcagttgtgagctcgggatctgtccgcagcccaacatgactgtacttctactctataataaagagacctctgttgctgtgatactctgtctccctgtaataccagcactgtttcctaggactggtatcgattaacaggttaatttggagcgtcacgggctagttccggtcgggactagttcggggcgtgacaaaaaccttggccatgggtggagcaactcccaccggaagagccctgcggaggtggagcacggggacgccatcgcctccatcagggttccgcctcccgcgtcggcgttggcagcggcggcgtcggtggcgtggagtgcgtcgtaggctgtgttcgggacacaaaaaacaaagcacgctattatagggagattaattaagtattagccttaaaaaacttaaaaaatggattaatatttttttaaataactttcatatagaaaacttttgtaaaaaatacactatttaacagtttaaaaagcgtgcgcgcggaaaacgaggaaagtaagttgggaaagggagaaaagaacacagccgtagtcgttatcatcgttagcctccgccgcgggctgcttcgacgatggagaggggttgcacttccgtcgtgccatggctagagcgaggcgcgcttggatttggggcaacctgagcccgaaaatcctaatgggcgatcattcggcccgcgcgatcagcccttttctcacgtgatttccttttttagcatcccattacttgtctactttagtaaatttatgcacctaaagtttgtacatctcaagtttacacatctaaagtttatacacccaaagtttataagtcaaaagtttatatacccgattcaaatttaaatttaaattcaaatatcttatatatatatatatagtattttctataaataaagtttatacgtacccaaagtttatatacccgattcaaatttgaatttaaattcaaatattttttatatatagtatttctatatataaagtttacacgtgcaaagttttatttatacgtacccaaagtttatatacccgattcaaatttgaatttaaattcaaatattttttatatatagtatttctatatataaagtttacacgtgcaaagttttatttatacgtacccaaagtttatatacccgattcaaatttgaatttaaattcaaatattttttatatatagtatttctatatataaagtttatacgtgcgaagtttacggtacaaattctatacataagtatataatctatgcactaaaaacagtagtagattttttttctgtatttttttaaaaaatttctaacttgttttttttatttttaaaaatttatgacgtaggaagaaaaaaaagaagggaagaggaagaggagaggagaaccccgacgagcgacacccgctcattagcgatgcccgccggagccagtagtagcgttgagtcgttgtcgcgagatggattccaacttgggcctgtaggcctagagagggaatagaagagagaacgggccggcaggctcggcccaaaatagcgccggagtccgtaaatacgaacagcccagcccaccgccgcatcctcgcaaccactgtctcgctctccgccgccatcgccgccgccgccttcctttccgccgccgccgttggtactcgcgcttgccgcccgtcgagctcccctcaccgataaaggctcaccgaaggtttcgtcgtcgaccccgggaggtaagcgtcgatcccgccccctggccgttcttagggtttttcctagggtttggttccggttctccccagtctcaggcaggagatttcggtttcgcgccatccatcggagtcgcgttgcgaagcggaaagctttgcggcgaatcacgtagagcgagggaccttgacccgccacttgcacattcatgtgcgtgaagaacacgattttatgcggaagatttctgcaagccacacataagtgactgtggatctagatacgggctcccccactcctttggaaggtgtgatgatttgtgggtgttctggtagtgtgaatttgttgctctgtgaaggatttacagattgctgtttaaaatgtctgtattctgatttctgaaacttatggcaagtttagcagctcctgtatatgccgattgaaatacaagtagaattatgcacactgtagtttagttagttcaaatgtcatgggtggagatagtgtgttttctgttttacctgctgcaattggtattaaggccgtaggtgaccttgcttttgcagtttcaaatatgtctggccgaggactgatgaagcaggacttaagcaagcttgacgtgacgaagctccaccctttatcacctgaagttatctcacgccaggcgacgatcaatatcggtattgatgcaacccttttagcaatgcttactgttatatggttaagtattacagaacttatcgctgcattttttattttgtgtgttttcttatgtacaaactacatatcatgattcatgattctgaaagaatgcttaggttgccccttcataagcatttggccgtgttaactagtatcatgaaatgacctacatggttgttcttttatacaaccttacatttccagtactttttgcagagtagtttgcttcctaggttattacagttcatcagtaccataactcctccacagtggagtttcatttgcatgctattggtagtttgctcatgtagatgtaactttcctttcttctgtttgtacttgtggacttgttcagtacaatacttactttttttgtccagatactgtgcatgggagggagcattctgatttttttaaaagaaaaaaaaaagataacaactaatggagatgtttgtctctggtttttttgttgtataactagggacattgtaatgttatattatttgcatatctgatttgtgaacttcctgcagcggcatgacattctttttcattctgtaaaatttcaggtaccatagggcatgtggcccatggaaagtccactgttgtgaaggctatatctggagttcaggtattattaatgtattttattatcatgcttctttccgagtgatgaatctgaactctgcgtatacctgacaactatgtatcacatttattggtaacctgtgagttttccatatattctaccacatgatgcttagatgtgtgcctttttgtacatgcttgaataaattgcagagaactttaaaatgtattgataaaattacaccatagggtgtagaattgagaagagttgtatctggaaatccatatgataaagtagtatagaggagaatatgccccatcataatgtcattctgtatattgtagttcatgactagttgcttcacatattccatatgtagtggtgtacagttcatgaacatctttcatatttagtatttatgttcttcacatgtaattcatatatttatatttgtatagttgtcctgatgtcttccttgtgatttgtagaccgttcgcttcaagaatgagctggagcgtaacatcactataaagcttggctatgctaatgcgaaaatctacaaatgtgaagacgagaaatgtccacgaccaatgtgctacaagtatgcaaacaaaccactagacaacatgatctttttagtgtttccattgaatatctgatagaaattgtcagtagagactcaaatgattgattctccaagaaaataacttaataaaattagttgccattcacctcttaggattattgctttggtgtgaagctcttatacaatatgtgtgctcttgttcactctttgttgactttagtttcctattacataaagggcttatggaagcggaaaagaagatagccctcactgtgatgtgcctgggtttgaaaacactaggatgaagctactgagacatgtttcttttgttgattgtccggtatgatgaaatccctttccctgtcaaatatgaatcctctcttgagacacggcctgatcagtctacctgaatgtttaatgatattgctttatgcaattcattgctttgcagtagcatgtatatttggttttaaacatttcggtctgtcaattgtgatcatggggttgtagttgcatctgtttttagatgcaaatattgtttccactaataggtgcatgacaatatactggaggactgaaggatatagataaaagaaattgtaaaatgctatcatttcaacttcttttatgggccactaagactaggtattggtttacatttgttgaagcctgagaaattacctatttcctcttaacagggacacgatattctcatggctacgatgcttaatggagctgctatcatggatggagcattgcttctgatagcagcaaatgaaagttgcccacaaccccagacatctgagcaccttgctgcagttgaaatcatgcgtctccagcatatcatcattcttcagaacaagattgatcttatccaggaaggtgcggcgatgaatcagcatgaagcaatccagaaattcatccaggtcactgttgcccatcatttcttatctagtagattatctcatctgtctttttgtttatggagatttttttttctctgcagggcaccattgctgaaggtgctccagtggtgccaatatctgctcaactgaagtacaacattgatgtgatctgtgaatacattgtgaagaaaatccccattcctgaaaggaacttcacttcccctccaaacatgattgttattcgctcctttgatgtcaacaagcctggttcagaggttgatgaaattaggggtggtgtagctggtggcagcattctcagagtatgtgttctctcctgtaacataattaaatattttaatcagtagttttttatgttaagtatgagctgaatggtaatgcttcgttccagggagttttgagggttaaccagaacattgaagttcgcccgggaattgtaatgaaggatgagagcggcaacatcaaatgcaccccaatctattcgaggatcgtttcactctatgctgaacagaatgaactccaatttgctgtgccaggaggtcttattggtgttggaacaaccatggatccaactttgacacgtgccgatagactggttgggcaggttctgggtgaagttggatcccttcctgatgtctatgtggagcttgaggtttgccataactcatttgtttcttcagggttttagtgaacgaatgtcattacttacatctgaacctttcacacagatcaacttcttccttcttcggaggctattaggtgtgaggacaaaaggcacagagaaggctgggaaggtctccaagctcaccaagggtgaaatcctcatgcttaacatcggatctatgtcgactggtgctcgcgtggttgctgtcaagaacgatctcgccaagcttcagctcactgcccctgtctgcacaagcaaaggtgagaaggttgccctcagccgccgtgtcgagaagcattggcgcctcatcggatggggccagatccaggctggcacgacgctcgaagttccaccatgcccgctctgaattgtgtttctccaggcagaaatcctaatctttgagagaagatagaagagatgtggaagggcagagagctcctaggcactatttttgtgaggtggatgagaaaacatgaatttgatttggaagccatgtcattgcgtgctatcgaattcagctatgctacaaaagttttgcttacatctgcattctgaattatggagaatcgttttttcaccatgttataatgaatttgaagtggggagaaacctactaattgatcagaattgcattattgcatttctcactgaatccaatcagtgatgtattattgcattgaacatgttgcaagaaaggaacatatcgctctggattttctttttctatcttctcctcccttaaaccagttgtgacttgcgacgcaaagaatctccatacgaacatgactatttactagcatatcatcaaaagtttcaaaatataaaccacagtaaccagctaaagaatacacaagaatgtaacctttgcacaggtatcttctacagtagcagtcaggagaaacagttgttcgattcaggatgagcccccatttctatacgcaaccttacttaggctaggcactggaatatcaaaagctatcaaacaattgagatttttgaggcagttgaaaaactaacatctaaattctaaaatacccccactctacctgtgattgtgcaattgaattacaatggttaactatcacacgaatcagagctacaaatcaagaaactaggatgtctggaaatctctctactcagcctatactctaaaattgctcccagaaggcggtctcaaccttgattcgatggaccgggcatgtcagggttgtcgaacatgacattgggcgctgccgaggttgagggagcgttcatcgctgacagaggcaaccgacccccgaaagagagcatctgcagctgccgctgctgctgttgctgcagctgctgctgctgctgttgcatctgctgctgttgctgctgcaagaaggcctgtcgctgctgttgctgctgtagttgcatctgctgctgttgctgctgcagctgcatctgctgctgttgctgctgtttttgttgctgttgctgcatctgctgctgcaagaaagccatctgtgggtgcacctgcatgttattggagtagaaagctggagtgccggcctggggcatcgatcccggtattcctggcggtcgaatgttcgcttgactcaatggatttgaggccatagtgttgcctctgggtgaagctaaccgaagccctgacatcatccggatgcgctgagcttgcagcccctgcctcatcctctcggactgctcactgtccctcaaaaggtaggtctcgatgtctgcaaattgcttcaacttcaactccagcctcttcaactgcaaatgagtattacaaaaataacagcaaagagtccaaatgaaaatgatgaaagccacatcaaatatcagccagtatggcataatcaagtgaaaatgacatattggacagtcattaacccccacatcacatgcataaatttcatatcagatttaggaaccaactcctggaggacaactgatgtcaattaccaggtggttggttaacactaaaacaggctactaggctagttaaggttccaaagataaatcaacattcaaccccgctggatcctcctggttttaactaaaagccagttttaaccctgggtaattaagtttctgaaaacttattaaaattattgtcacaggaggatctgttttatccacactccaaattagctagaatcatcaaaacttgtaaaaaaaatctctcccactgggtaaagccaatacttgccgaatgggcgttgatgctactcagtgactatcttttatgctcagaagtcacaacctcttttgtttctcaatgcttggtcagtttgttgacatgtcactgtagattgtgaactatcatcgtccaatcacaaactgaccgttgtgatccatgtttttatcaaattagcataatattgtttctgcactatagctaattccattcagaatcagatttcaaggcttcttcaagtccaaaaagaaatgagcaaggactgataacgcttcatctatacttcctccttttcatattataagactttctagcattgcccacattcatatatatgttaatgaaactagacatatatgtgtgcctagattcatcaacatctatatgaatgtgagtaatgctagaaagtcttataacctgaaacggaagtactctatactactataaatgttggtagtggtagtggtagtggtagtggtagtggtagtggtagtggtagtgaatctaccaccacaacaccctatcactgacgtgtcggaccctcaatgtcggtgaaaattttgtgctccctagttcaaatcctttgattccgtggcaacacacgggcaaatcagctagtttaatacaaataaaaacaatgccacaaaagaatatgaagctaactagattgtcattaccattagaacaaattgcagaatgtgaacttctgtattccaacaaacctgatgatttatgatggtagcacttaatctctgaatttcacgctcctcctgatccgcaaaaagtttacacttagttgctgctgccgacaagccacatcttgcagcatgtctaacattttctgaagagacagccaatgaggaatctgtattaaaataaaactgcatgttagagtaacatcttgaaaagaaagactgaaggatgcggaattactaattttaggaataaggtagtcaccacagttcggtcgagcagcatggcccataacatcattgccaattgaactgatccttaattgatgaacattattgtgttaagagaaatccagcaaggtgagataaagtgaaaagtaagtgtaaagacccgaagtagaacaatttacactccagttatagaactggtataacatgtcggagctaagagttcattaatctcatccctaaacctcccttacacagcataggtggctcacctggagtcacctccagtcaaaacaattaatgcttcacttgcacaggatgccgcaactcttggtcctaatgaagaggccaaaaatgcaatctgcaaatcatctctgaacagtaaggccagagacataatagagatctacaataaactgacaagatctggggagaatgatccagtatgtgggagattactatcatagttttctacctatctactaagttccacctagatattatgtttccatgtcttgtcccatgccgcaagctatcatgttagttctaaatgatggtctgcacgagatattaaataataaaatgcccatggctttgcaactaaagctgtggtttgcctatacaataaatcccagctgtcttacatcaggtgttttttaatttgagaattcggtcaatggcaagaaactatgtatatcactaaaagtgggctgtataaaagcagtgaagatgactgatattgcaatggagcataatggtttcagcacccaaatttgaattgagcagtgcaatgacataataaacaacatagtctgcagtcactcaccagtgacatgacaggattagcagtgttaatgaaaggaaggtctccagcttcgccgctttgaggcaagcttcctaaggcaaacaattgtggcaatttaaaaacggagccagaagcattttgcatcaaccaaaactgatatccaacacaaaaaaatgttaagtttttcagtaaagaaacaatgaataaacctgaagtactgccattggaatttgaatgcaaaaaaccattgttttgtactttcgatgaaaaggatgcttctggtactttaatattctctaacaatccatcttctactggaagacgaagaaaatggtgaagacattgtattttcgactttgttccaacatgctccgcaacagcattccagttttctttgtatttgtctatgccctccaataacagaaatgtttcctgatcagtccagctgtccccatcattgtccagtccatctttcttcccatccactctctgaaaatctaagcttgagtgcccagtaacaaatcttgcatcgtggaagcaatccgagcaaagagcaatgtctgcctgcttagtcagttaaaaggaaagcctgaaacacctttacaagcttctttcagaaagaaagggatttctcaagagaaagcagaataaaattactaaatacgcaagagatatagatatccatgaagatgcacatgattcaagaaggcactttgtgcaagagggtcaacaggggtggcaactaggaccagcctaactagagaattctaagcaattatcaggcatattacaaaagaagataggcaatactacctccattattattttactttacaatttggacatcgacacaatatccaatgcacatgtctcatcattaacttttcttaactttagatttataaaaattattagaaataactatatgaaagtgtttttcaggacaaatctgttaatacaattcacatataaaatcctaatatcttattaatgatacacgatatcgaggtttgattacacacattctagaacgtcatctatttgagaacagaggtagtagaacactaaaatagcagaacaagagccctgaagacaggttagcctaatgcaccatcctaatacctaatcactgcagttatctagcgcctatcggtgacttttagaacactgcatatgcacatcaatatcttaaatggatctgctacaaaaatgcagtttcgcacactagacaatacaccatccattttacaatagttgtccagtgcacatacatagaagatacaaaactccttattagttcaattggactctgattgttcttaagatcaaattactccatctaatggtgtcaaatataatctaattccaccaaatattattactggcttgtgtattcaacatttgaagaatgataaatatctaattggcagtcagaattatacacacctccttttgtgactcgtagtgcaagctaggcaaaggttgtgcgcagaaactacaaaagctctcagacaatctctccaacaatgtcttctcatcaaaaccagcatcaccattttccatccctggagaagatgaaagtgatgccccagaagcaatatcctctgcccggacactgcattttggtcgatcaaacaaaattaaaccatcaattgatttcaatggagcagacatgagatgcagctcccctgttggctcctctctgattagtgttgctgccatcctcaagccccgttgaacagacccagccgcaaggtaattaataatcccccaagcgtccaaaaacctaacaattctactcaggtcatacaattcaggcgtgcttgtgacaagcccttggcactcagaaaatgcaagcctcctcgcaggacgctccagatacgttgtaattaccctattcctcaacataatgtatttctctggcgtgtgccccggggacttccctgagaagaactgcggcagcacttgcctctccaacctgtgcaccgtcattggcaagaaccaatctacgatttccaaatcaacccataccacacagcttaagtcaatttagtgttcagctcaactagtatggcacatttcaggagctcttcgattcaaggaaacaaacctgaatgcttgggtaccatgagcaatttgccatcgaactgcttggccacgccgcggcactccatgagtagaggaggggtgcagacgtaggaggacggcttgtcggggtcgttggacaaggacgggtggtcagggagcacggacgagagcacctggagctgcccgtgagagatgttctcgagcgcggggacggccgcgccgccgccgccagcaccagcaccagccgcggcggcggcgcgctccgccgccatgacggcgagcacggaggggtggagccggttgaccacgcggcggaacgcgggcgggaaggcggagacgcgctcgatcgccgtggggtgcacctcggcctcgcggaggtccaccacggggtcgtcatcgcccccgcctagggttccgcctcccccgttgacggccgcggtgcccgcgtggagcgccgcgtcgtcgtcgtcgttgtcgtcgttcgccgccgcagccaccgcggagtcggagtcgtcggagtggtcggccgcggaggtgttcgcgttgcgcttccgcttccgccacttggcccgagcatctacaggggaggtagggttttggccgccagcgtcagcgcgggaggaggtccccgcgagggggaagtgcgaggcgaggagggggggcacgtacctgcggaggaggtggccttgcgaggaggcatcgtcgccggcgccggtggcggaggaggcggcgacggcgacggcggcggcggtgggggagcttggagtgttgccggcgagggaggcacgtgcgaagcgagtgaggaagggcgttgacaccgcggttcgaatttcttcccactttttcggcttttgctatccaatcaaatcattcaagcttgagtattctatagtgtc

SEQ ID NO: 79636 - DNA, 2874 bp, Oryza sativa
tgatgctccggaagatggtggtgctgtcagatcaaaactgaggtcggacgatggcgtcatgctggccgatgctcgagacgacgaacaacacgccgcaacatccgactccatggccggaacatccggtggcgccgtcacgggaggaggacacggaaagcttcttcccgacctcaacgtcgtcgcaaccgtggcgcacgacgacgaaggccgccacgcacggggcgcaccgcggccacaagacggcggcaccagcacgacgacgacgatggtggccagcgccggcgccgagcgcggcagcacgacgggccacctgccggccgccaccgccgggtaccgtcgaacgctgatgctcttcctggaggaggaggacgacgacgccgtggaggatgagcagcagcagcagcaggcgccgccgctgccacccgcgacgtcgacggcgacgacgacgacgaggacggcggcggaagccaatgtgcagcggcagcggcagccaccgtgttgtacatttgtggtgcacccgtgcgcggtgcacgcgaagatgcgacacggcgcggcctacgggtgcggctgccgtgtgaccggcgctgtccggagaggcggttaccatctgccgaggcgtgcagtacatactacgactactggacagtagtttatatacgacttgttgctccctcccgtcctcacaagaatgcgattgtagcattcaaattttgtactgtacaatagagaatataacaagagtgttgtacttcccatctacctatcatcgttctgaaacttctttctcatcttacctcagtcaccttcctagcctcaaccacatcttacgatttaactcaagggagatatagtcatttatcttccctactaatttatcttctgaatggtgcagtcgcctgcaaatttgtaatctatcagtcgatcccctgccgtcgattctgcattaagatatgttgcaactatcgggctggtgggaaagactttctggatatggacccaccgaaatgaaagctctcaattccttaactccttttccctcactcggctccaagttcgtcacagccagttcctaaagctcaacatgcagatgtgccacatcatcacccactaacaattattatctagagtatcttagatctcatgctaacatgacataccatttgtatttttgttgtatgtttagacctcagcatgcaaacaatgtcaaattaccatcttcacattatttttacattatttaaacatatacgtctatcacttttataatgtataacatgcatttatccatacatatcccacagcaaagcgcggggtatcaactagttttgaaaagacagtcgccgttgtttggcaactcgaggggaagggatggagagtttacacaagagaattgatgatgagattaagatgggaatttgatgtttaatatctcaatatcttgtttgcttgaggtggcggaaattgatagggagtttagttggagattaggtgattaatgaaaatgaatgggaatttgatgtttaatatctcaagatcttgtttgcttgaggtggcggaaattgatagggagtttagttggagattaggtgattaatgaaaatgaatggctaagatttgtttaggcaaagtaaaggaagaattccctcccaattaccaacccctactcatgtatcgaaaaggagagagttccttcctcaattccccattctcatccactggtggagaaactatctttcgtcggtcggccgaattccacaatagtcccggttgcaataaaaaccggggctaaagatgatctttagtcccggttaaaaagggtaacaggcatatttgatctttagtcccggttggtaacatcatctttagtcccggttcaaatgctgtcatggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtctttattgtatgactgttgaaagagtttgtaattattttataattattgtatgactgtcatttttgtacgaataattatttgtgtacgattttttttcatctcatgtagatggatcggcaatggatgtacgctgaccggcggtccaaagagtttattgacggcgtgcattatttttttagagtggccgaagctaacaggcataagggtttatttgttgtccatgcaataagtgtaagaatcagaaggagtattctgcatccaggactattcatttccacttgtttgagtcggggttcatgccaagctataactgttggacatcctacggagagcaaggggttgaactggaagaagatgaagtggaagacgacaatattccggactttgctcagtatgctggatttgaaggaaatcaaacaggcgaggaggaaagggatgctgatggtaacgacgttgcggatgatcttggtcagatgttacaggacaccaaggaggactgcgaaagtgaaaaggggcctataaattggacaagatgttaaaggaccacataacgtcgttgtacccaggttgcgagcaggggcacaaaaagttggataccactctggagttcttacaatggaaggcaaaaaatggtgttagtgacaagacatttggcgatttattgaaactcgtcaagaacattcttccggagggaaacaaattgcccgagacaacgtacgaggctaagaagatagtctgccctctaggactaaaagttcagaggg

SEQ ID NO: 79637 - DNA, 2353 bp, Oryza sativa
cacaagccacgctattatattatggcgcaagcggtacatcatcatccctgggcgacaagcggcgtctcgtgcaccatctcctccgactccgccatctcctcctcaggctgctgcaccgtctcctcctcatgctccagcaccgtctccaccttaggctcctgcatcgactcctccttaggctcctacactgactcctctgcaagctcctcgtccggcaccttccaagtcaagggccccccaagctccaccacctgcccccacaagggcaacgaaaaaggcgaaagttgacgcacgcaagaggtgacgcttatgtggcatcagaagtcaggacacaattgaagcctcgaagttcagaaaagaagattcctatagacccgagtgtcaggaacttcttcaggggtatgtctgcacctgccaaggaggccataaagctatcggactatgagcgaacacttaagaaagcatcctctggaaagtctaaaccagtccctcagcttggagagcaaccataccaggagatcgagccgttggtgaccggtgaagattttggaatacaagagtttattaatgacactgggctaactacggatcaattgctacgaggcgcaccaatcgaaaaggcggaagtgaaatacatgtacaaactcggtaagccgcttgtcaagcctgagcagctgcagtccctacccacacaaatgtacaaattccatcaactgtacatggagatgagcgccaccggtagagagatgatcggagcgaggatcaagggcacagacttcttgcaaggagatgatattctctggatcaatttcaagggtatctacaaactataccagctggacgctctcgacgtctctattatgagttgctggattttgtaagtatcgttcagttagatttcttattacgtttcctttaattaattaggtccttgtatataagtagactatatatattatatacttccttctatcgttgtagaatggagattcaaagggcccgacggcggggggttttcgatactagattcatcgaccctcggaaagtaaacgtcacaatgctcgaccagtatccgcaagccacagaggacaatctcgtccatctcctgaaggcgcagcattacaagacgttcatactattgccgtacaacacagagttagtttttactgtcttcctataccaaatttcattcccgtacaaacatgctaagtgtttcatatgtaatgcatccgatgcacattgcagattccactgggtccttttactcttcgacttggaggcctgcaccgtcaacgtatatgactcaatggataaaaaagagtctacgtttgacaaggttttcgaacttatagacaggtactgtcataagttcctatgttaattaagaatcttgttataattaattgctactacgaatcatagctttaaactccatgtagggcttagtatcggttccgtcatttggtccgcggcaagtggagagaaagacttaggcggaagtttaattttcctgtgagtacacatgctctacatttatattgaatctccaattcaaatacatacaagtgtatattaattagatctctcgccgtttgtcatttatttatagtgcgcaaagcaagcccagggaactaacttgtgcggctactacgtgtgcgagtattgccactgccttgtagaccaaatcatcaccacaagagagctcaatgtacgtacaaataaattcaaaatttcattgtgtacgtatcgatttgttgtttactaattaatttcatacattcatatagtttattcgtatgagggataacctcacacacaaggaatttatcgcggcggttcaagaacaactcatgggattcatcgacgaacaaatccttgatctcaagggtgaattctactacgacagaaatacaattcataggtccttagcttctgagataacgactactactacatcgaaatcgtagctagctaggacattataatggattgtaattaatccatgtctatttttctatatgcatgtacacattttctttaatgtaaatatatattttggtcatatatatatatatatgcacataaaatgttaagtgctttcatatatatatatacacacacacacacacatatgcatttgcataacatatatatgtataaatacatatatattatgcatgtatctgtattgaaacatatataaatatcatatatatatgcatggtttatatatatatatatatgtatatatatatatgtgtgtgtatatatatgtgtgtgtgtgtgtgtatatatatatatatatatatatatatatatatatatatatatatatatatatatatatatatat

SEQ ID NO: 79638 - DNA, 1260 bp, Oryza sativa
ccgacttcgtccatctccatccgtgtacttttgtttataaccagactgagccacaaactaagccttacccactagacatgtggaagtacggtagtgctttgcaacagaggcccgagcttaatccttatagggccggggtgctacttcccacaactagcatgcacccaaaccccaccgaaaaacaggttttaggggctttgaaagaggaagagaggggtatgtccaattccaccatgagccaaccattccatagtgtccaaatgatatgagaattcccaaagtctaaagttataaaaccacctaatgttgcctaattaatcagcgaagcatctacctaaattcatactagtggaaccatgaatagagtgtccactagttggggttttgtttattctagggtgaacaaggtaataataacaatagcaataataatgtcataacaaaggtaaataggcatggctaaataaaacagtgataacgcgggaatttaaataaagcgataatgcaataattgaaatcaaaataattttataaactgggattcaatatgttcaaggatgatgtgacttgccttgctcagagagaacggccttccgtaccttcggcgacgaccgcgaaccacgcttcgggaacctccggaatgacagaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttatatggagatttgcggattattataattaagctttgcaactataaaacatgtgtaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaactgaggcgacaggccgacaaacggactccactagacaccacacgggctgcacacgtggagaccacgcggctaccgagcgggcacactaacacggacactacacggtcactacccgcacacgtgaacgactaccgacaccggtacacgggtaccggggttgacaaccgcacaacgggtacggggcgacactgaaaggacgaggacggggcagcgagaggagagatccttaccaccacgcgacgaggcgtgggaaagaca

SEQ ID NO: 79639 - DNA, 3209 bp, Oryza sativa
aaagctcataatttatatccggttgctataattatgttgtattctatcaaaccatagaaaatcagtgttccaagaccaaataaattctttcattttttttcatttctagcatgaaaattgtttggttgctctacggttttctcgtagttccttgtaaatatgttccatgactaaaaaataaggcctaggtacgctggttgtgccttgtcccacctattattggttcattattcttaactcgtcaagactggtctactaactctctccccacttctctttctctcccatgcacttgtttgtgcatgaaaatatttggttccaaagtctgaataaatttattacaatttgtgtgtgtgtagtatatgacaattgtttagtgacaatagttttcttgtagctcctagtcaccttgctccatgttgtaataattgtgtagatggtgagatgtatttgttgtacctatgaaggatgtatacggtccgttgtagtgatgtttacataattgatcaagtttagttaatcattttttttattgtcctgggatagatatgagtcatctttttaatggtttgtgcacaaagaaataaatgaaattatgttcatacctaaaaggtgtagaagaatatctatatatgatatatgatatatgatatatgatggcgcaaacatgtgtcataaaattattttgtagttttttattcaattcggacgacatgaaaaaggcaagtgttgtccaccataaaaatatttaccaatttagctttactatgcatatttatagaatgatctatgtaatgatgtaatatatgtcgatattttatcatatttctttgatattttgatgacatctagaattcatgggttgattatgatatatttcttatatagaaaaacataggcatacgaaacttaatttgtttgcttaattaaaaatagagaaatagttatattagatatcaaacatgtagcgtgtagctatagaaatatcatcatttaaaaattaaaattattaattatttctcttttagttggataactaaataataggaacggagagaggaatgaagagtgccagtttaagctagtgggaggagcggacattgataaacgtatgtgaggggagggggacgggggagataaagggacctttgttttcttagagatatatttattgggtccacaggtgaagaaaatagatggaattgtttgtaaatgatgtggtgtttaataattgtttacattatttggtgcgaaagggcataaaaagacataatacggtttcgtgtgaaatttttttaattaaaatattgctaatatgtgttgtaatattctttatctagagtaaattgcacctgcgatgcaacaactaggcaagtgggtgtaatttggtataataacttgagaaataagcgttctagtgcaacaacttggtaggaatgtgcaatttagtataagaactttagaggtgatcacataaatgcagcaacttgtaaggtaggtacgattttgatacaatatattaagaagttatgtgacaacttaattatttggagcatttttatataattcgaatacacatacttacttataatggataatatactagcgtggatttgaataagcatacttatatttttatcctaataactaatatctgaaagcaattaacctggatgtagaaattattatatttcggttgatattttagaaggtgaagaaaaaaaatcttaaaagtaattggatgtaaattgtatgtgcagtataattcttataaagattaaattcaatattataaggtaatatccgaaggaatactatgtaatggcatattgatatcgtgaaaaaactcaccttgcatatgtttagccaagttgatgcaccaaaatactaaactttcaaatttttgtactagaacgcacccacttatcaagttgttgcactcggacatttaattcttaagtttttacactatatcgcactcacctgtcaagttgttataccgtgggtgcaatttactcttttatctattatagataagatagatgtgctatgttttaaatagatatattgattgtttgtttttctcgatggtaggtgcctgcgtacgtacgtacatgtttttttactttgtcatcgatagttaaggctgtcaaaaaaaaagctcgaggctctcaagctgcttgaactcggctcgtcttaggctcggctcgagctcgattcgaccatagtacgagccaagcccaagcttgcagaaaggctcgcgagcctcatcgaaccgaactcgaatagctcaacaagctcacctgctcacctacaatcaaaaagtgacatgctattttcttactagtatgtttgacttgttttatatctatgcaccacgggctagcagcaagcccacacctgtcttatatgaagtattaaattattcatactagcctagtacacctactagcactagcacactccccaataaaaagttgcatggctagattcgtgtgcatctctatctgtgctagtagtacaagctctcacatgttatctgtccggtgctagtagtactcctacaagcttacatgctgtcctgtgagtgtacataccccaagtaggcctatcaaaaatgctcgaggtccgtgagctactcgagcttgattcgttatgagctcgattctagctcggctcgtctaagaatcaaaccgagctcaagcttgactttaagctcgcgagcctgtcgagccgagctcgaataactcggcgagcctcaacgtctggctcatgttctttctcctaggcatttcctccccctctctctctcttactcgttcaaattactggagtagcacaattgcacatgtactggcagggcaggagggagcactatgcatttgttgtcccatttcccaacaagagagtaggagtactagtgtgtagtagtaggagtactagtgtgcggcttgcacagttgcactagtatacataggagcactagtatattacttttagccatctaatcatgcatcacagtgtcagctttttctttgaatgggatgaattgttccagtattccaccgcacgaagcaggcttgagagaagctcgaagctcgaacgagccgagctcgagctcaacttcaagctcgtggcaaacctaggggctcggctcgagcctcgactcgagtctatagagagcttgagcctacacatggaagctcgct

SEQ ID NO: 79640 - DNA, 6562 bp, Oryza sativa
tgtttatcaatattttttttggattgttgtggaaatttgtttcgatcactgacatacggacgtacgttaagaggggacatgtttatggatatttgtctatatgcatatgtgactatggaggtaagttggaccgacgggaatgttggatcctttgagggggtgtcttagacatcctagtgcaattaagatgtggtctatatttttttatttgaaggatttgacatgtgttgtccataagcattgtgtgcacatgagtagtagtactatcttgctatttaagcaagagtgtagccaacctgtaatgcattgtccctccaaccatatcattttttgttataaaagtgtaagtgaggtgatatttataagtaagcgtgccaattggatggaggttgggttgccttgttctgaaggacgggttgttacaaattgtacactaaaattacttgcatcatgtcgtcttaaatttatgagaaaaatatcattttaaaaatactacatgtttttattttaaaaatactacatgtttttattttaaaaatactacatgtttttattttaaaaatatttagcatcttaatttaaactttaattttttcttgtatactaaatatgtctgtgtagattttacgatatattaatataagaaattttctattaaaaatatgataatatgacatctttatctaattaaacaaatactcatatacttctatttacttctactacctctatccataaatcgaaggatttaaattttatatcctaaaatataaggaattattaatactactcgttccatccagccattcttcatttaatttttatccaacattacactaaccatcttctaactctctacataccccttatttaatgagccttatttaatgatgggtatcttggtatttttttttcattcctccttgatttctactccctccgtcccagaatataagaagttttagagttggacacaattattaagaaagtaggtagaattaaataggaagatgttatgttgggtggagaagtggaggtaggtgagaaaagtgaaaggtggagaaatgtgattagttgggaagggaatgttggtggtaatgttgttatatttgggacaaatcgtaagtgctaaaagttgttatattttgggatagagggggtataaaattttaggatccattataagacggagatatatagtaataaaaaagagtttctcatttatagacggattaatttgtacctttgtagattgatttagctttaaatatttgtataggtaaatagaaatggtataaaagttgagaaatataattaagttggttgaaagtctttagatgttaaatggtatgaagtaattagccaaccagttttattaaaaaaataatgtggatattttttgggggtaatttttaggatcttcttttattcagtggttaacttaattgttgtaaggaaaacaaagaggcgagagccagtgggttcatttcgtccgtgaggagggaactggatacatgtgttgtacatacgcactctgacggcttgatcgatcggtaggttttttaatacatagatctaacagtttaaaataaggtagatcagtttgggtaagacgactttagctcaataatgcatactcttgccatagttactataatgtagccagttgagatccatgcttggcacccttcagggtatgagtgagagaaaatggaggtgatgaaaatagtttttttttatgtcttgagttgatttattatatagggtatacataatttgtttatggtgttaatcgatactactaaattttagtggtatatatataattttatcttttaaaaattagcagggttgatcattggactctacttcgaaaaatataatagcttcggtggtgtggaccacgtaaaaaaaatgctcaaactttgatccttttctaacatacaagttaatataggttttattttttttcttgtattatacttttaattcatcaattcatgtttgtggggattaatattggataaatttattaaaattatttgtgctaaatgttaatactattttgctgggacgacataaaaaagagatacaatgttgttacatgtatgtttttcttctagcgaatagtagtctcacgtatggacgtttgttttttctttatttttctttttggacaaatatttgtttatcataggaatagagtgtgcgtatttgtattcataatgtgcgtctgcacgcatttatatgagctcttgcgattgccttttaaattgttagtaaaaaaaagtatttttaaaaatttgactggaagagggtggagcaacgggtggcatgagacggcgccgtggcaaggagtgatcactacgtatatgctcaatttagaaaaaaaaaaccttagatctagaaagaaagagaaaacaaccatatgggacaagtcatatacacactcttcttttttttcctttttatatatcttgcgtaggtatgtacataggagttgtgtatgtacgtaaggagtgattagatggtttttagacagagggattattatcatagatctaatttaatggttgaaaaataatagatcaccgattttgtgtgtaaatcgataaatattatttttgttttattttacattctttctaattagagcatcacatggcatcttagaagcatttgtaggagtatagaaatgctattactcatagtcacaatctacctgtagtcaactattgtttgcggtggattagttgcattctctacttacctataatttgttgatagttgcatacttagaattgccctttatctttggtgtttgattacatacatactcattagatatcagctaaccggccgttaggtgtgttgtgtacgaatacctcttaagtaatatgacttggtgattagtaaatagtgacttatgtataaaacttacatatattgggataattgagaatgtacaattgatattttaggctaggattggcagagtatattgcattctacatattaagtttttaatacctaagtaataaatttaagacaatgttgtaaagtgcttataagattagctactccctatttaatttatttggctgaaattatttatttggtttttatctcaagagagtgaaaaagaaaaagaaaaaataaaaagaaaggaaggaaggggaaggacgtacactaacgatgtacgtacgtacatgaacgtacacgtacgcgagtgatcgacatggatgtgtggctttctgaattctaaagatgaattaaatatatttagtatttttagatgtaacggttaaaaatatgggttcaccaaattaaatgaaaatcaatggctagatattttaaataccacgtggcgatttaggagcgattgtaggaagtttaatggatttttagtatataatagatagatagataattggaagataatagatagagtagaaattcagatgtgaatgcatttctttctattctaggaagccaatgtataccggccgggcactgttacagaattaagtaaaggatcagaagaaaagcaaatattcagattaatcactccaacaaagacattgtttttttcttcaccggcagcatgcagatacttacagtgtcattttatattggaccactctatcagggatagaggtagtacgcttttgttcagtgtggccctttagcatcagtggcccttaagaatcagtggcaaaacgaagattactgcaaagggccaagaaaaccaaaacgccaccgcgacggtttgcaggccgacgattagcgccgccaaaatgtcccctctagacagcagcgcgagcgtcatccagccaagcatccaaacctcgaaatttatgtagaccagaccaacggcagcggcggcgtagacagcgatgacgagcttaggggcgacccgtgccagcatcacgtacgtcgccgtcaggaaggcggcgcccacggacctgacgctgctgtgcaggaggcccatggagagcttcacgcagcgctcgcggaaggcgaagtcgagcggcgtgtagccggcgtacatcaggctgaaggtggccatcccggagagcatgaaggcgagcgtgttggcgacgacgaacgcgtcgaaggcgcaggtgccggccaaggtcggcgttccgcggcgttcgccgtcgtcgtcggaggaggatacgtagcctccgggcatcgtgaacgttgcggcgaaggtcacggtgacgatgagcaccgcgccgatggtcaggttctgagctgcgtctttgtatatcgtggaaagctcccccctctcctccttctcaactcgcttttcgtttaagctgtcggttgggttgtcacccgatggatggttgccggccgtatgggtcagggacgaagacatcatacactgtggattctgcagcaacgtacaatctgtcttgttaattggtgtaactatctactctctccgtttcagaattaaattgcttcaagtttgactatgtttatagaaaaaaaaagtgacattttcaacccaacacaaatatcttatgaatgcatattcaattatagatttaatgaaactaacttgatattgtaaatattactatatctatatacaaacttgattaaacttgaagtaatttaactttaaccaaagtcaaaacgacttgtaataaacaggagtagacacatatactacagtacagtacgtacgtaccacgggataattcagacctttcagatggttcttaaagcgtgcaagatcaaccggagtataccccatgttatttttcacatctagcagcacccgcctgtcaatcagtaggaagaagaagatcattatgtcacaaacatggacggcctgatgcagcgcggtgttgccgtttccatcctgcatgttcatgacggcggatcgtaacccaggtgagaaacgagccaacgcgaccactgacggacacaggttgtcgacggccacatggaggaaactccggcccgtgccgtctcgcaaacccgcggaatcggggcagaattcgatcatcaacctcacggcaaataatccggctacaccgcccaatgcagcagccacatgtatcgggtatgatccctcgtcgtcaggctgatacacacaggatctgtcgtgctccagtaggagcttaaccatagcccgcatcgataaacgattggtggatgcggcgaaatggagtggagtcctccccttttcgtccccttgtttggcgaggccactgttccatccgagtatcatttctgtcggacctgaaattaatttggaattttcattcagccctaaatataaacctgaaacttaattggaatttttttataactgttgataaccaaaatttgacaaactaaaacatgtagagagtttagggctccaatcagggcgaccgattggatggaaaaaaaaaaagaacaatctaatgttgcagttaaccatggatcaaaatattcgctttcacgtataataaaacatcaaattttcaacaattaacatatatataatcctataagattttgttgaaaatatttaattgtttgtacacaaatgaaaccaaatatgattgttattgaattatcctagttgagaaatccaaagagtaacctttggtgctagttgatcttgttgagtgatctttgagagattctagttctatccaatccacccgctatcccactccattcagttgatccgtgtcatatggtaccagagtttagggtgatggctagtcatcatcatcatcgagagaactccgacaatgacaacgccaaaggggggttaagcagggggaccctatctcaccacttatgtttgtgctagctgctgacctccttcaatcaatgatcaagaaggcacataaaggaattttcactatgccgataacaaaaccagatggtaaatttccagtgattcaatatgtagatgaaaaagacaatccaaaaggaaatcttttgtcagaaagggatcttacaatcttttgcccaatcaacaggtcttaaaataaactatcacaaatcttacatgatacccatcaatgttcctaaggaagataaggaaattttagcaggaacatttggctgtaaaactggttctatgcctttcacttacctgggactcccagtgggaacaaccaaacctagaattgctgagtttgcccctcttattgatcgagtggaaagaaaactaccttgcgttaattacaatgttcttaaaccatggtcagaggttaagcttggttagctatgtactctcctctatgccaacaaactatatgtgctcacttaagctacccgaaaaggttattgaacatatcgatagaggcgtgagacataatttatgaaggtaatcttctaatttaaatgtgggacctcagtccttagcagcatgggacatggtatgcaaacccaaaaacaaaggaggtttaggcatcatcaatttggaataccaaaatattgctcttctaatgaagcattgtgacaaattttacgataagaaggacctttccttagttgagactgatctggaacaagtattatcatagtggtgaaccccaccagg

SEQ ID NO: 79641 - DNA, 2435 bp, Oryza sativa
ccccggggtagatgggccgagagggattcggcccatcgaccccggggaggcaaaatagacttttgcggaggaatttgatttggaaggatttggattcgggattgaactcgacgatagatcggggatttgagatccgagatggcacggacactagacaacaagcaaggaaacaaatttcgcaaatagggtttttaagagatagttttcccgctaggcgccacgacggaacgggcgctacacctacctagcttgttgcatttgatccttcctctgttaattgttataccatgttcccttgtaaccacccagttgcgcctcggaaatcgtgcactctgcacgagtatcaacggtcgtcttcaaacttaaaatctgaaaaacatcttgggtaaaacatgggttttacaaaagacttggaaaacccgacacctgggtcggtgcttgcgaactaaatgaattttccaaaaccgcggaccagggaacgtaccgggtgtacggtttcccgctcttgcacttaaggaccgtttccttggaatttcatccgaacataagacaagtacgaccacatgggtggaatgggacacccctggctgagtaactagcttatcagggaagccttgatgccgagagacatgtggattcgccggggtggtgtcggggaggacccttgggcttcctggcacagtatggtctgggacctaacctgttgttggtctgggacccctctcgttggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttattaaactgttcgaacagccgtgcccacagtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgagagttgttggccgggtgccaatcttgatcaattctaaagactgatacattgcacaaactccgactggacgagacgcactgtctcatccgtgtcgtttgagaagcactcacttagttgttttcagaaaggagttcaaataaaatcaattgtaaaaacaacagcctttctttgaagcctgcattaaacacttatttcccatggcttgctgagtactcccgtactcacccttgctctatataaataatcccccccagttgctgaagaagttgaagcggaacctgctgatgaggagttcttccaggagcaagccggctacgatgagttttagggtttcggcctagttcccaagtcgcgcctgtattggttggtccaagtcctggcttccgtttcccttttgtaatgcagttgtgagctcgggatctgtccgcagtccaacatgactgtacctctactctataataaagagacctctgttgctgtgatattccgtctccctgtgataccagcactgtttccagggactggtatcgattaacaggttaatttagagcgtcacgggctagttccggtcgggactagttcggggcgtgacagtaggtccgccaatctgccttgcagacgggacaaagagattaagtgcgatcctatcaatgcataatatttttcaagcaacataattaaattcaaatataggctcaaggtgttcaaaggtggcttgccttgcttgagatcttgagcttgatcctcgaaatcctcgcactgcgggtcttcgggctccgaaactacacgcaaaacgggacaactcaacaaacggagaaaataaagccctattaatgacctctaagcgtgccattagatagatctcgagatttgaggaattttggaagttgatcggagtcaaacggatttacggttgggaagatattgaatttctaagattattggatttttggtctaaaggaaaaaggatttatttaaatcctttttgaaaaagaaaagaaaagaaaagaaggagggggaaaattagacttccctcgggcggcgagggcgcggcccgagagaaaagaggcggctcggccgagctaaatgggccggccggcccaaaaggcggcccaaagcgcgcgcgcgggcggggaggggagagagagccggtgggccgggtccatcccgcgtggtcccgggtgggacccgcttgtcggcgactcggctcaccgtgcggagcgagcacgcggcgcgcgctagggttcggggagggagacgcggtgcacgcgcgcggttcgcggaggatgcggtgcggcgggcccccgcgcagcctcacggctcaccgcggaccatgcgcacggggggggggggggggggaaacggagggagcgg

SEQ ID NO: 79642 - DNA, 7464 bp, Oryza sativa
  unsure (1)..(7464): unsure at all n locations
gcacttcaatagtcgccagggcaaccggccggtggggcaggcgggaatccggcggccggcgacaggtgatgaggcggcggcggcgcagcacggcctcccgcgcccgccctccctcgccgccggggaggagctgggcancggcggcggccctatccctgcccggagccgccgccgccgccgaggccgagcggcgcagagtcgtctatggcagtggctcccagcggctgtgggcgcgggggtatgcggcgaaggaggtggtattcggcgtcggagcccgggcctcccttctcaagcgttgcagccgccgccacctcccttctctcgtgtcgtcgccgtcgtccatccatgcatctcccacccccactatctctcgccctctcataaccctctcctaacccgagccgccgtcgccgcagccgcacgtcgtctcctccgctcgcgagctcctcttccagccggcgagagatcggagcacgtgggggcgcggccatgatgttggagacgaacaacctgctgctgtccctcgtcaggagatcttcaccgcctgcgccgtcacaccgccactgacttcctccggcgagcccaccggaggcagctcaccgtgttcctccgtcggcaacggtggtggcggcgtggggggaggccctcctgctcccatatcgttgccgccgccatctcgtcgcccgtcgctggccgccggagtcccacctcccgcctcccccactggcctcctcttcatccgatggttgccttgcccgatgagagaaaagaagaggagagaaaaaagaaaaagagggtaggggaataagaggtntgcatgtgggacacatgtgggtcccacgttgagtcagctgccacgtcggacaaaaccggagtcaaaaccgccgagggacttagtttgcactggttttgtaggttaggggacgcgttgtatccggttttatggtttaaggacgattttgtaattcgatgacaagttgagggaccttcggtgtactttttccttgttggggagagatgtgtctaagacgggaggaagaaatctactggaccgggccaaattgacagatactcaatggaatattggttgtctgtatacattcgaaaaacttacctccctcgacaatggaccgaatctaattctactgtaaaaacaggtatatattgtctccttcaactatcaaaatcagctcactttatctttacgagtggtttttatttgacgtagcacttgacttggtcttctaacatggtgctctaacatggtgcttaattagcaattcaaccggaaaaaacccatagggtccagtggtccacatatcgataatattgttgccatctcacacctctatttgctctcttccctctcaatagtggagggatctacagtggtaggcctccttggatcgtgatagtagcaacactagcatgaactcgaggaagagtagggggttatttgtggagtgcagagcaggccacacttcgtcgggtggagcaagcagcaagcgacgagcgatgagacggcgtggaggttggcccctatctcggcttccttctcaactccaaccattagaccctaccaccaagatagccttcatagctccatagatggagggtattcgagaacaatgaaggagaagacgttagcgatggtttcgggcttgcctagcgcgaggatgatgcggcaaagtagggcttcgtgggtttaccagctgtcaccaatgacttgtgctgttgccggcactagcacgttggtgagaaaaacagactcccgtcgaggtggtcgagcctgagctccaacacatccccaagccttgttgtctgcatggagccatcacaatcaccgtctcctacgacctcgggtcttttaaggagaaagggataagatggcaataatgtttttttttactgatatacgagtctcttttaattttgtcatggctaaattacttggcagatgaatcgaatcaatgtggcacgtcaaacaaaactatggactatgatttgacgtaagcatcatgtagcacataacatcttcaaaatcacttgtggtaaaatgagatgattttggtagctgaaaggctatatacatagttttgtcagcccatagttaagggaggtaaaatggacttttcttcatatccgttttattgctgcggcagtgcgggattacggaatggggtttgatgggagttgcgtcataatcatgaacttatcaatggcttaaaccgatttaaaattgtcgtaaaacatgggagcaccgagcacatccttctctcctgctttccatgatatttgaccgccacaaacaaattacaggcgatctaaaccgtccgttcaacctccaatacggatggcccgacgcgaccgacgccccacggcccacggcaccttctcgaccctgacgcgtggaccctctaggctactactactcatcaccgcgggccccgcgaaccagccccacacgacggacgccaccacgctcgcggtggactcggtccaccaagaccgcaggcacaggcgccggcggcgcacacaacaccggaccggagcaccggaggcgggatcaaggtgaaaggccacttgtttgtgtggactgtggactgtggtctgtacctccacggctccacctcactcgtcgcagctcgagagttcgcccaagtctccccccgatccgtgcagagatcctcgtgcgtccgaggtaagcacacccccccccacccccaactcccagttcctaagccctcgtagattcgccattccaactcagttttcgcgcacgaaatgttcgtcttctttcttcgtcctaggtgagctttattgcagattcgccggttcagtttcgtttgcggctagaaatgttcgtgttctggggcagtaggatgggtgtcgggtgcttgatccgtggttcatgaggagggttttggagtgtgagaagatccgagacaccgcactgaattactgatcccattctgtgcgtgtgagcgagggagagggagggagggagactgggagaggaggggttagttttaatgtagccgttgaatgattgtgcctgatttgttaggtgagcatggaggtgatgcatgataccactgggaagaaggaagtggttgtctgttatatgaacgcccctctaccgtacatgattgaagagaattacgggggatgcttctttgaagacgacgttgatcttgcacaggttctccaggaccaggttgggtgcgaccgcctgctaccttcttgtttgattgttcctatgctactgatttgtttcttgttttgttcctgttctccttgttgcatagaaatcttaacatcatgtgttccaccccatggaaaattgtgtgtttggacaacacaatgtacaatgttatggaaatgcagccaaacacttcatggattaggttgttaatttgtcttttgttttgttgtagtattattgaaagtagacctgaaaggtgaaacatctttggctctcgtggtgccataataatgtgtaaagaatagcctcttgatgacatttacattgtaaaacttctagctcatccctcattgttacatggtgctaattaccattatcacaaaatattttgtacagtactagttatttgtcgaaggtttttcagtaggattgtgatgtttctcttttatagtacaactgcacaagtcaacagtgcatgatacatatgaaaaatatgatcctcatttgcttgatatgcttgcaccttgttcaggaaatagtctatcaattaatacaaggaaattatggtactggttcatccaaaactcattcaaatcctagttctagttatagccatggatgtgaattgggtgaacggaaaccatcaggagttgcaagttatgaagcgcaactagttgttgatgaagctttagctcgagagctgcaacagatggaggaccaactagcaagtgcatcaattgatgaccataacataatagaacatggttagttgtttactggtactcttctatatagtacaggacaactggtgagtgtctttcctctcgtaaatgctaatacgtggttcaaaaatatctgttcaggaagaaagccaatagcttcttcaacatctagcggtggtaatgcttctgcaagcagacctcctcaggtagtgatggaggatggcattgatccagataacatgacttacgaggtgaattccttcaaaccattgttttgccagtattttctctactgtttcgtaaggggacgtgccattgtcaactggtcttctactccatgaactttcatttcaaagtacctgtatagtctatggtaactactgttgtgtcatagaaaattcaagtatacaaaaattggacgtctccattttacacacattgctctaaccatgtttactatataaaaattgtaaagttgttctttaacagcttattgcttttaacaaatgcaaataaatgggataattgaagctattttcttttattttgttgaattttgtttgtatttcaggaactgcaacaattaggggaagctataggtactgaaagcaaagggttgccggaagatgtgatagcgctcttgcctacttcaacatacaaaattaggatattctcaagaaaggaaaagcatgacgagtatgtccctgtcctgattagatatttcagtgaaaatgtgatgtgcagttatcaacaggttattaataaacattttctatgcaacactctcatttacttattattattgtagaaggatatttggttagtacttttctgatcttaagttgcatccttcatcattgtgctagcaaaggaagctcctagagtactcgttatctatggctgcatgttcatgttgagttatattgcttgagtatgaaagtatttttaatacccacttctttgaatgtttacaaaaacagatgtgtgatatgctgtatgacttacaagaaccgagataggctgactaaattgccctgtgagcatcagtaccatcaaacttgtgtcaccaaatggttgaagatcaacaaggtaggccaaccatgcttttcaatctttccaatgtttagtagtgataagtgtatatgtgtatttattgtagttaccgtgaatatgaccttgattactttgctcaccgtaaaattgttctgcttttcgaaattccatcttattacctggtcaggctagatttaggctgagttcaaatctacgggtttgtcacccgtcctccctagcatgcaaaatggagcggcggattagtgcatgatcaattaagtattagccaaaaaaacttgaaaaatggattatgaattttaagcaactttcctatagttcttttttttttgcaaagaacacactgttaagtagttcgggaagcatgcgcgtggaaaatgagggagtatagaagttgcaagaagggagtatagaacacacccttagatagaatgacaatagtaatgtactgacaagaagacttaaataggtaatgagatgggtaagttatgaggaaagctacccaagaaaagagcttgtaatctcgtgtgttcatagatttacaaaatttttgagaccatgtttgcatccagaatgtattgatactgatcagccttgtgacacatttgtcaggtatgccctgtttgcaacaaggaggtttatgggtcgggcaagtgaaacattacggattcatctttcatgaaaaaggaggcaaacatgacggattcatctcacgccagttcaacaggcttaagaagtatcattgttcactggctgtgcactcattagcatgcatcatggtggcaggaaaggcaatgcattgtattgctaatgatcggaagattgtcagcgagttaccgaggaatgtctcagcaagataaataagatagatgcttctgttctgtttttaagctttatggagtcttcgagtaactgagactcttatttcagctttcaggcctggtgctttacacacactgtattgtaacatatcataggatgtatatcagtatgtgtatactgaagattagttgcatgctagcatctctgtattgcttgtactcttatcttttatggtatcaaatttggctgctggagtcagacttgtatggtcttcttgatgaatggtcaatggtcaattccctgacttctgagccaaccagctggaactatggactgctatcgtctagccagagagtgtttggtcttgtttccaagtggccaatctatgcttggataattctttataatggaacattggactattctacatccattaacgaaatataaccttctaaacaggactaaatgatgttggcataaaggctttgtacaagggaagcagcttatgaagagacaaatttgtgggagcttctgaaatgagcatgaaaatgacaaattcgacgggaacaaggacacaaaatggcaaaagtcgccatgaaactgcatgcgtggtgctcgtcagagcggaaattcgacgcacacaacggcacaaacgcgataggatatcgttaaaccccaaaacttgaccatcacaggtggcgcgtcgaagtactcgtttgaccagacaactacacaagttcatctggattagctttgtttattaaagtgtaaatttcacttcgggccatcttttattaccgatgtttcgttttgtaccaccctttaagcaatattttcattttggactgggtaaacctgcctttgtttcactttggaccacccgactctcttctcaagcatataaacgatctcgattacatcgtcccctactcgtcaatgaactgccacagctatatgtaagactatttcttcgacatattataagttggatgtagatggataaaaaagtaagggtggtccaaagtgaaataaaggtaaaaatacccagttcaaagtgaaaacattagtcctaagatggtacaaagtgaaacatcgataataaaaggtggccaaagtaaaattaactctttattaaaccaatcctgacgctgctctgcccgaactgtcacgcccactgctggtttcagataggaatcctatcctgacgacgaagcttgtcattttccagacatcccctcgaatcatagcatataagcacatcataatcaattcatcaaactcgacagggatttgtagttgtttagaagggatttgagaggattttattagggtctgaaaagcaattgtttcggaatgagaagtacttaaccgacgaagtgagcagtactagtggactactaggcgtagtgtctacgaagtggataggtttgcaatgggctgggccccaagctaggttgctgactcggatccacgcccatgggccccgatggaaaatgtttcatattgctaggcccaaatcgcacgggggcccaaaggttagcgcagcctggtcccggctgattagacaccggcacatgggccccaagtagttaatcattgatgtgagattttctggttgttaagaggaaaatccggagagaagag

SEQ ID NO: 79643 - DNA, 5350 bp, Oryza sativa
tctcgttctctctctctccctcttctccgctctgtccgggtgccgcgccgcgtgcgcgtgagccgcgccgagccgagccctccctctccgctccctcgctgccgcttcccgcgcgccgttgttcgcgtgcgcgcgcccgcgtggacatcgcccgtgccgcgcctgcgccgtctgcgccgcccggccccgctgccctgccgcgcagctgctcggccccgcaagccagcacgcgtgcccaagccgtgccgctcaaatcgccgcgccgcccgttgcttcccgcgcgcgcgtgccgtggtggccgaccgcctggtcgccgccgccgtcagcctctgccgcgcctgccgcccgtgtcgtcgccccgctccaaaccaccccgccgtcatcgccgtcgtcatcgcccggcccccgccactccgcgcgcaagctgccaagggacggaggcagagctccttctccctctgccgcgtcgcccccgctccctcctccttttcccgaagaggcaagggggcaagcccccttttctctccctcttttcccctttttcctcctgccggcgtcatcctcctccctcctccctgtcgccgctttggccacgaccgccgagcgctagccctctcctttgaccgccctaagtcggttcccaaaccgacattgccatcctataaacccaagcttccccctttcctttcctctcccattcgcctccacgccattgccgccgcctcccgtgctctgttcgccgtcgccgttcgtcgttgcgcttgtcggaggagccggcacgagcaaggacgcggaaggggactccgagcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagccgttggctcgtctccccttgtcctgtgcaaccacccggtgtgctcgctttcgcctgtatcgccgtggttcgctccaccgctcgccgctgtcgtccgccgtccgttccggccggcgtcgtcgtctacctcccgccggcccgcgtggcagccacgtaggcgccacgtcggcgtcagctcggccaaaaccgggtcgagtcgaccccggttagccgctccctccccgtgcgcgcggtccaccgcgagccatgaggctgcgcgtgggcccgccgcatccgcgtcctccgcgaaccgcgcgcatgcaccgcgtctctcccccatcctagcaccgcgccgcgtgctccctccgcacggtgagccgagccgctgacaagcgggtcccactcgggaccatgcgaggtgagcccggtccaccggctctctctctcctcccctcccgcgcgcgcgtgccttgggccgccttgggccggccggcccatttagctcggccgagccgccccttttctctcgggccgcgccctagccgcccgagggaagtctaattcccctccctcttttcttttcttttcttttctttttcaaaaaggatttaatcaaatccttttcctgtagaccaaaaatccaataatcttacaaaatcaatatcttcccaaccggcaatccgttagactccgttcaactaccaaaattactcaaatctcgagatctatctaatggcacgcttaggggtcattaatagggctttattttcgccgtttgttgagttgtcccgtttcgcgtgtagcttcggagcccgaagacccgcagtgcgaggatttcgaggatcaagctccagatctcgagcaaggcaagccacctttgaacatcttgagcctatattgaaatttaattatgttgcttgaaaaatattatgcattgataggatcgcacttaatctgttgtcccgtctgcaaggcagattggcggacctacctaatttgttgcatttgatccttcatttgataattgttatatcatgtccccttgtaaccatctagttgcgtctcgatattcgtgcaccctgtgcgagtatcgacggacgccttcaaacttaaaatctgaaaaacttcttgggtaaaacatgggttttacaaaagtcttggaaaacccgacacctgggtcggtgcttgtgaactaaatgaatttccaaaaccgtggaccggggaacgtaccgggtgtacggtttcccgctctcgcacttaaggaccgtttccttggaatttcatccgaacataagacaagtacgaccacatgggtggaatgggacacccctggctgagtaactagcttatcagggaagccttgatgccgagagacatgtggattcgccggggtggtgtcggggaggacccttgggcttcctggcacagtatggtctgggacctaacctgttgttggtctgggacccctctcgttggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttattaaactgttcgaacagccgtgcccacagtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgagagttgttggccgggtgccaatcttgatcaattctaaagactgatacattgcacaaactccgactggacgagacgcactgtctcatccgtgtcgtttgagaagcactcacttagttgttttcagaaaggagttcaaataaaatcaattgtaaaaacaacagcctttctttgaagcctgcattaaacacttatttcccatggcttgctgagtactcccgtactcacccttgctctatataaataatcccccccagttgctgaagaagttgaagcggaacctgctgatgaggagttcttccaggagcaagccggctacgatgagttttagggtttcggcctagttcccaagtcgcgcctgtattggttggtccaagtcctggcttccgtttcccttttgtaatgcagttgtgagctcgggatctgtccgcagtccaacatgactgtacctctactctataataaagagacctctgttgctgtgatattccgtctccctgtgataccagcactgtttccagggactggtatcgattaacaggttaatttagagcgtcacgggctagttccggtcgggactagttcggggcgtgacagtaggtccgccaatctgccttgcagacgggacaaagagattaagtgcgatcctatcaatgcataatatttttcaagcaacataattaaattcaaatataggctcaaggtgttcaaaggtggcttgccttgcttgagatcttgagcttgatcctcgaaatcctcgcactgcgggtcttcgggctccgaaactacacgcaaaacgggacaactcaacaaacggagaaaataaagccctattaatgacctctaagcgtgccattagatagatctcgagatttgaggaattttggaagttgatcggagtcaaacggatttacggttgggaagatattgaatttctaagattattggatttttggtctaaaggaaaaaggatttatttaaatcctttttgaaaaagaaaagaaaagaaaagaaggagggggaaaattagacttccctcgggcggcgagggcgcggcccgagagaaaagaggcggctcggccgagctaaatgggccggccggcccaaaaggcggcccaaagcgcgcgcgcgggcggggaggggagagagagccggtgggccgggtccatcccgcgtggtcccgggtgggacccgcttgtcggcgactcggctcaccgtgcggagcgagcacgcggcgcgcgctagggttcggggagggagacgcggtgcacgcgcgcggttcgcggaggatgcggtgcggcgggcccccgcgcagcctcacggctcaccgcggaccatgcgcacggggggggggggggggggaaacggagggagcggctggccgggtcagccgatctggtcgcggccgaggtggcgcctacgtggcagccacgtgggccggcgggaggtagacgacgacgccggccagaacggacggcggacgacagcggcgagcggcggagcgaaccacggcgatacaggcgaaagcgagcacaccgggtggttgcgcgagacgaggggagacgagccaacggctcggattcgccggagggagtgcgtcggcggcggattgcggcggcggcaaccggcggggagggaagaggggaacggcgacgaggtcacgaggggccgattcccggcggcgagagcatccacgcggctacgggaatccgtcccttgtgccggattaggaggaaacgcatcgagggaggccggcgacgagaggcgcttccgagctcgggcggcgacggcggcgagcacacggcgagcgacggcagcagtcggggcggcgccggctagctacggggaggctactcgtgctactacccgagtctaaggggaggagatggaacgaggagggagaacggggagatgcgctaccgtgcgggacggggcgtagtgacgatgggccgacggcacgggagtgatctctccggcctcgggccggggaagaggaagaagagggcgcgcccggagtccccttccgcgcccttgctcgtgcgggctcctccgacacgcgcgacggcgaaaggcggcagcgaacagagcacgggaggcggcgacaatggagtggaggcgagagacgaaaacgagggagattggaggagggaggagcttgggtttataggggcggcaatgtcggtttgggagaggggaaccgacattggacggtcaagcctgcgagctggcgcccggctagcggccaatcacgacgacaggaggtgacgccggcgagagggaaaaagggagaaaaggaagggagaaagggagcttgtcccttgccact

SEQ ID NO: 79644 - DNA, 9105 bp, Oryza sativa
tctttcaatccaagcaaatgtattccctgtttttctcacatctacagcgatcacttgctatcaaaatgatctggaagagtaaatgcacagtagtcttcctaactgcttttgatgaatagactaaatacgagataaatgttgcaagaagcacaagtaaaactccagagtggaacaaactgtgtaatgtgcaaccaagcaagtccagaagatgcccttcatctgtttttcacctgcttgtttgcccagcaatgctggcaatttttgggaatccactgggatttcaaccttgaatttatgcacatgattcttacggtgtgtcgagacttcgcgcaaccttttctcgttgaggttataggacttgcatgcgcaatatttggacgagaagaaataatcttatgttcaacattgctccagtttcctttctatcctggaaaaatggcttcaagggggattttgatcttcatatgcatagagcaaagatatctgataaaccactctagcaattatggattagctcacttttttaatccaatttttattttccttttttctctgctgctcctcccctctacatattcctgtgcattccccccttttccattttgtattttatcctttcattaatattaatgtagtaggagcctcttcaactgttttacgtcaataaaaagtagtaagcctgggaattaaggaggaaaatgcagtaggcaaagatgtccagtgttttcgatacaagaactgaggtcataggatgcaagattgtccaaacagacataggcctcgttttttttttctccaacaaaagttagatgaaaatttggatattcgtggcatgcttttcaaaccgctaattaaatagtatgtttcgtgcgaaaactttatatatgaaagttgttgtaatatatcatataaatctatttttcaagtttataataattaaaacttaattaatcttacgttaatactatcttgttttaatcttcatctacagcacaaaacaccaccatactcttgccatagatggcagaaagtgtaatgttggccgtaggaaaaaggttttaccagaatgacatcccgtacgtgagatttggtaaaatgctacttttgaaatttacgcaacactctataatgcatttttctcctctttaggtgttttttttcctgtcttgcattgtgaatgaacgaaaatgcccctcgcgctgtgttgaactgtttagaggggatcgttctcttcctctccacccgcagtgcaccaacgagcttgagcagcctcgcagccgacacgatgccttggtaccagctccaccacgagtacaatggtgaattagtgatgttgttatttagcacaaatacgtttctaaagcacatttttttataaaaaaaaaattccatctagaaacattcatccgaagaacttatatcaaaaaaaatttttttgtccaaaaacaactttcaccgaagaacttttttcccaaaaaatttcatatgaaaaaatgtgtattcttaatgcacatgagccaaacaacaatcctaatactatggtgtgtctaggagaatgcattgatacaaaatttgaatatggagtgaactgagcatagctcatccggtaaggtccctaatcactctaattgaaaggttaataccaaaacacgctgtcactgggccacgtaattagaaaaataatagccgtccgatatgaaacgcgagaaagaaagccgttcgatagagtaaaggaaaattcctgatggtgagtttgtgacacttcaggagctatatgcttcgaccggaacactcgcacagaaggtctcacatgatgcactgatgctcacataaggcggcaagaaaagaagagatggcgagatgaggaggtgacgacgacttgctgccttgccgccgctaggctctctcgagaactgtcacagcactactggagaaactatctttgttggtcgacccaaatctacaataatcacggtttcattaaaaaccgggactaaaaaggatttgggccgccaaattgagcctcgatgcctatgatttggcaaagaagctcgggatcatcagggtttgctgcctctcctcgatcgctcctatcgtcgtgtcgtacgtgctgccgttgtcatcaccatcactgccactaggcacttaaggtctgtgtcttctccatcttcctcgcacaaatccaatccaggtgaccaaggagctcaaggatgggtctaggcgcagcctggagccggccagcttcattcttcttccccagcatagatccaccgctgcaaaactcgagctgtgcctgctactacaggacacgagagggatggagatggaggcagcaatgtcctagatgctcagccacagcctgttcctcccagcctgctaatagctagatgcgcagcaagcaaagcaagagaagagaatggggacaggatacataaagacgggtcaaattctcttgctggacaatataagggcatgcacaactctcttcgttgccatgcaagtaaaattgatgacgtggaagagagaggggaaagaaaaggaaacatagttgctacgcatgacaatggcttaaagtcgactcttaacatttattaatggaaattttgttgcatggggatggacaaaaggaaagaagggtagtaaaataatattttggtgcattaatggttaagagtttttgttgtctcaactattgtaggaatatagtctacaagttatatgtattaattgagagaacatatcagactctacatttgtacatgccctaatggtgcatacgtaactatttaaaaacaaacttttcaaatcaaaattctcaatgatattaaaatattacttcttttatctcaaaataagtttggtttttacccatcgcacacataccaatacaaatcaaaagactataacatctccactttatcaaagcttaatgcaatttttactctatttatctactttccatacatttatcatgtactttcacaaacatcaattcaatgattactaaaaacaaacttattctgagaaggaggaagtataagagtaggttaagggatgcatgatggagtattggagaggacggtaagactatcactaaatcagcattaaagaagaccgttatatatagtcacatagatagaaaggggaaacagtggagaagaagatgaatagaaactctaaccttaaccattgcacactcactgttttgtttagctcaaagctcatgcagcagcgaagagggcggatatggtcgcgcaaataaagaataaaacaatgatggtgaaggtgaatataaaccctaaccctagccgatgcaatcattgtcttgtgcagctaaaagataggtttcacatttcagattacaagtctatttacaataatattacaaataacatgtttcaaaattcaaccaagagggaagcaatgatcacgcaatatgtttggtaaaatattggaaactataataattttctcaagtacaaatcatgataaatttgttaatgtgatagtgacacttctcacaaagtatattattagtggataattacaaaatttaagctaattacttagaaaatgtataaacaggtctaaacaacataaaaactaacaattctaataaagagggaggtcatagtcgcgcaaatatgcgacttataatagactagtttggtgtgaaacatgtatgctcatctggtaaggtccttaatttgtggtgacacatgttcacccaaatttaagtcctagacacatgtcgtatatattagttcagtctttaaatgtcaggtgtgtgtatgcatatataggtatgagtgtgtgctaatttatatgattacatttgtctttaccaagtttcgaaaatctcgtgttttggcgggcctacatcatgttaggactgacatgagtcggtatatgtgtcgatttaataaaacgacggaaatacctttatctctactattgtaaaaattaaagatgtttttatcggtacttttggtacgccatccgtgtttgaatcggtttttaagttcaatcgctttggaaatatagatccgtgtttgagtcggtttttaattttgttcgtttttagaaatatagaaggagtcgtataagaaatctctttacaaacttgcatgctaacttgaaatgatcgaacccctaattgcggcttatgattttataaaaagaatatccaagtgaattcctacggtgaatttcaccttagctaaaccgtacaacaataataagattaaaatactcttcacccgttgtaacgcacgggcatttttttagttagaacaaaagctagcttatgtgcaccttgaaaagtaggagtataatcattaaccaacgacggagatattacggaactaatttataatccggatcggctaaaactcacctttgccaatgagcaccgcgacatgcaaagcgtttcggccttgaggtccagagtaggacagctgttcgtccctctcgtgcagcttcttcgcaacctcaaaccgtcgcagtgagatggccaggtacagcggcgaggtgcctccttcttctcctggaacacgggcaagctccggatcgtgggagaggagctcgtcgacgacgagatccctgctgttcgagcggatcgcctcgtgcaaggccgtctcaccgcgcttgttctgcgctctcaggaggagctccaccgccgccctctgtctccgccgttcgccgccgtcgtcgtggtcgtcgtggtcgtcgtcgccggcctcgtcttttgccatggcgatgaggcggcggaccatgttaacgctcccagccctggaggcgcgatggaggggcgtgtcgccgttgctgttgcgggcacgtatgaggtgcctggctgccccgtggatcaccccggcgcagtcgaggaacacgtcgtcgtcgtcgtctccgcatgccgccgccaccgccgctgccgccacgacatggagcgcggagtccccttcgctggtgactccctccaggagcgtgttcgcagctgcagatggcgccgccgccgcaggccggtcgacttggaggacgacttgtggcggtggctgtgctgtgttcacggcgaggaggcgttttagggtctcgatgtctccatgtcgagcagccatgagcagcttaggattcatggtggccggcgcagctggtattgcgttcatctttgagctagctagttagcgctctctatgctgcctctctgtgaattagacagtcccttttcttatacaactgacggtgtctttagctaatccaagattactataagtgtgataaccaacaagtgatttgtttacaactatcctgttttaggacaagggacaaaagtaaacttgttatatatatgtatatatcatcaatcatcgatggctacattcttcaccataaaatactgaaaaaacaggaacgcatcgttcttatactcgttcagttatgtttaaactagggccgttcaactgatagctatagttgataagtcattaagtcacatcacaataatttgtaacaacaaagtcgcactcacacaagtcgtatatctgtcttcaaattaaggaccacttggaggtcgggagtaaaattgaacttattgcggcgtgacctcgaagacatgccaatatatagagaggttgggtgacaggaaggaacaaaaattacaatttttattgtaactaggaaggtagtccgcgcattcgcgtgggcatgcatcgtatgctaagtttgaaatagttataaaatctaaatgttaactggagaacatctgccacgatttctccatacatttttttcatcggcattaattgtttcataattttctaacctattagctgtatattggactatcatctttttatattcttcctcatcatttgaaaagaaggtagacttattatctttagaaaacatatcatcacaagtaaaagtaaggtgttttttaattgcatatatattatgatagtttattatgggataaattggggactattagggaggacaatgagaagagtcagggagacagagaagatagggacgatcaacaaaagaatatattggaaccgtgagggtatcattgcatgttttatttagtggagacacattttttattaagtaatttgtatacttaaattatactatcaaattttagtagtatataaacatttttcgtcttttaaatttgatgactgtagttggttatttgacacattgaaaaaatagactcaaaacacgtcatagacacattgaaaatacgtagaacatcgttatcattgttatcatggatctaatttagctacatatatgtttctagattaatacagaatagcacatttgatatcgtatttattgaaaaaaaaattcatcactgtcttgatgcatagcatatcacttctataattaaaatatagttaacataggtcttaacttattaatttaatcacaaatattataaatattcaaaccagttggaaattagatacacagttaaacagttatatttatttgaatgttatttttaagtagttaaccacggtatactcttgctctatgtacgtacactatattttttaactaacttatgtgcgtacacttagagagagcaaaaaaaaaaaagttcgttatttctggatcgctccaaggccgaacataggcctgttattttacaaatctaatttaactatctgacataaatagtggatccatcatctttagttgaaatcgacggacggatatttatcttttttttcttttttgtaacttgggagttataatctatctaattaatattttttatttatatattaagtgttagctagaaaaatatgaaaggtcagttagaaaataggagaggagaagagatacggaggctggatggagtacggattatgtacgtgcgcaaatacggtgcggggtgttgtacaccggatttttttaatagagatataatggttaaaattaaagggtccacctattcaaaggaaaataatgattagatgtatttcttttctatcagaatttttaagattttctctactatattagagtgccatgtgacggtttaggagcatttgtatagcaccacgtggcggtttaggagcgtttgtagaggatttctcaaatttatttgagatccacgtagcggtttaaaagcatttgtagaaagtttaatgtactagatagatttagaatatggtttaaagaacattgattggatatttatatagatctttatttaactaaatatatttatatttgtgaagtaatatattttatctaaaatcatattttaaaaactgttgatttttatggaattatgtgttttctatcttttttttccatgtgtatgttttttttttttttggttccagcaagattaggaaaggtcatgtacattaagtttgtacgtatggaaagatcagcagtagtatcatacaaacacatacgtacagatcatgaggaggttattattttttaataatagatcaatctaatggtgtaaactaacgggaccatcaatttaagtgaaaatcaacggtgagattagataatgccatgtggtgacttgggagagtttgtagagcgccacgtggcggtttaagagcgtttgtataggaagtttcatggattttaggatataatagatagatagattttggcacgggcatgctatattccatgggtacatactgataatttgttgtaatttattattctattaaggtggttgtaatatttactcgaaccactagcatgccgtacattctagtgggatgaatcatccgggattcatttactcgatttttgctgggtgttttttcatttgctcgatttttttttctgggggagattttttcctggtttcctcgtgctgcagttatattttcagctcatggaagaatcgggcatttaaccaagtatattttttatttcttgcattctcttcctgtcttccacctaaatagcttttttggtgttccgttttgttctttcgtagttaattatttgagagttctgatagtgaagaggtcgaattgagacctcctctgcatccttttttttccccagttgtttgatttttggattaatcttggatttcaagaagtgaccgaagtcatacactttgagattcttcagaattacaactccgaaaattactttggaacacgagttttggtgacgttaatcaaagctctgcaaatgtcagtctcagattctattctgctgagcagtctgacaccttgactttcttgtggaatcttagggtctgtttagattcatggactaaagctagtctctatcccatcggatgttaagacactaattagaagtattaaatatagattaatgacaaaacccattctataaacttggactaattcgcgagacgaatctattgagcctaattaatccaccatgattagcctatatgatgctacagtaaacatatgctaattatagattaattaggcttaaaattttatctcgcgaattagctctcatttatacaattagttttgtaagtactctatgtttaatacttcaaattagtgttaaaacattcgatgtgacaggaactaaagtttagtcgctggatcaaaacaccaccttaagaaacaactcctgcaagttatttgacaaatttgtcttagtggagtgaaggcctagtaaaataccagtataccaccatggaacaatttggtgctgattttatttttaaaaaaaacttcaaaagagaacagggagttcctgttttgtatttattaagaaaagatttggtctagtttttaagggaaattaggtgctaaaatatagttatgtgcaaatacgcgtgcgtccttattgttttgactgaacttgaaaaactgtaattctttcatgaaaaaagatttgtctcctttttaatcattgtcattacagtttaatcactctgatattagcagatttcaggaattagctacctgcaagattccaaaacattctgtatttggagcaggtttttcttgtaattagctacttagctgcacattttacgtatatttcgccccacattccaaaacattttacttccactactacagaagtggtctttccatgcgggcgaaaaggattttc

SEQ ID NO: 79645 - DNA, 1507 bp, Oryza sativa
caaaataaaagttatagatctttatgagttatacaactttgttgttgatgactttttcagttgaaatcatttactgcttcaaaatattaaaatgttttgaaattcaaatttttaattgataaacacaaagtcacaacaaaaagtgcccaaaataatagcattaagaacacaataacatgatagagcatgattttagaaacatttaggaaaaagaatcatccaatttggagttcatatgagagagatacactagtttcaaattttatttttgcttacggctccttaagacgcccgtatggaaaaatcgatttttctatgcgggcgcttaaatgagccgcgtgcaaaaatgaccttgttttttcatgcggatctcttaagaggcccatttttccatacgggcgtcttaagcagccgtatgcaaaaatgccgttcgatttttgcatacaccactagttatggtccccatggaaaaatgatggggcctcgtacagaaaaatcacttttgtagtagtgttctgtgcgaacacagctaagtttcaacgaggaagacatccaatcatcgcatgggacattaagcagaaaacacccactgtttgagtatcacggatctgactaaaattttgttgaaagtccatcatcatgtgcataatatttatgggtgccaagatttaaaccctaatggatgaagtcatgtatctactactacaccatctcatcactaatctcctgcttggtattatcttcccatcttagcaatgcgacctcctctgtctctttttcccgtcttccacctaagtagcatttttggagtaacttagaagtttcaacaaatgaccgaagtaacacacttgttctttacaactaggaagatagcccgcttgatgcgtattagtttgttctgaaaatagttctaacaaaattaattgaaattaaagtaaggtgttttctattcttaattgtgtgttgaatgtatctcttttttctgaaaaaatctcgacaaaattttattggtaataaatgtattttttttaccaccatgttagccctctttttgattgcttcatatatatgcaattcattttgcatgtgaatcaataaagagaaaagttcttaaaaaaatatttattgtattttgaatttaatgattgagtgattctaattttgaatttttattcaaataaaatcattattttattctaaattgtcttttttaggattttaaactgtactttaatatcgtatcgtgttgtatttggactcttcttttaatacttactttattattccaaatttcaaatatttataacttatacttttatatggattcttatattttatattctacgtgaaatcttgttatatttttatagttttattattctttttatttttgaatgtgtattttaataaaattgcttgttttatttttttctgaatttaattacgaactccttgtaggccttgcggatcatctcgtcgacgacctcatcggtgagcctctcctgat

SEQ ID NO: 79646 - DNA, 3861 bp, Oryza sativa
tcaggctacaaagcgagagtactgatctaaagagtccaacccttcatccgtatctggtccccttacttttatagtccaaggagaggctcacattattataaatctactctttgtcttgtcttatcagcaatcttgtcgttgctggctggttcctatcacaatatttaagaaacccttcgagtcgtgcaattcgtattacctcgggatctgtctgagacagttgggctctcgccagtgtgctcgtacatggtgcatggtgggcctgacgagacccgacctgcccgaaatagcgccacggttgcttctttgcccgtttggctaaagcaggtggtgcagggcatgtgcgacgcgtgtccaaggcgtcaccggtcctaagtgactcagcgcagatgttttgtccacgccctttcaactctagactggctggggatcccccataaacttgtttcatttatggcggggcatgctacttcacagctggctgtggagcacgcccaacttcccggcaagttctgatgccgcgccctcccgcgtttaaagaagaggtttggttattctcggatgagcttcttgaagatgtcgttgatgaaggaatattctaagattatgtatcttgtatgtctcgacactcctctaggcagaggggcgtgagccctacaaggaccaaggtgagcccgaggcccggaacaaggctgggcccgaggcaaacctcagtttaaacctttatgtttggtatgtctcgacagtcctctttctcgagtagtgcatgaattgtgcatgatgagtttatactcgaggaggaagactaccctgtcgttgactacgtgttgattatccatgccgccaagtcgataatagctagataggttacccaaatattatacttgtgtgatccagatgaataaagagcaacatcagctttggccaacaggagtataaaaagagtaaatttcacaaaactacagatactatgaacaaactaccacaaaactacagatttaaggagttatatcacaaaactacacatttagcactaaatttatcacaaaactacatatttaagatgaagtgtcacaaaactacacgtttagtaactaaattattataaaactacaggtttagaaccaatttaatcacaaagtaataatgtttatagctccaccataacaatggtgctagggatttaaactccaaaagttgtagttttttgataagttcaatattaaatatgtatatttgtgatacttaatctaaaatctatagttttgtgataaatttggtgctaaatgtgtagttttgtgatataactccttaaatctgtagttttgtgataatttggtcaaaatacctgtagttttgtgaaatttactcgtataaaaatccttgtctccatctcttttacctcaatcttgcatatacccttataccaattgtcagggttacgggttaggcataccctttacccttcgatatacattacatatcggtacggcatacccacgcgcatacggatatttcttgcgtacactaaggaaatccttcacggagtctacggatgggaagagtcctactcggacaagactgggtcatcaatgtatcgtatagggtctattatctccgagttctacttggaaaccgcctgacctgcgatataaaagggaccccccggggaggacctgaggcatcgaatctcagagccaacacaaccctcacagcctacgaagtcggagcctgcaaggagccgaatcaccggggatctagtcgagccaactcgaccacgatctcgccggatccgtcaagttccattgttccctttgtaacctgttttttccaccatataatcccacatcaactggattagggctattacctaccaaggggcctgaaccagtataatcctcgtcttttgtctgcttgatgtcgtattacgtagatcattgtatcaatgtaccccaataccctctatatccggtctacgggtaccacccgtcgacagtggcccgccaggtaggggtattggctatcgatgatgtcggcacatcagcgcgcaccaatgcagaagcggagaatcaattgaccactccagcccagcacatcagagccgtcaacgctatactgagggaaaccccctacgatcccgttctgaaggacgatcttgcgcattggacagaacaattacgggaatcagtgaccaacctcagcaacgcattcgaagaggccgctgccgcagcgcacccagagcagccaccaactggcgatgccaatggtgaaaaccctgaatggagggaatcgcctcagcgacctacccctccacctcgcggcactggcgatctctgagatcacatcaacggtcgccgagaggcacgacgcacatgagacaacgagaatcattcccgacgtcatgtctcttcacggcgccatgataacaaagatcgaggagaccgctcaaacgaggaccgagaccgtgataactgccacaaccaccacgatcacaacgatcgcgaacggcgggtgccagacgatactagtcgaggacgtcaccataacaatgacgatgatggagaccggcgccgagacaacagcgggagacgacgacaggattctcgagatccaggccgacatcctcgtaatcgtacgccggagccaagcgacccatcgtcatcgtcctcgtcttcctcatcatcagacagacatccacgaaggacacacgatcgccgacaaccaaccgcccccagcgctgggtgtagggctttcagtcgtttcctgcgtgatgtctaatggcttgagagattccgacctggagcaatagaaaaatacgatgggagcaccgacccagaggagttccttcaagtctactccacagtactctacgctgccagagtagatgacaacgcgttggcgaattatttgccaactgcgctaaaaagctctgcacgttcatggctgatgcatcttccaccctactcaatctcctcgtgggcagacctatggcaacagttcatcgccaacttccaaggaaccgacaagcgccacgcgatcgaggacaacctacatgcgttgacacagaactcgggtgaatccttgagggaatatgttcggcgcttcaacgagtgcagaaatacaatccccgaaatcaccgacgcttctgtaattcgcgccttcaaatccggtgtcagagatcgctatactacccaggagttggcaacaagacgcatcacaactactcggagattgttcgaaattgttgattgatgcacccacgcagatgacgcgctaagacgcaagaatgacaaaccgaagaccgggggagagaagaaaccagccacagacgcgtctgagtcaagcaagaagaaaaattgcaaaaatgggaaaaggaaagctcaagcggaagtcctcgcagcagaatatgtcaagtcccaaaatgactctaaaatacatcctctaaattatgcctagaataattaaaatccgtgtgaaagcctccaaaaaaattaaaatgtgcaaagttaaaagtcaactaaggcttggaggatttttgtatatttcctaaaagcctaaaatgcataaataaattttagtgcaattttcagagcacaaataataattattaagaataaacaaagttaaaatggttttataaaaagaaaaaccctaaaggtcccctttccctccctcccccctcttgggccggctcggcccatctccctccccctctctctcctctccccgcggcccactcggcctctccccgcgcgcgcgccgctgacgggcgggcccgcccgccgccctcgctgacgagtggggcccacccgtcatctactaactcccgccgctcccgccgctccgcccgcgccaagcgcc

SEQ ID NO: 79647 - DNA, 8056 bp, Oryza sativa
gctctctctctccgccgtcgccgccgagctccggtccgccgccgtcgtcgccccggaccacctcccacctcggcgccgcctcttcggcttcgccgtatcctcgccgacctcgtccacccctctgtttcgctcgccgaccaccggaacgccgtcgaccccgtcgacccgagccgcgccgccgccttcctccgctccggccgcctttttcgtcgtcgccgtcgacctagggtgagccgtggaccgccgcctcttttcccccttctcttcccctctctcggccgccgctccgccgtgcctatggctgccgccggcgaccataggggcgcgggcgccgcctccggccggctgcgccagcttggccgccctcgggcgcgccgagtggctgccacgtggggcccggccgtcagccgcccgcgccctcgggtgcggctgacgcgtgggacccacggcgccggccggtgtgagcccgggtgcacccggtccaccgtggaccgtgaggctgccacgtgggccccactcccgtggacccggtccgcgcgcccctccccctcggctgacgcaataaaccctttttaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcgtaagatccgctcttcgtggaggtggaagccgacgtttgggaaagcgagcaaggcaagtcacatcatccttgaacatattgaatcccagtttataaaattattttgatttaaattattgcattaccgctttatttaaatttccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcactgattaattaggcaacattaggtggttttataactctagactttgggagtattctcaccacctggacactatggaatagttggattattgtggaattggattcacacctccccctctattcaaaaccctcaaaatggttttaggctgggctcggggtgcatggttttgatattagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtctttcgtccgtataccgtggtggtatgtggcacgtggttacacgtgaggaagatgtgtcttgtgggtaaagatgtacacctctgatcagagtataatctattcgaatagccgcgcccttggttatgggcaagccgagcaatgtacccaagttagtgttttaaattcttaaaacctgcttaacaactaaaatgtggaatggttggcctgggttggcttgggacgagctgggacccagggtcgggttgccagttcggtctgaatcatcgtaggccttgggttaaggcaggttcgtgttggttcacggccttgattaataatattgtatagctctagaatcgtgtttacaaaatagctttgagcaactaagtgtcttttaatgctgtttactgcaaaccgtaaccctttatattataacccccttgtactcccttgcatttatcctgcacttgtgggtgtgtcttgttgagtacggtggttgtactcagtcttgctcaatttttcccaaacccagaagtggagttcctggaagatgaaggctttggtgtctagctcgtgcctgccgtcaagtgcctgtggtcgtcgtcctagtcttccgctgtttcccgtttgtctttgtgtgtgctgggccttcaccgcccatgtaataaattaactatttacgcttccacttgataaactctgaaatgtatcaacttttggtgtaccttgcctcctggcacaaggaataatacacgcacgtaaggaacgcccgttgggttaattccggtcgtgacagaatacgcgaaccctcccaagcgtccagacccacagagtagcgacacaaagaaagcatggtgccccatacacaagacggacagacatctttggaagattgccttgttttcaaaaaatcgctcgagaagcacattgcatttgaaaaaggcaagcgagtacgcgtggtcgaaaaggacgcggaggcggttcctcaggaatcggattcagcatatccagactccgacctcgacgtttcagacatcttcggaggttccacaacgtactcctcaaagcgagaatacaagaaagtggaacgcgaagtctgttcgacatggcagggggctgcacccaagatgaagtggtctgagcagaagatatagttcttggaagaagaccaccccaagaccgccgtcatcccaggacgatatccgattgtggtcgaacccactattcggaacatcaaggtcgcgcgagtcctcatcgacggtggcagctcaatcaaccttcttttcaccagcactttggacgcgatgggaattccgcaaagcgagttgacaccaaccgatcaaccctttcatggaattactccccaatcctcgtccagaccattgggcaagattacgttgcccgtgactttcggccaagccaacaacttccgaacagagcagatcacctttgatgtcgctgaattcgatacagcttacaacgccgtcattgggagaactgcacttgcgaagtttatggccgcatctcactacgcgtatcaactgctcaagatgccgggaccgaagggaacaatcactattcaagggaacgcaaagctggcggtacaatgcgacaaacggagcctcgacatggtcgagcaaacacccagcccacccgccacgactgagccaccaaagaaagtgagcaagacaaacaagacgccgaaaccggagggtgcaatcaagatcgttccactctccagtgccaaccccaacaagaccatcaagatcggggcgacactaagcgagaaataggaactcgcgctcatcaccttcctccgcgataatgctgacgtgttcgcttggcagccattcgacatgccgggggtccccagggaggtgattgagcacaaacttatggtgcgacccgataccaagccagtaaagcaaagactgcggagatttgatccagaccgaaaacaagccatacgagaagagctcgacaaacttctcaaagctgacttcatcagagaagtacttcatccagagtggctagccaatccagtcatggtgcagaaggccaacggaaaatggagaatgtgcgtcgacttcaccgacctcaataaggcatgccccaaggatcacttccctcttcctcgaatagatcaactaatggactcaacagccggctgtgagctattgagctttctcgacgcttactctggctaccaccaaatcagcatggcaaaagaggacgaagagaagacagcattcatcacgccattcggagtattttgctatgtcaagatgccgttcggactaataaccgcagggaatactttccagcgcacggtccagtgcgcacttagcgaccagctcagcaacaatgtcgacgcctacgtcgacaatatcgttgtcaagaccaagacaagcgactcattgattgacgatctgcgggaaacgttcgacaacctccgacaatatcgcctcatgctcaatccagagaagtgcacgttcggagtaccgtcgggcaagctgctcggattccttgtctctggcaaaggaatagaagcaaatcccgagaagatcaaggcaatcgagaacatgaagtcgcccacaagactcaaggaagtacaaaagctaaccggatacatggaagcactgagcaggttcgtcgctaggatgggagaatgagggcaacctttcttcgctctgctgaagaaacaagacaaatttgtatggacacaggaagccgaagagacattcgttgcactcaagcgctacctatcaaaccccctgtacttgttgctccccaacctaatgaagaattattcctctatattgccgccatgccatattccgttagcaccgtcattgttgtcgagagagagaaagtacaacgaccagtctactacatcagcgaagctctccacgacgcaaagacaagatatccacagatccaaaagctactttacgcggtcatcatgacatcaaggaagctacgccactactttcaagcccacagagtcacagttgtctcctccttccctcttggtgaagtcgtgagaaacagagacgttgttggccgcattgcgaaatgggtagtcgagctgagccagtttgatgtccactttgcgccacgaacagccatcaagtcccaggtactcaccgacttcgtagccgattggactatgcctgataacaaatcagacaaccaagtcgacaacgaaacgtggacaatggtgttcgatggtgcactcaacagccaaggagcaggggcaggatttatcttgacgtctccctccggagatcaattcaagcacgcgatccacctcaacttcagggcgaccaataacacagccgaatacgagggactactcgccgggataagagctgcagcctcacttggggtcaagcgactaatcgtgaaaggggactccaagctagtcgcgaaccaggtgcacaaagattataaatgctctaaccccgagttatccaagtatctcgcagaagtcaggaagctagagaaaaggttcgatgggatcgaagtccgacaagtctaccgcaaagacaacatcgagccagatgacctagcacgacgtgcgtccagacgacaaccgctcgagcccggcacttttctggacatcctgacaaagccattagtgaaagaggtttgcggcgaagttagctcggacacccccgacattagctcggaggccacaaaggcagaatgcgccgttgccgatatcgagaccacagacgactggcgcatcccactaatcaaattcatcaatagcgaggagctgcccgaggacgatacagaggccgagaaaataacccgtaaagcaaagatctactgtatggtcggcaacgatctatacaagaaagcgccaaacggggtacttctcaaatgcgtctcatccgacgacagcagacacctcctccttgatatacacgaaggcatttgtgggtcacatgccgccggtcggacattagtcgggaaagcttttcaacaagggtttttctggccaaccgcccttaaagatgcatgcgacatggtccagcgatgcgaagcctgtcaattccacagtaaacacacaaagctacccgcgcaagcgctctagactatccctctgacttggctgttctcgtgctgggggctagatatactcgggccattcccacgaagacagggcggctacaggttcctattcgtggcgatcgacaaattcaccaaatggatcgaagtagtacccacgggggaaatcaaggccgacaacgccatcaaattcatcaaggggatattttgcagatacgaactaccgcaccgcatcataaccgacaacggctcccagttcatcagcgctgatatccaggattactgcatcgggctaggagtcaagatatgcttcgcctcggtctctcaccctcaaagcaacggacaagtcgagagggcaaacggtatagtactacaagggatcaaaacccgcgtctacgacaggctcatgtcacatgacaaaaaatgggtcgaagaactcccatcagtactatgggccgtacgcaccacatcgacgacgtctaacaaggaaacacccttcttcctcgtgtacggctccgaggccatgctccccagcgagctacgacatcagagtacacgagtacataagcattccgacgaggaccaggaagagcagcgaaacatcgatgtaaatctactcgaggaacatcgcgaacgagttgccattcgagcagccagctatcaacaggccctccgccgttaccaagagaagcgcatccgagcacacatactttcgatcggcgactacgtcctccgacgggttcaaagccaagcagggcgaaacaaactctcacccaaatgggaaggaccttacacgatcacacaagtcttgcggctaggcgcattcaaaattgcagacagcgagggtcgcaagttagcaaattcttggaacattgaccaactacgtaaattctatgtatgagtcaataccatccgtacctgtaagacaccttacagtatcaataaagcctattcttaggcccacattacaatcaaagtgttcccgcccgatgatcccttactctgatgacacctagcgttgaaacctatcctcatgtccctttacgccgtcttgacaaggcctccgaagaacctaagggatcttcggctggggacgcccagagccgataaggccttgttagatcctatagagatgaaagaccatgtaagatctggtcgtgtaagagttctcgccgtgcgtattaaccaagccgcgaaatcggaaattaactttctaacttcacggctgggggctaggatcagagcttattcaaccaaggcaggtcaaaagtccaagagccttatcctccgagaaaattcctccgacgacaaggctgggggctagagagagtgtacgactcaaacgattgactaaagtcgtgaactgagaaaacactcttacacacgacatccggagtaagaaagatttgtcaaagatagatttcttttcaatttcacaaaatacttcttacggtttttacacaaatccaaagttatattacacctttttcctgagatatctatcacagggtacgaagattaccaagaaggccaacgccaatccatagactggaacatcttctccgccaacggcgccatcgacctcgccaggtgatctatctcagctggagttttccgagaacgaacaaaaccctcacggagaaaatcgaggtccaggcgcgggcgatgatctcataggcaagccaacacgtgccctccggcatatcggctcgatcaacgacactcctgcttcaaggcctcgtcgatacgtttgccgacgccatcaagttgagtacaggccccattcagccacgagatgtacccagccgcggactcctcgggatccccacgaggtactcggagctctctacaaaccttggccatggatgtgcagcaactcttcaaatacgagttgaaccacacctcacgacctcggagcatttccacagcctgctctttcttcactgcaagcatagtcctctcgagttccgctacttcaaattttgtcttccaatattggatacgacaatcctggccagcaagagcactctcgagatctgcttagtgtgggaacgactaagtcaggctacacgtctcttccgagaacataggggatctagtcggagaagcaaaaagggatggatggaccactaacccaaggaagtggtcgccatctccgtccccgtagcaagggtttggtctacattgtcgggcgacgcatgtggttcgaatgtgagagctggaataatcgccggtgactcgggttgcccgcgctgctggacatccccgtcatcaacatctctacaagggacaaaaagctgtcaagatcaacatgcaagagtaagctagaacaataactactcgcacaaaggcggttaagatccagttttatacagggctgcaggaa

SEQ ID NO: 79648 - DNA, 2646 bp, Oryza sativa
ctagtataggtgacccgcaacgagccacggatttctgacagattgttcccgagctccgacatgtggtgctcgagcccctgccgttgtcgctcgttgccggccaccaactccctcatcttcttgaggtcttcacgagcctccgacaactcgtgtgccagccggtcagcccgctcgtttgccgacgacgccgtcaacctcgcctccgcaatcttgcgaccgatgccacgagcactagcctcgaggaggcgtcccatctcgacatagagctcctcccaagtgaggacggtagccggtagaccacggccagccgcgggatcgctgactgggccgcttggtgtcgcctcacggctcccgggtacgagcacgacatccgtcgaggccgcagcgggcgatgcgccggaggtccctccggactcgtcttgcatagccttcgtccgtgccgccctgtgagacggccatggttcagacaacactcgaataaaatcatggaaacttaagttcgtctacttacttctcgccaaccgtcacaaggcgtcgtcgttgtggaggcgggggagacgcgtccgaggcttgaaaaacggtcgatgcgaagtaaggcgaaattcttctggctgtacgatctgacgactggatagcttaccgagggggttgatgccttgcgacgatgtccgcttacagaggagaacttcctcccctttgtccgaacattgccaccacttgtagtagcagcagcagcatcagacgcctccttggcgaccttctctttcagagacaccgccacctgatgttccgcgagcggcccgatgatgtcagtcagaggaagagcctacgcttaatcaagtcacaatgtgatctcagaaggaaaacgcagaatgcctatcgagtacacttacattgatggcagcatcacgttcggccgcccttttctcacaaaggggaacggggatggtactcgccgttgtcggaccactgatcatcacctggccaacacgatgttccacggcttcactgttcaggcctatgaatcgagaaccaaattttgataaatcaagaggaacgcgaacatgagtatgtcaggataaatgcgagaaagataccccgaggagaaacccgggtcgcgtcctccggtctggaatagtcaaaggctggatgggctcgatcctggagcagctggatccgcttaccaacgaagtctgcagcgacttcataccccgacaagcctcgtactcggagatcgtcgataatgtcgataaacgactggagagagcgggtcaaagggggctttgcggtccaagacgaaatcttgtccggttgttcctcgggaacaacgaagacagggttcgaatctttgatctgaaggtagaaccacctagtccgccatttgctgcgagaagaagggcactggaaggggatataacgcgacttcaggccatcccgaagttggaacccgacgcaaccagacatgttggactccatccaacgcagctcgtagtagaagcgaaagagatcaagaaagggctctaccccaatgtaggcctcacaaagatgagaaaagatgctaagaaaggcgatagaattggggttcaaatggagaagagaaagaccgtagaagttccaaaccaagagaagaaattcggaaggcggagggagaaaaccgcagagaatatagtcttcggtcacaaccatgcgacctaagacgggctggggattagtacctcctgcttccctttccatggttccgcgaccgggatgggcgccgtcttcctgaagcttcttcagcgacgcactggtggaggatgatttgccgaggtccatcgttgatcggagatcgccgaagaaagggctcaggtcgatgaactagggtttcttgtggcagcggagaagacgcagagcgcttacaggcgggatgttttcttcacaataggcggacttcaaaatggatccccaaaattcctttaaatagacgcacttccgacagtacgaattccaaggaaaggggagagatgcccgccggagatttctgggtccgttacgcgcggcagttttttggacttcagtttaaattcactcatgaccgttgggcttcacacggtgttctcgactacgtcctgtctctacagtcctcacaccgggaacgacaatagtctcgacacaagaagtcgcgaatggttacacgagttcatttaagcagaagtcggggggctactgtcagggttacaggttaggcataccctttacccttcgatatatattacatatcggtacggcatacccacgcgcatacggatatttcctgcgtacactaaggaaatccttcacggagtctacggatgggaagagtcctactcggacaagactgggtcatcaatgtatcgtatagggtctgttatctccgagttctatttgtaaaccgcctgacctgcgatataaaagggaccccccgggaggacctgaggcatcgaatctcagagccaacacaaccctcacagcctacgaagtcagagcctgcaagcagccgaatcgtcggggatctagtcgagccaactcgaccacgatctcgccggatctgtcaagttccattgttccctttgtaacctgtgttttccaccatataatgccacatcaactggattagggctattacct

SEQ ID NO: 79649 - DNA, 13966 bp, Oryza sativa
ggcctcgccactccgcgcgcaagccgccaagggacggaggcagagcccctcctccttatgccgcgtagcccccgctcccctcctccttttctcaaagaagcaaggggcgagccccctttctctccctcctttttccccttttcctcccgctggcgttatcctccctccgccctgtcgccgattggacgcgagcgccgagcgccagctcgcgccttgaccgcccaagtcggttccaaaccgacattgccgcccttaaagcccaggcgccctccctctcttctcctcccatcgccattgttgccaccgccttccgagctctgtctcgcctccgccgttcatcgccaagcgccgggagagccggtgcgttcgaggacgcggaaggggactccgggcgctcgtcttcctcctcttccccggcccgaggccggagagattactcccgcgccgtcggcctctcgtcacagcgcccctcctcatctcggtagtgcctccctccgttcttcctcctcgctccatctcccccccttagttttcggtggtagcacgagtagcctccccgtagctagccggcgccgccccgaccattgctgtcgctcgccgtgtgctcgccgccgtcgccgcccgagctccgtagcacccgctcgtcgccagcctcgctcggcgtagctctgcccaatccgacgctagcaacggattcccgtagccgcgtagatgctctcaccgccgggaattggcccctcgtgacctcgtcgccgtttcccccttttctctccgccggttaccgccgccgaaatccgccgccgatgggctccctccggcgaatccaagccgttggctcgctccctctcattctccctcgtcatcccggtgtacgccccgtcgcccctcatcgtcgcaaggcgtcccggagaaaccgccgccgcccgccgtccattcgtggccgacgccttcgtcttcctccggccagcccgcgtggcagccacgtaggcgccacgtaggtgccacgtcggcgccagctcggtcgagatcgggtcgggccgaccccggtcagcccctcccgtgcgcgcgttccaccgcgagccgtgaggctgcgcgtgggcccgccgcatcctttccactgcgaaccgcgcgcgtgcaccgcgtccctcccccacctacgcgcgtgcgccgtgtgctcgctccgcacggtgaaccgtgtcaccgacaagcgggtcccacccgggaccgcgcgcggtgagcccggtccactggctctctctctcctccctcccgcgcgcgcgcccgacttgggctggccggcccatttagctcggccggaccgctccaattctcttgggccgcgccctagccgcccgagaaaagtctattttccctccctcttttcttttcttttcttttctttttcaaaaaggatttaattaaatcctttttcctttagaccaaaaatccaataatcttagaaattcaatatcttcccaacctaaatccgtttgactccgttcaacttccaaaactcctcaaatctcgagatctatctaatggcacgcttaggggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagtctatatttgattttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactatgcagagtatcgacggtcgccttcaaacttaaaatctgaaaaacttcttgggtaaaacttgggttttacaaaagacttggaaaacccgacacctgggtcggtacttgcgaactaaatgaattttccaaaaccgcggaccgggaaacgtaccgggtgtacggtttcccgctcttgcacttaaggaccgtttccttggaatttcatccaaacataagaccagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaggtgtaccccctctgcagaggttaacaaactgttcgaacagccgtgcccacggtcatgggcggatgtgaggtgattcctagcgtagtgttgtttgactactgccttgtgaaattgctgttgtggaaaggggttcgatgtttggaaaatctgcagctgatgggatcagctaggcccgggtggccgtttgaaagttgttggcccgggtggccgttgaaagctgttggccgggtgccaatcttgatcaattttaaagactgatacattgcacatactccaaccggacgagacgcactgtctcaaccgtgtcgtttgagaagcactcacttagttgttttcagaaaagagttcaaataaaatcaattgcaaaaacaacagcctttccttgaagcctgcattaaacacttatttcccatggcttgctaagtactcctatactcacccttgctctatataaataatcccccccagttgctgaagaagatgtagcggatcccgctgacgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtctgcagcccgacttgattgtactcctactctataataaagagacctctgttgctgtgatattctgtcttcctgtgataccagcactgtttcctggtactggtatcgattaacaggttaatttggagcgtcacgggctagttccggtcggtactagttcggggcgtgacaaccgttgatctcatttgatcgaagggttcagatctatttatactactaccccagttaacggtagtacaaacgtggagggacattattgtcaaaaataataggtgggtataatcgccatttaacagtgagtatacttttttcctcctttttagctttttcgatgaaatatgagtgatgttggcgcaataaatggtcatagatggaattaaccgggaaaaaacataaatgacaaagtaacctctagtcatcgtgttagtaaattgctaatctatcctaataatactagtagtataacaggtagagagcatctgagcatcgctatttccaaaaacgtgcaaaatatatttatagacataaaggggtggtgatgactcctttttgaagagaaggggttaggggtggcaactaattggcccaacccttacaatatacgagtaggagtcggtaaaagaattctggctaaggataacctggttcattaggggttggaaaagctgaaatgcattctacttttggtatgaaatccattacctggtagagtcgatgtttttttttctactaaggaatttattgatggttaggatgacagcaattctgcgggtgttttgcaaaatttcaaccattattatttgatgcaacctatataagatggctgtatttattcttccccaattaacttgattttttttctaggggttgttttaattagtgtaggcttcgcaaataaatatgtaggtaggtagataagattgggaatacaccgattgctacaaacgaggccatgtttaggtcaggagtgaaaagtttttgcatgtcacatcagatatacagacatatatttgaagtattaaacgtagtctaataacaaaataaattacagatttcgcctgtaaactgcgagacgaatttattaagcttaattaatccgtcattagcaaatatttactgtagcaccacattgtcaaatcatgacgcaattaggctttaaaaatttgtctcataatttacacgcaatctgtgtaattagtttttttctatatttaatactccatgcatttgtccaaacattcaatgtgacgggatgaaaagtttttgtttgggaactaaacagagcctaaatcagcatgaagaatacaagtatcgaaaaggaatgcatagtcaactatgaattcgagtttcatgcagtgtgactttttagaatttagaatgtctcattttccttaattaccagctcgattttgatattttcttttcatgagaaatcacgatatttatgcttttccttaccaattataatatgtgtatagattgacctttgattcagttcgagctaaaattattattgtttaatcttttttggggagagggggactattttcatagcttcttttccaagggtacaagcgcacaataacttgcacaaaagctatcacattaaagaaaaattccttgacgtcgtctagacagccctggctgaatcctcccagacttttctcccagacttttggtgcaagcgcgctctctagacgcatgtcctcttgtgttagcgtcctagcttacgcaagttggccatgtcggagggtctagaggggagagcggttccatccttctctctcacctctctctctctcaatcccaaagatgttgctagagttagggtttggtttcagttgttagggataggttcgggcgacctcggctgtagttcatttgttggcctagcggcggccggtcacgcttagcgatggctggtttggtgctagccttctcccgggtttgtgtttgatgttgtcggtgcgtggagaaatctttgtattttttttcctggttacgacctcccagggttgtaatcttatattttttccctgctctatcaatatgaacttcgcactgtctggtgcgagtcgttcaaaaaaattccttgatgattgttgcaaaggatgctttgcccttgtaaatgatgccttatttgcccgcggtgagtcactgacatgttattaagagtgagggccaaataaggggttgagttaacttttaggggtgaataaagattttattccttcaagtaacatttttctgggtgaaaaccatatctttcttagattggcgatggcggtatccttgatgtcgtgacctccatggtggcatcgttttcggagtctcgtccctgtgatgctgtcgtaggcctagcggcgattagccatacttagcgggggtcatttttggtgctaggctccactctcagttgtttgtgcttgtgtggttagcacgcggtgtttggtcatgcactttggtgcattgtggtgttttttcttgtaacttttctccttcttaatatattcgaatagcctccttcagccttcttggtgaaaaaaaagcaacattttttcagcattttggcattcaatcgttcaaattaactgcaatcaggagcagatctagcgtgggtgctcgagggactcgagtcccctagtccccaacccctacccggctaaatcactattgataaaaggagagatgggaggaggaggaagaacagagaggggaggaagagtaagggacattgaaggaggaagaaaaagataagtctctctccaattttgttctagatctgcccctaactctgattgaattattgacttgagagttcggaaatagacatgcaacggtaccactgttttcgaaggatgcattcacctaacaacccgtttgaattggataatgattctgtgcaggaatttgacaaactttggtcatgttatatagtacttgctacaggaatttgacgaactatttttcgagcaatacggaccgctatcttttgatccaattgcaggtcatctcaattgctttggatcaactgtccatgcatttatttcttgcagctgacgaacgtctcaatcgcagcccattaagtaattactactacatccgtcatattataaatgcggttatggtttccatgtccaacgtttaaccgtccgttttatttgaaaaatttataattttttttaaaaaatagtcacacataaaatattattcatgttttatcatctaataacaacaaaaatattaatcatatttttttaaataaaatgaatggtcaaatattagacacgaaaagtcataattgaacttatattaaaacagagaaagtagtagagagccccgtgtcaaaaatataaataagtaaacagcccatgcgtccaataataaatgtacatctctcaacataaagtcgttttggaattctagacattgtttatgttttcttctatgcctgtcattctcaaaaaacaagaatgctatccctctcacaaataaaatttgtcgtctttttcaagatagtatacatgaagggcatgagagttattttctcaagtcttgtgcataagcctaaaattgacttatatttggaaccatttgagcatgttttctttatattgttgatactggccattgtaaatagcatttgtagtattttcggatgctgatggagttaggccttgttaatgtctctggataactttgatccgatagccatcaggaaattctagtcctggagttcggactaccctgcttgctcccagcggtatccacctgaaaaagaaaagcgcaattatttcatctccttcgctctcgtttgcgagaccaaaaatttcagccatcgctgttccgaaatgttacttcaattggttggcacatcacagagatatgggatgacaaggatttggacttccccaaatatgccctcaagttggactgcgaaagagaaaaacactacctgtattttgtcacaaggaaatggaggaaaatagccaattgtagcttgctgaagtctgctccaacgcagaaccgtagtcctccgccgaatgccatgaagtgttttgatccacggtttatctctggtttatcctgcatgttacactcaagctgattaaaattttcttttagtggaaagctaactaaatatacccgaatgaatagatatttttgtgtctgtatagggggagacgggcttggccggggtacgtgttactccatccgtttcaagttacaagactttctaacattatccatatatatatatatatatatatgtctagattcattaacatagatatgaatgtgggcaatgctataaagtcttataatatgaaacggagaaagtagatctttcatgagtttattttttgttttttttaacttgtgggagatatgtttcataaaaaaaatgagtggaaaatcaggattatcaaaccttaaaccttgaagggatgaaggtgagaggatccggataaatatatggatttaagtgcactgctggtggacagaccatcactccccatcctgctggaattgtgtatcctgtcaccaatggatgtcacttaggaaaagaagaatggtattcagttatgctttttttaaaagtaaatttcacaaaactatagatactttggtcaaattatcacaattaagtaatgtatcacagaactacaaatttaactataaatttatcacaaaactacagatttaaggctaagtatcacaaaactacatattgaataataaaattatcacaaaactacatattttagggtttaaattcttagcactagtgttatgttggacttataattgttcaagttttgtgattaaattgtcattaaatatgtagttttgtgataattttgttactaaatacgtagttttgtgatatttcaccataaatctatagttttgtgataaatttagtactaaatctgtagttttgtgataaatttagtactaaatctgtagttttgtgacacgtcatgttaaatctgtagttttctgataatttgatcaaaatacttgtagttttgtgaaatttactcttttttaaccggatgcatgatgtactgactcgttagcaaggtttcaacatgtgacatagtaatctggagatggattctaatatatcgctcaataaacatgcgagttcaaaagtgacttttgtagtttgtaaaaaaataacaaaattaattgtgaatatagatatactatttaaattttgatttgctatttttattacaacttgtaaaaatcaaatttgaacttgtatatttgtagagtgccatattatacatgaatctatcttatcaaaaaatttgatttttttttcataacaatttaattagcatgcaacaaatcggtggatatctagctaagtgatcaaaactgtttcaactgaccacgttaaaaaaagctcaaactaatttttttagcaaattttgcctgaatatcacatgttttcatcgataactagcatggtggcccccgcagattgcgcggctagcattattatattttctctcatataatactacatatattttctcaatttgttattaaaatatattagaatgacaacatattttaaattttatattaactttaccaaactactaatttgtaatattcatattttattgtatatacatgatagttactaatatcaaattttagttatttctgaattgtatttctatatggactctatactcgcctttcaatatttcttttttttaattccgaatttttgttatttgcaaattgtattttttatatagactctaggctattcttttaatattatttatctttaattctgaattttcattatttctaatagtatttctatgtggactctaaactcatctttcaatattctttatttttttaatttcgaatttcaattacttcaaaattgtatttctatatggactttaggctcttcttcccatgtgttttaaatttcgaattttagttatttgtaaattatattgctatatggactctaaactctatttgtaattttattatttttattcccaattttagttagttctaaattcctatatggactctatgctcttctactgttccttattttttaattccgaatttttattatttcttaattgtatttctatatggactatatactcttcttctaatattccttatatttaattctaaatttcagttatttctaaattgtatttctatatggactctatactcttctttctgtattttttttaattttgaattttagttatttctaaactgtatttctatatggactctaacctgatttttattttttttattttttatttcgaattacaattagttctaaattgtatactggcatgaactctaatctactcttccaatatgcggatttgctcatattgttttcttgcccaggcattgctgcagaagagtgaaatgaaaaacttattccttattttttaattctgaatttcagctatttctaaactgtatttttatatagactctaacctaattttaattttcttttttttaattccgaatttccattagttctaaattgtataccggcatggactctagtctattctttcaatattcctttttattaatttcgaatttcaggtatttctaaattgtatttctacgtggactctgtttttctttttctccgattaatatgagaatttctatgccgtgagagcgaacgtggaggctcatttttctattactttaaataagttggagtaatagatagattgggttattcaatgactggtcgcatttgtaagccttgctagctcatcaatcatactcctacctcattattaaatagcagcatcaagatatgattttggacccatgatcaacagattgtggggggctcaccattgaaccgtatgtctttaagtgcctttctgaagatgacaggagcgatgttggccaaacggaccgtctcgtttatgacctacataataggagcatgtgcgcgtatgattggtttagcaacgcacgttttgatacaaaacatgcatggggtgctataattggatccaatgcaatcagtagcataaactgttgcacagcaaattctgaaccctatctgatcgatatttatctagcagttttgtgcgagctagtactagtaactaacctgagatgtgaatgccatggatttgtactccttccatgtgattctatctagctcgctgcctgcctcacggtccttcagaatcgtttcatgctccacctgcgtacgtacatatccgtgtatgtcagtacatagtcataaacgtgtatgtcagtatatcacatcttgatttttgcgtatagtataggagcactcaccgtgagctcctccaggacgagagggtggtcggcgagcagcttgacggccagggtgagcgccagcgacgtcgtgtggaagctggcgaagaggagcacgaacatcaggtcgagcgccatcttctctgtcatgaccggcttttccttcgtgatctcctggatcacataatccaggaagtcgccgtgctgctgcgcttctcctcctcgctgcaatcctgtcgattgcttcctctcctccagaacttgctctagcaccaccatcgcgcgcctccgcccctgacaagagtctcaaaaccaagagaccatgtctgaaactttgcgaagaacgactaattagtgcaatatcgtgacgacataagttttacctgcatgcatgagtagtaagctgtccctggcagatacagcgggaaggagatgagccctcgaacgaagtcgaagaagctcttccgcaaaatctttgacctcgacggctccaggccgagcagcttgcttgcagcaagatcgaacaccatctgcgcaagtgcatgcactcgaacggaacatacatcacaatgagacagtacaagaaaccaacattctaaaatctgggtagaaaccgcgtacgtacagtggagacggcttctttgagctcgacggccggcaaggtggaccaggtgcagagggagctggagacggcgcgctcgacgtcgcggatgatgccttccttgaggctctcggggccgaagtacctgagcaccatgttcttgaggtacctgaacatggcgccctgctgctccccgacgttgtccttccccaggatctccacgaacgagtccgggtaccagctctggaacagctgcccctcctgctggaacaccatgtggttcagctcctcgtcggccgacaccaccaccgggtgccccaccaggctggtcttgaatatcggcccatatctgaacttgcagcccaaactagtaaaaaaacagcaaaagaaacccagcccgttctctggcccattaacaaaggcgtacctagccagcctgtgccggatgaagggagggatgtccaaggaggcgtcggaggagaagaactggaacgtctcgccaacgagcgggaggcccatggagcccggcgggagttggccgccgcagcgagggttcctccacctgcgcgcctggtgccgcagcagcagcagcagcacgagcgcagctgcgccgcccacgagccccacgtaggcgtacatctgcacgcgtgtaatatgcgctagtggcagtatctgcttctgttgatctacatgtgccgtcgtcgaaagcaaagcacatttggctgtaggacgatcggtatgtaaggagtagaggggggggggtcacggctttgaccgtggtttggtgaagccatcaacgtaaaggttgtgaaaaactagtggttgctcagcctgtcgttgttggtggatcgaatgttcgatggctgctgctactaggatgggccggcctgatccttcccgttagatcttaagattctggcccatctacagagatttcggcttcccaaaatccgcacaatgcccatcgtcacacggcctacgaaatcctttgctctctccgggtttccgtggcacaactgggaaggcaaacccggcgtctctccgccccccaatccgcatggacgagctgctgcttcgctcgtctgctgattgcggaggccggaaggatcacccgcgtagcgtggtcaggtactgttggcgaactcccgcaggtgttcgacgaaataccgatcaaaacagagcgagcgagaagatgatgtttgtgctgcgaaaaaacttgcagcgtttttagttgcattaggaaactttaaatagcaaattacatgtccacaactctctactggatcacgtcatcccacgaccgaagttgccgccatgcgttcctaccctcccgccacttcgccatgcctcccgagtagaccgcgccatcccacgatcggaaacacgcaaagcgcacgcactccctaagaaaacggaaagggctcccgcatgaacgcagcatgcgtcggagcgatacacacgccatgatccccagcaaaaccggaaccacgcgcttgactgataacttggagcagaaaacgggagatggcgccatggattatcacaacaggtacttcctcctcaggtcaaagcctcaaggccacatttggtttagggttgcaaattttggtacggggtagtcggtaggtccgagcattgaacggcagtgttctgaatgtatatatcgggtgaaagtaaatacggagaataggccaaggactcaccgacgagcgggcaccgaaaaaggggttgctcctcaatgctgcgggtggctttttccttgcttgtgctgggcaccaagccaccaaccgaagcagagagcagaggataatcccagctctcgtactgcaagcacgtggactccgccgtggctcatccaaatgtcaggtttctcggaacagatcagtgctcggattatcctgcctccaatcatgtggctaccctgcacgccttgcgtagggtcgttggggatagcactgagcagctgggatggatgtccccaacgcaaaactatccgcagtggagtactgaggttgttgcaaagctttcttttcggtccgcactgagatgaactttgtcaaatacctgaatccatttattacagtaaagaaacactacatggaaatgagctttcagctttgtcaaaaccaaaacaagtactacctgaattcatttcttcgtccgttaacagtaaaattgcctgataaagagccacggttttcattcaaaggtatatatacccacacacaggataatggaacccgacgtattgtctgacagaagatatcagcagcggaagtacttgctgcaccaatccccaaaggtatgggcttaatttttaggcagttataagagtacaagctaattaatcagtaccattaccagccatacttcttgttacagtatatcctgttcatacttcttgttggacatgaaaatttactgtattatttgctctggcctatggcattaccacaaactaaatgtcaattattttttctccgtgcatgtccttgacagaagattcttaaccactaccactagcatcctatatagactgattgccattgctagctcaacagctaacaagtaaccactgttgcgagctaaccagtaaccagtagccctcctattgtatacagagatgccactgttaagagctctgttattgcagcgttaggtgagattgacactttggttagctgtaaggtggtatgcatcactgttcttccggtggataatgggggatatctcagatgaatccttgtgacagggggacctcgtggtctgtcaagtgtcctcatcatttcaatacatgcaccgatcgcccaaaagtgaattgtttcttctgctcctcctgtcggggaccagtgcgttctgttgccgtcgcattgcatgcatgccaatggtgatgaactctttaattagccgttagtccattacttgcaagatctgaaactagacagctaacgttatcttctccataatacagggagaattttgcccttaaaa

SEQ ID NO: 79650 - DNA, 14604 bp, Oryza sativa
atttacttttaagggcaaaattcagagacattcacgatgttttttttaaaaaaaaatggtactcgttataagtaatacatgaaaattatggcatgacagtgacaaaatggtgtcaataattatgcaaatatattccagatgctgattgaagtggttaggacttaaaagtctttaggcccttttctcaacttggctgactctgtgtcagatttttggatgttttgcgtggcttgtcttccactaccacttccaattccagcaccgacgctgacgtcggcacaaaacaacgaaggcgtgtagacgcggaatataccagtacaaccgttttgtctcattttaaggcattgcagtcggtgctagcgtgcctaatgttcagctacactgtaactaattttgtaattttgacattattcacctggagttagtgtagacgaatgcatatggtacgctcagtgtgggccaccaaattttcagctgaatccagagtcaaacctcacaggcatagtagttgagttcagcactccagtagcatgtgcgagcaaacgtaaaggcagttcagacaatttgcgtctagccatgtaaacattccacggtagttctactgttctagggagagtaggcgtactatggtggtacactggtactccgtactaaaatgcctgatgacagcgcatgaagaatgctactgaccgtagaaaccagacctacgagtaatgtaagaattatatcagaatggtaatctactagtaaaaagtaatggcaaacaccgtgcattggaacaaaaaggattgacaccataattgtagcttctatttacccacctggaatactttggttgtcctttaatgtaaaaaactttgcagggtttccttctcagcacctcttttacacctaaacatcgagggctgaactccatatgtgaactattccacccaaagaatgaaatggaaaaagaaacttcaaatccacaaggcaaatggtaagccgattacgatatttgcccaatatgtcaattttttctaacactttatttcacgttattgctattccttttcttccccgagtgtccagtatgtctttacaacaaggaggagcttctcccggacgagcgggccatcttcgtgatcaacgatttggctgttccatctcataccgtcggtaatgctctttattttcaccaacatatcaacatcatctcttataatcactgtaccctcaggcctcagtattctgtccatttccagcagaatgttgtccatctggcatctgcaagagacgaaaactgcgtcagtccagtaccagggtaaacagtctccaagagtgactgttaacgatacctattagatttctcaaatacaggcataaagaataatgtgcagttactactgcataggagtacagatttatactccacggacaagaacagaagtcactgttgctgtgatggactgaattttactgcagcttatgattacctgtccttgtatagcgtgaacactgaatcggcatgaatgaggtcgtaggtccgagggtacgtggacatgccctcacacctgcagtaagcacggatagaagtcacacaccaacaaaaacatgagcacacacaccaacaaaacatgaccgtcatcatattcagtctcaaagagaggggcagtgcttgcagagttgcggtacaagaactcaccagtcttggtagcttccgatgagcccacgctcgtatataaccccaagagttgttgaattgccaacagttgggaccatattcatgacccacacagggtcatccaccaatgccgcagcgaagccgccaaagcgcgcattcatatcaagcaagttgcggtaccgtcctttctgtccaaattgacttatcacggacttgtagtgcccgaccctcttctgccatagtttggtgtcttccacgaacatttcatcagtgacaccctcaatgctaccactggcaattctgggtggcactgcagtgagcctctctggccatttcttcaactggccacccgcaatctcttttatgtcactaacctctgggagaggagttatgcaagcctccatcttatcgtacctataatcgatcacatgaatatgatttatcctgaactgtgaacgtgagttaacttcaagatggacaataaagatataattagtgttgtaattaccatgcagcatctggatttttatttgagcagaagggtggggacttgacgactttgcgggaggccttgcagtgaatgtggttagtaggtttctgccagatggcaatgtcaccaacctccttgagcgtgatcttcttccagcaaagactcttggccactgcctcaatcgcttgctgctctgcattcaggtcctccttggttctctgccaccccttccagtgcttcttccagttgattggaggtccagacaaaatccaataccctcctggccgcagaatgcgatccacctcagccaagtacagcccatctgcatttcaaattgcacctgagttatcaaaggattaacagagcattgccaacacatttaattttggacaaaatgttgccataccgtagagctgccagggaatgaggcagcgggagcaatgtgccatgtcaaaggcacgagctggataggtgagccggttggatgaaagaacaccgatcatcgccggcacaccacgttccagtgcaaattgaacctgtgcctcgtgagagtcacgtggcgcgaaggacatggccaggatgttgcgtgacagcaagtatgcgccccagctcgctacctgcaacaagcggcagagtgcaacacattaggaatccataactctaggcgtctggttataatatacaaagggtaacttgcccctctacacatgagaaaaactcagtttccacatatctagcaatacaaatagatcaaaatgacaactattggcacagcttgctgtagacgtgaaaattccattatgtgtgacattgtcactgtgtaaaaaggcactacatatcttccaagttttcaacgatattagtgcacagtgcacacaacagaacctctcctatccgcagccgacatggagaatttgatcaaagaatgcactatgcgcacggaatgctacaagcagtcaagtactagtaacttcagttcagtgcttcagttcagcctctaaacgaaacggtatgtcggattggtcacgttactctacagtctgacctgcctaatcacagaatgaaacgaacaaatgctcctctgatccgggtcggagcagaagctcgtttagggtcagacccgtttgcccgggcagaagggcccagaggagcagtgtgggactggaaacttccgacacgcgcaaagcaaaatcccattccggcgttgccgagatttccgcctcatgttctagtgcatcaacaaactggagtataactaaacccccaaattttgctacgaatgtacgaaacactacttaaaatcgagctaattatgcgcgaatgtcatctatcttaagcaaatagggtgtgcttatgtatgaagtggcctaccccacaaccggtgtcgagggcggtgcggatggatccatcgtggagggggatgatcttgccgatgtcgtcgatgtacgcgccggcgccgtgggggaacatggtgccgccgccggggaaccggaacttttcgccttcgacgcggatccagttctgcaccgccttctcgacggtgagctccttgtgcggcacgttggcgaaccacgcgacgtcgcggctggtcggccacgggaacgggttgcggtacccctggggcgccggcacgaggcaccggagccgctcgccctccgacgggcagtgccgctcccggtacacgagccggtcccgcgggaaccgcagcgagcgctcgacgtcctcgcacggcgtgtactcggagtacttggccgggcacgcctcgtacgtgcggtgcacctggcccgacgccacctccatcccctccgcggtatggtgcgccgcgaagtcgagcggcgcggacgacgaggagtcgccgccgccgccgccgccgccaaggagcgtcggggtgggggagacgcaggagacggaggcggtggtggcgatggagacggaggaggcgacgccgccggccggggaggcggagaagccgccgtggtgccagatgccgatgaggtaggacaccgtgcagagcaccgcgacggccgcgaggtggaacagggacgggcggcggccgcccgcggacggcatgtgcagcttcgtggcggtcgcgcccaccgccatggctggctggcggcttctgctgctcccgctgcgcgctctcctctctcccctcgcctcttgtgggattggggcgattcgcctttctgcaccactgccccccttgctggctgcttaaagcgcttgccgcctaggaaggattaggggcgtggggatcgattgattaggtggaggtgaagacggggggaggccgtgaaagggagccgcacatgcatccggttttggtttaatcgtgaagagagagcgtttattactccggagcggctggtttattactcttgggaggatgcaaatggttgcgctttgggaacacgacactacgccaccctacgctgctatcgctggcggcgcgtgtgctgcgtgtgcatatcgcggcgtggcagcagtttcagcaagcattaactcggtggtgttactgtatattttctgttgatacgatcctggttggcgctattaaaagtgtaaatgctgagtgcacgagcccactctgtaaggttccctctgaattgtagaagtgaaaaaaaagggaggaacaagaaaagtacagggattatgatagaaattcaacagcaagatgtatgaaaaatacataaataatcgtttgattatttataggaaaaatataaaaatcggatgaaagagatagattcaaagaaaattttccatgaggttgaagctattgctaagttttcttcaaaattttgataggattgtatattctatagaaatttcaaaggatacgataggattcactccattgtttcaaatgttttcatagaaaatattttctatagaattgaaatcctctaaaatttatatattctttctacaaatcaaatggccccttattcgacatttgctcgaaaaaaaagacaaaatatgtttatgacgatatattttcatccataaacaaccatcgtaagtgaaaagggaagaagttaacaaaactataatcgtacagttaatcactcaactgtaggtccatacatagtggtttaatagtttgctatcatgttcaagatttatgttatatctgcgaaaaaaccgtgaaaaacaaactaatcgatcaaaaataatctgtatgtcggtctcgtgtgtatggatcgttgttgacatgcagattattgatgctcttaccttgttttccatatccaagtttaaaaatgaagttattttgaacggagataagtagtataatgacatggcagtactagagcaagagtttgagcacaatttattccttttctttctagagacacatccaattatatactcctactacaagtaacgcaatgacactgaatttcttctataataatatgtataaataatggtttagatatttattgtctacccccgtcctataatatagcaacctaggactggataggatattttatagtacaacgaatctgaacacactcatgttcaggttgctgtattatgggacggagtgagtatagagaatatagagttttttttttcacatcatgtctaacagaatatagagaacccacattaaccatccgtttagctgtttcaaatagatttatataattactttttattctataaacaacacatacaaatagtgaagtagatggttattttaacttgtctattagactacatgttaattaacatacaacaatcttttctgtgttctctcttttctgtacaacatcgcaccattattcatgtcgtaagattgttttcatcaatcaattaatttgcccttgctcgtattattttttaaaaaaaaaaacgaaccgcacaagacagtgcgcgtttcatgtattgataaagcaggagaaaaatacaatctatagtcctggaagaccacagaccagaaaaaagaaaatacaaccacaccgtgcgtctacaacaagacccactgcaagagcgaaacagaaggtcttcgagacgacacctccaagaaggaaacgacaccaaaggtgccactgtcgtctgtcccgggaggccaggacaaggttttcacctgaagaaagtaattaggagagataagaaatacaaaaacaccccaagaggaaaacggcacccacaggcgttgttgttgccggcccggaggcagagctttcgcccaaaatttcgtccctcccaagaactaaactcctgcacgctctgtagccaccaccaacgaaaaccttcgacgcacggccaccgcaccggcgccacgccgccagtcgatcatcatggggaagctcgaacctcgacacacaccggctccatccacgcagatgggttggatggggagagggtgagagagaagaatggatgccctctccccccccactagcccgctcgacatggacaacttttgtcgacaaaggcgtcgtcacaagaggacataagtctggaaatgtgcccgtcgaaggatcgtggctcctccctgacagagaaaccgccaactcagccacgaatctgttgcccatgtcacctcgggccgccggaccgtttcgccggcgccttgccaccctccacaccgtgctgatgaccccctccgccacagtgcacccgccgtccaatggcgcggcactaggacgtccaacgaagcacgatgctcacgccccaaaaccggtggaggggaccggttcttgccggagggaagccagacgcccagcactcgccaaagttgccagcataggaaggttcgcgccgcacggagaccataaggtcaccatcgtcgccacatctccaccgtccaccgtggcctggcaagcgtgccgctcgtcgatggctgcccaccacagcttgggctccgccaacaccaccactcagtattgactttaaggaacctacagtagcttgtcatgcaatgatttataatatttgtcatcctattctaccacaatttggtagagtgatttttcataggtaaagaattaaaccaaccctgtaattcttttgtcgtggaggtttggattgcgtggaacatgggctagagcctaagcctttcgataaagtattatcctcctacccaaaccttgtttcttctaggtctagtagtaacctgtagtactaacaacgaagtattattttagaaggacattcatcccaaacacgtttagaggtgcagtaatttcgagcaggcggaatgttggtctctcagtcaattagggaaaatgcgcagaatcataatccactgctctgtgagcactctactcttcctcacaagaacaaacaagatcacaagtttcatcgatggatcaacaagatcgcatcgcctccgccgccttaaccgctgatatattgatctttctcagatgagtttcatcatacagaggagtttgtttatatatctctctctctcgttcggcaacaacgccagctcacaactgccagctatgcattagctattacatggcccaatccggcccaacgaatctagtatttgggatacggagtcttgcagcccgtttgcgcggcccaccatcttgcggttgctgttgctcgtccgaaacgtcagtagctgggctgctgacaagcccctccccttggaaactgacttgaccccaagtcagggcagctgggaacctttgcctgagattagcttcatcttcccaggtcgcttcatctgcagcagaatcagaccaacgaaccagcaactgaggaataatacggttacctttcttatggagcctagtatccagaacttggactggaaactgaatactggaagttggaccaggtagctgactctgaacaggatgcttgaacccacaagagcctttcaattgagagacatgaaagacaggatgaacagcacagtccaatggcaactgtaacttgtatgccacttgaccaaccttggcaatgatttggtatggcccataatacttaaaagatagtttgtgattagctctcttggcaactgaagattgcacataaggctgcaacttaaggaaaacccaatcacctacctaaaactcctgaaaactcctttttttatcagcttgatatttcataacctgtcgggctctattcagatgttgcttaagcagttgagccatcaacttcctttcagataaccattgagctaaatcaggtatactgcaagcatcttctctgatgccgaaatgagtaggaggatagccatacaaaacctcaaaaaggtgacttatacagtgaagaatgataagagcagttataccaaaactcagcaagatgtagccattcagaccatttagagggagtagcatggacaaaacagcgaaggaagatttccagacactagttaaccctctcggtctgtccatctgtttgaggatggtaggctgaactgagatgtaacttagtgcatgtcggagaatgaactcctccacaagggaaccgtgaggcccccctttgtgagttcggccgggggcagcggatgagattcgagggcttggtgagcggagctgtgtgatcttgagggggttagcccccccccccaagacgatgagacaaaagagatttatacaggttcgggccgctaagaagcgtaataccctactcctgtgcatgattgattgaatgtagaacacaagtgcttggggttgcgagacccaagcgccagttcgcccccctccctccccccctcccccctccaccactaggcctggacctccttttatacctcaagtggttaccacatggacccaacaacctaacctagctccggtggagaagtattataatctttgcattaaatgcatgtcttgtctctgtggttgggaagccaagcacacgtcgtcttgatgatggggcctatcaaatcttgccgcctgacacgaggggtacccctgtcagtcaccatttaatgggtgaagacttctgggctcctattacaccgggaaacaggagccttgttttgaccagagcgggaggaccgacttcggcttggataagaggataagaacctctcaccatcactatttgatgggacatgtcaggctgcacgccgcctgacacacgagcagcgcacaggcgcactagccagtctcatcggtcattcgaccggtcacagaccggttgagtgcactgcacgccgcattaaatgcggcatggcgcgaccgctcgggacgccataaatgcgggtaggtgggcacctggaggcggacacctaacccaccgtacgtggtgacctagagagggggtcgggggagcccgacccctagtcacgggagggggcggcccccgcccaacctcgggcccgatcccccctcgggggggagccacatggcgcctggggcggccttctccctctagtctcggccagggagtggccgccgccctacctcaggcctgaccctcctctggggagggccacgtggcattggagggcagcctcctccatccagtctctgggaaggagtggccgccgtcctacctcgggcctgactcccctcgggggagggccacgtggcatcggggggcagcctgctccgactagtctttggggaaggagtggccgccaccccacctcaggcctgactcccctcgggggagggccacgtggcatcggggggcagcctcctccctctaaacctgatacccccgggcccatatcaccgacagtgcctgacctgatgaacaattgctcccacaatgtactggtaaaaattttatctctgtctgaaattatagcttgtggcaacccatgcagcttataaacattaagcatgaagactttggcaacatccatggcagaaaaaggatgagatagggtcataaagtgggcatacttagagaacttgtcaaccactaccaaaatacagtcctgcttgttagaacgaggcaaaccttcaataaaatccatggatataatctgccaagctccatcaggaacgggtaaaggttgcagcagtcctggatatttagctctgtctggcttggattgcaaacagattgaacaagcattcaactgttgttggatggtatccttcatatgaggccaagagaaaagagatttgattctgtggtaggtaacaggaaatcctaagtgtccccccatgggactgtcatgcaaggcagagatgatttgctgttgcattgaagaattattgccaacccacactcttcccttgtgtttcaagagccccttgtgcagcttatactgagggtgagaagcaggattaacggccaattctgtcagaagcttaactgaaacaggatcttggtcatatccctagattatgtcttgcaaccacacaggagaacattcagatagagccaagaattctgacacttcggcaggaacattccttgaaagggcatcagcagctacattgtgcttgccctttctatagacaattttatattgcaacccaagcaatttagtgaaagccttatgttgccagggagtgttaagcctttgttcagcaaggtgcatgagactatggtggtctgtcaagatcaggaactcttggaattgtaagtaagggcgccaatgatcaactaccatcataatagccaaacattctttttcataggtggaaaggccttgtgttcttggtcctagaggcttgctcacataagctattgggtgctgattttgggaaaggactgctccaatgcctaggtcactggcatcggtttccaaagtgaaaggttgctggaaatcagggagagctaacacaggagcagaaaccaaagattgtttgagcaattggaatgcttgttctacttctgcagtccaattgaaaggagcatccttctttagcaattgtgtaagaggtttgctaatagcaccaaaattcttaataaatttcctataatagcctgccaatcccaggaatcctctcagctttttaatagtagtaggtctgacccaatcgacaatactctggattttagaaggatcttttgcaactccagccccactgataatatggcccaaataggatatatgttcctgggcaaatgcacatttactgagtttaaccttccactgatgattagataacagctgcaggacttgtctcaaatgagtaagatgagtaggcagatcaggactgtatatgaggatgtcatcaaaaaacactagggcacatttcctcaacactggactcaaggtgtcattcatagcaccttggaaagtgccaggggctcctgtaaggccaaaagacatcaccttatattcatagtgtccactgtgggtttgaaaagctgttttgtgctcctccccttcagccattctgatttgatgataaccagctcgaagatctaacttggaaaaatatctagcaccagccaactcatctaagagctcatcaataactggcatggggtaagttcctttctgagtgatattgttaagctgtctgtaatcaatacagactctccaagaaccaaccttctttttaaccaagagtgcaggtgaagaaaatgcactgctgctgtgctgaatgactccattttggagcatttcttgaacctgtctctctatttcatccttatgtccaggtgtatgcctataaggtctgataaacactggtttggagtttgggaataagggtatcctgtgatcacaataccgtttaggaggtagcccttttggttcttgaaaaacttcttggaactcagtcagtaagggctgcacaatctcaggaatagagggagatagctgattagtagatttatccaattgaacaaggtacatgattccaccagacttagccaatccatgtaactggcccggagttatagggagacagctgagagtactagacagtgttccctacaacctgaccattgagtcattcaactgaaattctagccacttgtgtacccaatccaccctcattgggctaaaccgttcaagccaatccatttcaagtatcacatcgtaggcacccaatgctaaaagtctaaagttgctcttgaaatgtattccttgagttaaccaatcacagtcaattatgtgcagtgagcaagtgaggaacccaccatcagcaaccttaactctagctagtactggcatagccttaacccctgataatttgagaccaatctgttgatacacaaacgagtgagtactgccagaatctatcagcataagaacttcaatgccctgaacccatcctcttaacctgattgagtgattggagtcagtaccattaatagcttgctatgatatagccattaaggtgtcagattcaggtggttctgaaacagcctgctcagactgagatgaaccttgtaagacgtccagcaactcttggaccacatgtaactgaatggaggaagcacatttgtgatctctgccccacttctccccatagacaaaacaaagtcccttggatctcctataagacttgagagctgacaatctatcatattcccttgaatgattgcttaattcagttcctctcctatcatttgaaatgattggaggccctcctttagtggttggtggcagaggcaatggcatagcacctttgactgactgtttctggtatccatcagattttttagattcttttggcttatcaccctccaatgcttcttcctgtaaaagagcaagagtacaagcaacattcaaatctccaagtctttgaagcagaatagcagacctaatcgcatgccttagcccctcaacaaatttagtgacaaagtagactggtttcaaagatgggtcataagccatcatttgatgcatgatgcaatcaaactgctctacataatcagctactgatcctgtttgacaaattttaatccattgtctaataagggcttgctgcctatctttgttaaacctagtacaaattttttcacatagttcagaccaagtaaccccttctagttgagacctaactgcttgcagccaaaaggcagcattaccagtgaaattgagtgttgctaccttaacccaattacccggatgtatgccatagacatcaaaataagcctcacaattagacttccacatgattgggttatctccatcaaattttgggcaagtcatgggggctaccccaccagtcataccaactgacaaagcagactgaaacgaattcatggcagaagcatccaaatggaaaggaattggagagacattgtgagacgcatacgtaccattggccgggattggctttggggtaaaaccctcagcctcctcacgattcaaaatttgaacgcggtggccatctagaccggttgagccatttggtcgaacacctggtgagtccagggttcccgctggagttgtttgctctgttttgttggctgaagagctctccagttgatttacttgcatttgcagcagatccacggtggattggagtacatccaccttcttctccacagctgggatccaagattccaccgcctccttgaacaaccgcatctcctacgcctgcctcttctccccttcctccctcttgcgctcagttttctccatcttctttagaaggagatcaagttttgcttcgttctccatgattttagcggtctacttcgtcacaaaacgtggtttctccagggcttcagatcttgtctcacctcaccccgaattcggccaactcgagcaaggcaagttaccttttcacggatctacccgagggtaatccaatccttgcccaagaatttcacggccaaatcaagggaaaaagaggattgacgaagctctgataccaagttgtgagcactctactcttcctcacaagaacgaacaagatcacaagtttcatcgatggatcaacaagatcgcatcacctccgccgccttcgccgccgatatattgatctttctcatatgagtttcatcatacagaggagtttgtttatatatctctctcgttcggcaacaacgccagctcacaactgccagctatgcattagctattacatggcccaatccggcccaatgaatctagtatttgggatacggagtcttgcaacccgtttgcgcggcccaccatcttgcggttgctgttgctcgtccgaaacgtcagtagctgggctgctgacatgctcacgtgtaaataccaataatgcaaactcctatcaaatcatggttaattcgcaaaattttatttttactatacctcactctcagaaatcaaatgacacttgtaaaaattaaaccttcggaattcaaatcattaatttttctttcaaaccgaataaaccctaaatttaccgggggaaaataagcccgggcccacgccagccgccacccatacggtgcacgggcagacaacctgcaaccgaccaaccggactcgcacggccgatagatcaacctcgaaccagaccgcgcgcggcaggtctctcgctggcacgtgggccagggaagaggtggaggagccgaggaagagcctgcacgacagcacgagtaaagtacagcgcaac

SEQ ID NO: 79651 - DNA, 19995 bp, Oryza sativa
cccccccccccccccccccctcccgcggcgcgcgcgggtgttgtcgtgaccacccccacggtggtcgacggtgaatggacggtcctgccgcctggatgatgcctcgcgcctggccgcccgcagtaaacgccacacatgctgcgcggtgcctactcccctcccgtaccccgtactcctgatgccaactatgcaccgtcttttgactcggacataacgcatatagtatgttactgtactactgctgctgctgtctcgtggtacaccggtgcgaccgcctccatcctgtagcactagcacaaagagcagtggctacccagggcaacagggtactggactagtggaggagtggggttaatacagtcagcaaaggctgtattaggcccttcttgaccgctcgatgagttgaaaaccgggcacgtaacctgttcacaactgtccatcaggaggcgtgcctgtccctcactagaatcattgttgtagcatgggaagcggtaggatcttatcctcgagaccttgacggcgtgacgaatgcctaatctgatccgactgaagtctggatattcaaatcttgtgagcttcttattgtaacaataggataaacggccaagttgcggtgtggtatagagtacggcatcttaacaaatgctagtcggcgagatcaatgtcagcatgctccaatcaattggcggagatttttgtgggccgtacctttgtgtgagactgaagcaaccaacagaatggactactctgtgttcggataccccttttcccaaccatttttcatcgttttttcacgcgcacgttttttaaacagttaaacggtgtattttttgcaaaaaaattttatacgaaagttgcttaaaaaaattaatctatttttttaaaaaaatagcaaatacttaattaatcacgtgctaatggaccactccgttttccgtgatcactgttcttggtgggaacttgtcctagcgaatacttagggcttgtttagttcccaaacaaaacttttcacactgtcatatcgaatgttaggacacgtgcatagagtattaaatgtagataaaaaacaattgcacagctcgttgggaaattgcgagacgaatcttttaagcctaattgcgtcatggtttgacaatatggtgctacagtaaacatttgctaataacgtattaattaggtttaataaattcgtctcacagtttactgatgaaatttgtaatttattttgttattatactacgcttaatattttaaatatatatcagtaaatctgatgtaacatgcagtggtaaaattttttaccaaataaccaggcccttactaaaactatcaaaggcaaagcaacgacaaaagcaatactaattaggaggtgacacgccaacatctcgtcaaagaaccgagctgtatcaatttttcgcgccatcaacattatggttttcctctgtttatttataagctagcattggcacttttcaagtgctactatactgctatacatggttggataagtatagtacaactagtatatacttttataaataaaagaggaaacatatattcggtcattcgggtgccattgttcttttcaggatatataccatcctagggcaaggccaatgtatgatgtatatacacatattaaggtgggacccatgaatagttagcatttcttatggtatgatgcacaatgtatatggtctttaacatgggtctcactataaaataaaaaaattaagatggctgccaacttctttgagatagtagtagggagagagaggatgtgtaggagaaaaaaatacttgtttattcactatggctagttgtaagcttgagttgcatcataagaatttttttcctattgctaacttacacaatacacaatgtataaggtgtgtctcgagaatatatttattccttaaggttaactttttagcacattttggttgcccttaacacatactccacataagggggacgtaattggcaatatgtacatatggagtgtgggaatcggctgttttgacttgttagctagccgtattaagagtacttaatagcagttggtccatcgcccaagctgatccagttaatcgctaatctctatgctcccctctgataaggatgccatatgtctgacactcgttttctagtacggggtaccaggaaaactctgttcagagtatggtttggaggcacatgggttggccaggttggtctgcggcacccaccagccaaaatcagtagtaccactactcagttcttggatctggagaattttctttactggaagatggtgtgcactgtaacttcagaactccggcatccagcggttacaagtgtaccactgtagtactgtagtgctagtagttctagcgctgctagcatgggggcaactcagccaactgccatgacaactttccactcgaaaagacgaggaaactaacccacatgccaaagcatgcacgtggttcatagagccctaaaacagagtaatcctggtttattttagtggcccctttttgcagcaaaccgacggcctccctcatgcttcttctctatagcttgggcaaagtgtagttaccagtagtagaagtcctctctgtcccgctctctctgtttctgtaacgataatactataaaatggcaggagtcatccgtgatcgatgccacgacttggtttagtccgagccacatgccaaatacaacggtctaatctaggagtagtagtacttagcatcatcagctggaggaatggaaaaattggaccaagacatagtgggtcgggctgcttcaaagtatgcaaccaatcaccaaagtatggcgatcgatatgtatcattatctacacgaaggtcaaaccgttgcacagctcgcgaagttcagaagacatcaagacaacttgcgatcgatatatgtatcggcggcttcgagacgagccgtgcgtgtgtagcgtgcatggacgccgtctgttccaggcagcagctagctagcggatgaggcatggctcccgcgagacggcgagaagacgatctgaccggtggtcgctgtgccaaccacagcgaggctgcggcgcattgccatgccgccatcgtcagaactcagaagttcccttttctaccgtgctatgggatcgagtacccaccagtctgctacacgacatgcgtgtggagccgtggtgtatggagtaggcgctagcatagcaggagcagcatcaggccgggggagacggagacaaacaaatgcttccccacgcaggacggaacgaagcctgtgcgtaccttcattgcccggcaaagaacagaacatccgaagttctcaacatgggatatattgctatcttgcttggtcttcggtggattcgtatcatcgtatgcgctgcaacggcagatcaacaatccatctacacaccgtccaccattgcggtggagatataaacacactgtagaacatttcgggtgaagaaggccaaaagtggtgctaaagctacaataaaattcagtgtgaaatctgaagccatgggaggcccaaaaccccctgtctcagccaatatcgtgcagtccgtttgttcagtttggtgcctgggaagtgggaacagagggaagcagagagtgtgaacgtgaaattcagaatcgggtgaagctgcattctacaatgggcctttaaatttaactggaccaaaggcctcgtgggctttaaattcaaaaggaggcttaagctcggggttaagggcctttaaatttaactggaccaaaggtcgctgttataagctggccttcaaaaggcccactaatcattagttgttgggggaaaaagtgcaccgaaggtccctcaacttgtcatcgaattacaaaatcgtcctccaaccacaaaaccggatacaacgcatcctccaacttacaaaaccagtacaaattaggtccctcggcgggtttgactcctgttttgtcggacgtggcagctgactcggcgtggggtctacgcgggtcccacatgttagcctcttcttcccctcccctctttttcttttttctctcctcttcttttctctcatcgggcaaggcaaccatcggatgaagaggaggccagtgggggaggcgggaggtgggactccggcggccagcgacgggcgacgagatggcggcggcaacgatatgggagcaggagggcctccccccacgccgccaccaccgttgccgacggaggaacacggtgagctgcctccggtgggctcgccggaggaagtcagtggcggtgtgacggcgcaggcggtgaagatctcctgacgagggacagcagcaggttgttcgtctccaacatcatggccgcgccccctacgtgctccgatctctcgccggctggaagaggagctcgcgagcggaggagacgacgtgcggctgcggcgacggcggctcgggttaggagagggttatgagagggcgagagatagtgggggtgggagatgcatggatggacgacggcgacgacacgagagaagggaggtggcggcggctgcaacgcttgagaagggaggcccgggctccgacgccgaataccacctccttcgccgcatacccccgcgcccacagccgctgggagccactgccatagacgactctgcgccgctcggcctcggcggcggcggcggctccgggcagggatagggccgccgccgttgcccagctcctccccggcggcgagggagggcgggcgcgggaggccgtgctgcgccgccgccgcctcatcacctgtcgccggccgccggattcccgcctgccccaccggccggttgccctggcgactattgaagtgcggagcaaatggagagaaaagaagaggagagaggaagagtggggaggggaagaaggggctgacatgtgggtcccacgttgagtcagctgccacgtcggacaaaaccggagtcaaaaccgccgagggacttagtttgcactggttttgtaggttaggggacgcgttgtatccggttttatggtttaaggacgattttgtaattcgatgacaagttgagggaccttcggtgtactttttccttgttggggagagatgtgtctaagacgggaggaagaaatctactggaccgggccaaattgacagatactcaatggaatattggttgtctgtatacattcgaaaaacttacctccctcgacaatggaccgaatctaattctactgtaaaaacaggtatatattgtctccttcaactatcaaaatcagctcactttatctttacgagtggtttttatttgacgtagcacttgacttggtcttctaacatggtgctctaacatggtgcttaattagcaattcaaccggaaaaaacccatagggtccagtggtccacatatcgataatattgttgccatctcacacctctatttgctctcttccctctcaatagtggagggatctacagtggtaggcctccttggatcgtgatagtagcaacactagcatgaactcgaggaagagtagggggttatttgtggagtgcagagcaggccacacttcgtcgggtggagcaagcagcaagcgacgagcgatgagacggcgtggaggttggcccctatctcggcttccttctcaactccaaccattagaccctaccaccaagatagccttcatagctccatagatggagggtattcgagaacaatgaaggagaagacgttagcgatggtttcgggcttgcctagcgcgaggatgatgcggcaaagtagggcttcgtgggtttaccagctgtcaccaatgacttgtgctgttgccggcactagcacgttggtgagaaaaacagactcccgtcgaggtggtcgagcctgagctccaacacatccccaagccttgttgtctgcatggagccatcacaatcaccgtctcctacgacctcgggtcttttaaggagaaagggataagatggcaataatgtttttttttactgatatacgagtctcttttaattttgtcatggctaaattacttggcagatgaatcgaatcaatgtggcacgtcaaacaaaactatggactatgatttgacgtaagcatcatgtagcacataacatcttcaaaatcacttgtggtaaaatgagatgattttggtagctgaaaggctatatacatagttttgtcagcccatagttaagggaggtaaaatggacttttcttcatatccgttttattgctgcggcagtgcgggattacggaatggggtttgatgggagttgcgtcataatcatgaacttatcaatggcttaaaccgatttaaaattgtcgtaaaacatgggagcaccgagcacatccttctctcctgctttccatgatatttgaccgccacaaacaaattacaggcgatctaaaccgtccgttcaacctccaatacggatggcccgacgcgaccgacgccccacggcccacggcaccttctcgaccctgacgcgtggaccctctaggctactactactcatcaccgcgggccccgcgaaccagccccacacgacggacgccaccacgctcgcggtggactcggtccaccaagaccgcaggcacaggcgccggcggcgcacacaacaccggaccggagcaccggaggcgggatcaaggtgaaaggccacttgtttgtgtggactgtggactgtggtctgtacctccacggctccacctcactcgtcgcagctcgagagttcgcccaagtctccccccgatccgtgcagagatcctcgtgcgtccgaggtaagcacacccccccccacccccaactcccagttcctaagccctcgtagattcgccattccaactcagttttcgcgcacgaaatgttcgtcttctttcttcgtcctaggtgagctttattgcagattcgccggttcagtttcgtttgcggctagaaatgttcgtgttctggggcagtaggatgggtgtcgggtgcttgatccgtggttcatgaggagggttttggagtgtgagaagatccgagacaccgcactgaattactgatcccattctgtgcgtgtgagcgagggagagggagggagggagactgggagaggaggggttagttttaatgtagccgttgaatgattgtgcctgatttgttaggtgagcatggaggtgatgcatgataccactgggaagaaggaagtggttgtctgttatatgaacgcccctctaccgtacatgattgaagagaattacgggggatgcttctttgaagacgacgttgatcttgcacaggttctccaggaccaggttgggtgcgaccgcctgctaccttcttgtttgattgttcctatgctactgatttgtttcttgttttgttcctgttctccttgttgcatagaaatcttaacatcatgtgttccaccccatggaaaattgtgtgtttggacaacacaatgtacaatgttatggaaatgcagccaaacacttcatggattaggttgttaatttgtcttttgttttgttgtagtattattgaaagtagacctgaaaggtgaaacatctttggctctcgtggtgccataataatgtgtaaagaatagcctcttgatgacatttacattgtaaaacttctagctcatccctcattgttacatggtgctaattaccattatcacaaaatattttgtacagtactagttatttgtcgaaggtttttcagtaggattgtgatgtttctcttttatagtacaactgcacaagtcaacagtgcatgatacatatgaaaaatatgatcctcatttgcttgatatgcttgcaccttgttcaggaaatagtctatcaattaatacaaggaaattatggtactggttcatccaaaactcattcaaatcctagttctagttatagccatggatgtgaattgggtgaacggaaaccatcaggagttgcaagttatgaagcgcaactagttgttgatgaagctttagctcgagagctgcaacagatggaggaccaactagcaagtgcatcaattgatgaccataacataatagaacatggttagttgtttactggtactcttctatatagtacaggacaactggtgagtgtctttcctctcgtaaatgctaatacgtggttcaaaaatatctgttcaggaagaaagccaatagcttcttcaacatctagcggtggtaatgcttctgcaagcagacctcctcaggtagtgatggaggatggcattgatccagataacatgacttacgaggtgaattccttcaaaccattgttttgccagtattttctctactgtttcgtaaggggacgtgccattgtcaactggtcttctactccatgaactttcatttcaaagtacctgtatagtctatggtaactactgttgtgtcatagaaaattcaagtatacaaaaattggacgtctccattttacacacattgctctaaccatgtttactatataaaaattgtaaagttgttctttaacagcttattgcttttaacaaatgcaaataaatgggataattgaagctattttcttttattttgttgaattttgtttgtatttcaggaactgcaacaattaggggaagctataggtactgaaagcaaagggttgccggaagatgtgatagcgctcttgcctacttcaacatacaaaattaggatattctcaagaaaggaaaagcatgacgagtatgtccctgtcctgattagatatttcagtgaaaatgtgatgtgcagttatcaacaggttattaataaacattttctatgcaacactctcatttacttattattattgtagaaggatatttggttagtacttttctgatcttaagttgcatccttcatcattgtgctagcaaaggaagctcctagagtactcgttatctatggctgcatgttcatgttgagttatattgcttgagtatgaaagtatttttaatacccacttctttgaatgtttacaaaaacagatgtgtgatatgctgtatgacttacaagaaccgagataggctgactaaattgccctgtgagcatcagtaccatcaaacttgtgtcaccaaatggttgaagatcaacaaggtaggccaaccatgcttttcaatctttccaatgtttagtagtgataagtgtatatgtgtatttattgtagttaccgtgaatatgaccttgattactttgctcaccgtaaaattgttctgcttttcgaaattccatcttattacctggtcaggctagatttaggctgagttcaaatctacgggtttgtcacccgtcctccctagcatgcaaaatggagcggcggattagtgcatgatcaattaagtattagccaaaaaaacttgaaaaatggattatgaattttaagcaactttcctatagttcttttttttttgcaaagaacacactgttaagtagttcgggaagcatgcgcgtggaaaatgagggagtatagaagttgcaagaagggagtatagaacacacccttagatagaatgacaatagtaatgtactgacaagaagacttaaataggtaatgagatgggtaagttatgaggaaagctacccaagaaaagagcttgtaatctcgtgtgttcatagatttacaaaatttttgagaccatgtttgcatccagaatgtattgatactgatcagccttgtgacacatttgtcaggtatgccctgtttgcaacaaggaggtttatgggtcgggcaagtgaaacattacggattcatctttcatgaaaaaggaggcaaacatgacggattcatctcacgccagttcaacaggcttaagaagtatcattgttcactggctgtgcactcattagcatgcatcatggtggcaggaaaggcaatgcattgtattgctaatgatcggaagattgtcagcgagttaccgaggaatgtctcagcaagataaataagatagatgcttctgttctgtttttaagctttatggagtcttcgagtaactgagactcttatttcagctttcaggcctggtgctttacacacactgtattgtaacatatcataggatgtatatcagtatgtgtatactgaagattagttgcatgctagcatctctgtattgcttgtactcttatcttttatggtatcaaatttggctgctggagtcagacttgtatggtcttcttgatgaatggtcattggtcaattccctgacttctgagccaaccagctggaactatggactgctatcgtctagccagagagtgtttggtcttgtttccaagtggccaatctatgcttggataattctttataatggaacattggactattctacatccattaacgaaatataaccttctaaacaggactaaatgatgttggcataaaggctttgtacaagggaagcagcttatgaagagacaaatttgtgggagcttctgaaatgagcatgaaaatgacaaattcgacgggaacaaggacacaaaatggcaaaagtcgccatgaaactgcatgcgtggtgctcgtcagagcggaaattcgacgcacacaacggcacaaacgcgataggatatcgttaaaccccaaaacttgaccatcacaggtggcgcgtcgaagtactcgtttgaccagacaactacacaagttcatctggattagctttgtttattaaagtgtaaatttcacttcgggccatcttttattaccgatgtttcgttttgtaccaccctttaagcaatattttcattttggactgggtaaacctgcctttgtttcactttggaccaccgactctcttctcaagcatataaacgatctcgattacatcgtcccctactcgtcaatgaactgccacagctatatgtaagactatttcttcgacatattataagttggatgtagatggataaaaaagtaagggtggtccaaagtgaaataaaggtaaaaatacccagttcaaagtgaaaacattagtcctaagatggtacaaagtgaaacatcgataataaaaggtggccaaagtaaaattaactctttattaaaccaatcctgacgctgctctgcccgaactgtcacgcccactgctggtttcagataggaatcctatcctgacgacgaagcttgtcattttccagacatcccctcgaatcatagcatataagcacatcataatcaattcatcaaactcgacagggatttgtagttgtttagaagggatttgagaggattttattagggtctgaaaagcaattgtttcggaatgagaagtacttaaccgacgaagtgagcagtactagtggactactaggcgtagtgtctacgaagtggataggtttgcaatgggctgggccccaagctaggttgctgactcggatccacgcccatgggccccgatggaaaatgtttcatattgctaggcccaaatcgcacgggggcccaaaggttagcgcagcctggtcccggctgattagacaccggcacatgggccccaggtagttaatcattgatgtgagattttctggttgttaagaggaaaatccggagagaagagagaggtccctgtcacacacgctggctaatactcctcccatctcctaacaccagaaaacgtatacatttaatttccatttcttgttcatcgtgaataatggaccagacaaaatcaatggctggacaacgtttcagatactagataagaacaaggcctcgatgctgcttatgtactaatactacaacatgttgatacttgatacaagtatataatcagtggtccagtgcacacctgtatttattttgtaccatcagaaaacaacggagtttatccgtgggagaaaaataaaagaaaggggtacacaagtctgcatgcaccaaacattttgatggcaacttggcaaccggtggaaacttggcagaatgccgccaattgtggccggcatgatgatacttcacgcgtgtacgttgctcggtgctccaaaccttatcggttcccacggcgaagaatgcccgtagtctcgtcatacactcgtactcccgcggagataaacactctctgtagttagctgaatattttgtgccatgtgtcgccacaaccctgaatcctgatttgataaagatgacaagaaaacgatacaatctccctgtgctgatgctgcgctgcatggatcgaaaagggcaacctctctgtactgatagggatcgatacggcatcgatccagccgaagatatttagcacctccatttcgcgcaattatcagtgacaaccgacaactctattgattatatttttcttttccaaggaaatcttagggtgtgtttgaggagaaggggattgaaggattgggtagatacgtaaaacgagatgagctattagctcacgattaattaagtattaactattttaaattttaaaaataaattaatatgattttttaaagcaacttttctatagaatttttttttaaaaaacaccatttagtagtttaaaaaatgtgtacgcggaaaacgaaacaaacaaactcactctctaccctctcgaacgctgccttagtatctttgccctttctgaccacaaaagggagggtgctttagtgcgagtagaaaactgcagttcatgcaggtgaagatgacgacgtggatatcttcatctttctcgatcggttgttgctttcggagtttcagtacttgtccatcgatgtttcttacccgttttctcatccttcgatgatagttcaatcttcaaccgatatagtagtatatctgatctaatctactccaaaagggctgaatacttatctgatctaccggcagagcacgcgattatttacgttgggaaggagttttccaagaaagagaacaatttaacgatcagagcacattagtcattagacattttcaagctgtcaaacatggtgcggtggtcagtgtagccagtataaaatggacatgaaaactttgtttttttttttttgcgttacatgaagatttttatctctcctaatgcattgcgcattagcagccaactgggaatatttcatatgaaaaaaacacctgtcagaatcacataaggacacgaaatatatactgcaccaccgaaactgattgcattgctacacacctaacctgaaagacctgttccccaactccaggcacattcagaaggctttcataaagaagaaatagaaaacaaattaccgtaaatccaatctgaatcacaggcggtatctaaacagtagcacttacagaacaatatcaaacttgaccttaacttattttgtctgaaactagcaacccaaaaggcgcatatattttacacagtcatcaccaggtcagcaaacagaacctcctagtagctcttatgtcttcaggcttccgctataacttgagaagactggccctccaaagccttctcttttctcctccaattcgacaaatttgacgctattccgcattttattcagatccattccccctcgttcgcagctttccgcgtgaaggtacgagcattttagagcaggtcagggatttttttttattttttttacgcttgatttgatgcctaaaatggccaagaatctgggccttgattcggagacgagtttctgattaattcgaattggctgctccggataaggtgaccggttgtttagctccggaagtccggatgaagtattcctcgctgcaaatcggttgaattgaagcggaattagcggttgtccaaccgctaacgcccggacagagaagaaaaggtatccgcttgggaaggctaatccggaagcaatcgcggcgatccgtcgtcgttgaatcgcttcgagagttttggcatttcttcagcgtggcatgggggcgggggcgtcgagcatgatgggaccggaggggtacggccggggatgggggcagacgtcgctgggcgacatgccggagagctgcgtcgcggcggtgctgctctacctcgacccgccggagatctgcaaggtcgcccgcctcaaccgggcgttccggggcgccgcatccgcggactgcgtctgggcggccaagctccccgccaactaccggtacctcgccgccctcgccgccgctgccgacgacgacagcggcggcgacggcgccacggaggggaatggcagtcgctgctcctccgcagccatgatcaagaaggagatatacgcacgcctgtgccggcccaccccattcgatgggggcaccaaggtaagctaatttatcctctgtaataatgactctcattgagaactgagtttagcacctgccttatatcctgtgctttctgctcttgttgttggcaatacatctatgttcttatttaggttgaagagaggacatcgaggttcttattgataggaataatagcattccttatgtggaagagagggacatcgagtagaaagtagatttgattgtgaattaacaattagtaattgttgagtgagatttgttactttatggtgatattagaattaggatgacttgattgttgagaatctcaaacatcttatttgatatatcggagcgctagtaggatagatcggagcactagtagtaaaatatgaaataatcatatggaagttgaggaattttttttcatgtgtatttggtttgccttgcttgtctatgttggatgatgcttgttcttgcttttcttgtatgtcgtgtttcaatgatctaattgaaaaatatatttgtgtgtaggaattttggatggagaagaacaagggtggtctttgcatatccatttcctcaaaggctatggcaatcacaggcatagatgataggagatattggagtcacctctccacagaggagtccaggtacttccctcatggcttaaaacctcggtgtgaagttcctttagaagttaagattaaattccatgaaactattagtttcgagacctattcaagttttggttttcataggatatttgactagaaagaatgggaataatatcgaatacctctcactgcatggtttattttcctaaatatcctactgtatggaggtcagaaaatttcacttagctctggatacgtgcttattggtgtattggaaactctcgataattatgactctcaccatgctctctttaacttagtgtcaactgctctttatctttgttatcatggccataaatttatttcccctttgtcggaaaatctttcttatgctgatacatgctttcatctcgcacctgtccaacaagagaactcctcttctttttctcaattcaaaaagagcttgttttccataaggtccatcaaagtaataagtacaaacaaactgagaaggctaatctgttagcaagcttattgtctaaactgctagtaacaccctgtgccggttcattcaaaaaacaagaaaaaaaaaagaaactgaactgctagtaacagctcacatctttgctagctattccgcttgagggtatgcttggcatgtgttggtgcttggcaaggtgctagggtccaatagctgaaaactggagccttattttctgtaggcagtgtactctaccaaatatacagagctcgtgcgtacataaggccccaaatggcgcatgattcatttttgttgatcaatcgtgctgatatatgtcatcctttgggtcatttctgttgtagaaaattcatgttgtacaaaatcatctagcagttccgtactaccattgtctccagtccgataatttctgatgcaaattgtatcttcaaaatttaggtccttctatttcattcatcacctatacggtttgatgccaaatgatttctttgataattttgcatagttagtcctctcagatacctccactgggtatatctttttagtcttcactgatgttgccaaataacaagtgactaaaccaatatatttttcaccatacagattccaccatgtcgcgtatcttcagcaaatatggtggcttgaggtggctggggaaattgatttctgcttccctgctggttcatacagtcttttctttcggctccagttgggccgaccgcacaagtacatgggccgccgagtctatggctatgagtcaatccacggctggaacattaaaccgacaaggtttcagctttcaacttcagatgatcagcaagctacgtcgcaatattatctgaatgagccaggaaactggatcctttaccatgtcggggactttgtcgtatcaagttcagatcagttaaccaaccttaagttctccatgatgcagattgattgtacccatacaaaaggcggtctatgcgttgattctgtttttatatatcccaagggtcatcgacatgaggactgcacaatctgcaagtaaattttggaaagccactggatcccgttctcctttttccaggtcattcctgtccaaaagctcaatgtatatatccaaacttcccacagaaaaaatttttgtatgggcgtgaagtcttgatcgatattctttgtagtgttagctaaatcagcaggaagattatagatgtaggtagtgagttaggcatgagtgcttctgtgcttggagttttatctgtagaaagagcagttccatttgttcatcatttgtgtagtgatgtttaggtgataaagtctttcgccgatgttttttgagatttgtacaatttccccctttcttgtacagattatgtcgtatttttacttgtaaataatatgtcagattaaaatgtttatagtttgttctactacttattctacttaactgtgtcttggtggataatttgaggctttgaactgaacatactggtttgctggaatattttattagggggaaagaaggtaagagaaaacaaggacattagttcactttagtctctcaatttatcatcaagtctgaaattcatccatcaactgaaataccaggtataacttatcccctaattcacaatacaatgtcaactttgatccctcgaaagttggtactatagtagccggttttggctgatgtggtgagtggggcccacgtgggccccatatgtttgcgggtaaccgttgtctgcgtcattgtcctcctaccttgcagcatcatcatcacctctctttgggtagatgcgccatcagatttgttggcatctacataagatgatgtggcgtcggacctgcgtgatggtctttcccataaatatgaggtcgcggttacggcctgcgtgtacggggagtcaaggggaaaaccacggctttggttgatggactctgacgatgacgacaacggctctggtggggggccaacggctgtagtgccgcagagtttccaccaccactccataagcgcccgatacaagcttaggatttggcgtcggcaatcctcttggcgatcttgcggaggcagtagttggagctatcatggaatgggttcgacgagttgatgcacttcggccacgatatcccccccccctccccgccgccgccattgtgccctgtgctcaggcttcgagattcggtggaaccctaaaagaaaaggattagcttcgcgtgcgattagggattgagaagctacggtgatggcaatggcgacgatggcaaggtgatgtggtgggcttttccctccttcgcgagctcttcgtgccgggccaccatggccctttcctcgctggccaccccgctccacgcttgagaatatgagagatgggaaagagagggaagaggatggagaagagttggctgctgacacgtgggcacatgtggttcccacaaaccacgtcagccaaaaccgtccattatattgtcgagggaccaaagttgagacggtgttgtgagttgggagatgagctatacctgatatttctgtttagggatgagtttcagacttggtgagtggtgacaacttgagagacctaaagtgaacttattcagaaaacaatagaaaagcgtttcaagaggaaccctatgggcctttgggtgctgggctatgctcagttgggatctagcgggccaactcttgcgtcggaggagtcttgttcactaagaagtgtaatgggcctagcggctctgggtttccaagcttagagttgttgtcgaacacaaaagttgcgcgtagtttttgcttttctacactctaatccttttcttgtctaaataaaagaataaactttgaataatctggcccctttacctcttggacgtatatatagcacatcaagctgcaaacctaaccgttctacaagagattatgctatgcgctttataagtgcgtaagattatcaggttgacaaggccattgaagctgggaaagcgaaagcaaggctcgttagtggtaactcgatcagcacaaggaaattaaagacaagtatggaagcatctcagtggccaaaacaaccttagatgcagtagttttctggcaagcaaagctagctttacactgacgcgggatttacgtggtcgacggcatcgcgctcgtgttgtcgtggggaaacgggaactcgccgagattaccgggccatcagaacgtgcggcaataataatcagacttcgtcttccgcctgatagagtaggactcgtttgtcctggagcggcacacttttctttttctttttgccaagctagctagtgctgcctcctcttgtgcaatgcctttttacaccgggtgccagatgggaacgtacgtgaccatgggacacgactggtagtagctagctacctgtatcattaggagggaggagtagttgttacccaccgagctagctagggagaggagggcgaacctgctcgctctcagtgctgagctcaatcagcaaccgtgttttgactgaactggtatgcaccttgaatgcatttttggcggcaatgatgcatggcagtgcgatgatggctttgctgtgttgaagtcgttggaacactatgatggggtgccctggcacagggcatgccatgccaatgccattgccaggggcagggggctgatactgatatactgggctggctggctggctggctctgacggccccggcgcctccctgtctctggccggcctcacgagcggtggacgttaaatcgccccctgcctctgcctcccctctactgggtggtccaatctcatccattgtgctgtgcttgtgttcagtgcaggttgcttcatgtttggtcttcctgtactctgggccacagtggtctaagtacgcgccggtcgatcgacgtgtcgaccggtgagagcatgcatgcatgagtgcaccagcgatcgacgggattgcactccgcgacagtgctatatacgcatgcagcgggggagaaaaagaaaaggcgcgcgcggtcagtgatgcgacgtagcctggcgtccaccgatctcgtcgcgcgcgcgcgcgcagacatggccggccctggcgccgcaacagtgaccccctcctgatcggtgcaggccgtgtgcctagctagtgtgtgggcatgcatgcagagacggcactgtggcgtggcgtcctccagcgtaatcgatctcacgcgcgactaacgcccctcgcgcgtttcgattccttctccctaataatcatggattgcactctcgcggagcgagagcgagtttaatttcttttaccaccgccccttgtacttgcagccttttgctgccgccggccggccggtcaaggtttgaaagtcgtctagagagcgcgcgatcgatcgagcccgcattgtcattgacccaagaaaaaataaaaccgatccatccgccgcgccatgcacgtcaaagcgagtcgctgtcaccgcgctcgattcgcgcagcaagttgcaccggcgttggccacacgtcgtgcgcgcgtatcacatacgtagtacgtactcctatcctagctagctacgtcgctcgctggacggagccgacatggcgagcacggcgcccatgtcgtcggcacgtcgtttgctgcatgcgcgcgcaggcggccgcgggtcgtcgctagctagctgatcgatcagtcgatctgcaggcgcggctcgagaggcttccttgggttattgaggggcacggtgggcaggaggccagcgcgcagcatactacatggcacggatagggctaagggcagggagcaaacaggccggtac

SEQ ID NO: 79652 - DNA, 7948 bp, Oryza sativa
aggccgccaccgggggagatgggccgagagggattcggcccatcgaacccgggggaggcaaactagacttttgcggagggatttgatttggaaggatttggattcggaattgaactcgacgatagatcggggattgagatcttgagatggcacggacactagacaacaagcaaagaaacaaatttcgcaattagggtttttaggagataattttcccgctaggcgccacgacggaacgggcgctacaaatatcaatcagcaataatcattattaaaaagttggttacaaatgaatgggaagaacaatatataagacgtcatcttttctatgcggtttatagaagatatataaagtacaaaagtccaagagtcctagggtgaaaaatcttgaagtctactaggaaactacttcaaatataatatgcagtactccttttttttaatagatgacttttaaatacgtgtttgaccattcgtcttattaaaaaaagcaaatgtataaggtataaattatacttaaagtagtttaagtgataagacaactcataacaaagtacattataattatgtaaattttttgaataagacgaattgtcaaatgtgtgacaaaaaaaaatctcttaaaagacggaggtaatattgacttggtgaaaaccagatcacgtaaaaacgcccttgttttagcacattatcattgcggcaaagcaaaatcaaggccgagtttagttccaaaatttttcttcgaactttcaacttttacatcacatcaaaactttcctacacacacaaactttcaacttttccgttacatcgttccaattttaacgtgaactaaacacaccccaaatacaaatacccattctaataagattctgtatagattcctatgcatcccacttggccaatttccaaagcgatacaaagtacgtgctttgcataattttttatacaactacgatgatgagctcattactcatactcaaaactaaaaagttcaacggcgagtgtgaatgtgtggctcagagcgaggtggaataaacataacatgtactagctacttcgtaccaagggaatgggagacagatcctgtgagagtgtgagatgcgtctcatcgtccatgcctctacttgtgcttccgctgccaataattctgttcagtgtttgggcgaatatttccagttcatttcgcgcagcagtgagccgtggtggacagcattgatacagcaccgaagtctgaaattccttcccttttcaagttgcatctgccagtagactttctcgtttcagaagcctcgtgagaggatagattaacagagtgttctgtagcatgagctagctgggcgtggcaggtcacgataatcgcagcgccccctaattccagtgtctaaatttatttaagcagatcgttcttcgcgtggtgtgttaatttaacttcagccgcaaaagggttgaaaaaaccgagcgcttagatccgtgcgcgcgggtgcgacttgaaaagcgaagacctgatctgctactcgatctcaaccaccgaatgattgtaagcaaaaacgcgcgaactgaaaagggcctcgacgacatgagatgcagagaagctagctctccttctgaactaaggaaaagatccagagagagaatatatatttggagcaaatcaatgccaggatctcaatgttttataattcatgcagctaggagcgtatgccactgtgtgatggagctaatttgtaggctacagcagcacaactgcacaagtgaacccagtaggcgtttcctcgttggattttgtcaagctactgttggattcatttttggacgatggagatatgttactgttggattcattcacatgcatgccttgttcacaaatccgtcgagaattttggctggtctcgcatcttggcaatttgcaagcaactcgtattcttgagttgtgtagctaaggaatttcaagcaggtaaactgcatgcatgcatttggccactccaaatgagggataggaagcacttctgaacaaatgatgaaagagatgatttcaactgcctgccagcaacaggaacgtggaattatttcattttctcccatacgtatggatcagagagagggagtaggctgttggtgttggagcccccaccgacagaagaatacaatcctcgtcagcaacgctgaaaacacgtcctgctgaagtagaccaagtacattaataattcccccccccccccaaagatagattaaaatgcagttcatcagcgaactttgcaaaccagagtttttggctagtccattaataagtacaaatgtacaatacaattttcttgatctcgcaacgagttcacacaaatcttccttcggaacagagcatgtcaaccatgaattttcggtgagtcggtttagtgaaccaatggatgacacctgctagacatgcacaacagtgacactgtgacagtgatgccacaaacgcgcagtcatcacacccatgtagcagaggtagatgtgttcatccaccatggcatatctggatttttcacattttagtccttttaaaaaacttatcctccaaataaactcctaaaaaaacttattctataaatgattcttttcgcggcgccaatgtcgttggcgccgtgattcaacatgacgacgccaatgacgttggcgccgtcccccccccacccctggatgaaagttaagtcacaaagaagaccagtttgtaaatttttttaaaaggacttatttgtaataaaaaaggacccatttgtaaaaaaataaagtgaattgcatgttggtcttgttattatgaccaaagtttcaatttggaccatggcacatcccaacattttcagtttaaaccagagtcttttaccttggattgcagattagaccaccctatccatttccacatcccgttgtttccactcagccactgcttgctcctaaatcaagttgctgcctgctgccgatcgtctacttcggcactgacattgggtcaagccagcagatgagcacaacaccattaacctgaggtattgagagccgcggggaatggcgttgaagagatgagctctatctatgttgcccctaagcttgagctcgagctccatcagtggccacctttgccagctgcgtgcttgagctctacctccaccttccatgccccatgctcgagctccacttgcaccgctgtggcgcctcaacagccctgccctgaagctactcttttttctcccatgtgttgtgctcattgctcttgcaacaatagtggtagcaggatccggtctagtgcttgatctagtcatcaagctcctaatctagatgcttaagatcgagaaaaacaacagatgggcaactagactgcaaggcagactggaaacggaaagtggagggagcgatagtggggatgggaatgaccggtctggaggaggaagagagaaggggaagagggagagacaccaggtatagctgacatgtgggcctctagaccaaattgcatgctcaagtaactatgtctggttgaaagtgaaaatggttgataacacctagttcattgtgaaacatgggtaagaaaacatagtccaacatgcaattcactcaaaaaaatatttacaaatagatcctcggcgccagcgtcattggcactgaggacctatttgtaaatattttttatttataaataggtcccttttcaaaaaattacaatttagtcctcgacgccaatgtcattggcgccaccccccttcacatttgtaacttaactttcatcggggggctagggagacggcgccaacgtcattggcaccgtcatattggaccacggcgccaatgacattggcgccgcgaaaaggatgatttttagaataagtttttttaggtgcctatttgaagaataagtttttttaaaatggtcaaaatgtgaaaaatctagggcatatgccattcttttacgtgtgatattaccgtggatatatgtatgtttctatatttcaattgggacggcacgtaaatttccatttctcaaaagaaaaagataaggtgacaaactatgcttgtctttaccaacagaggggaacaactccaaagtctgcaaatattcccttggtccattattacccccatgcaagtggataactatactagcagcaggatgttaaactagtgacactagacaaggagaactcaggcccaaagctgataaacaaaatggccagcacgtacttccctgatctttgcttcgatcgcatggcacaagctgataaaacaattcgccatcaatcgccgtctgacattgtttcatctctcgccgcggttcctgatctccggccggtcagaggcagaaaggatctcacctttggatatggcaggggctgggggtcaaatgtgcagtttactataaccgggaatcgtttgggtttatagaccccaaatcctgcggatgcagatacaggctccaacctgtaaccacggcgtcgcgattaggatggctcaactgaaacggccacgtttcttagcatttcgtaggaacacgcactgttcccgcgttaaggtgacgcgcgcgtgatgaatccgggcgtctcgccgcgttgcagcatttgcctacgtgatttttgtatgccggcgttcggtgtgcattatctagtgacattcggcctccgaccctgctggatttggcgataacgaatagacatacgccgctgctgttcatgaattgtctaaaaccgtggaaaattcatatttcggtgagtatatattgtcggccgccatgtccgaaccattacgacgtgtttaattctgccatgatatattatattaggtatattccatatcttttcttaaaaatagatggttgatattgtacagatcctattctaaaacgatatgatactatgcgggtatcagatctagtaattacgaacaccaagtctaataccatgtggataccatgcctaatacccatggtagtgggtgcattatttgtagatggaccaatcaccccattcaccattggagatggcattggcttgggtttgggtttcttgtggaaagtcataaaagagatgcttgtggaagtagtcacatagaaacatcgaggtgcactctgccgcttctgagtatgcggtggagtagtgcatcttgccagcgttggtgacggaagtgttagcttagccactaccattgttgtctgtacttgagagggtacaatcttagacggctcctgcacggggcacaacgtgttgctcgatgcaatgtgaacttgtacgagcagtcaatggagaatgcgcacgctgaaggtgacgttgccgtcgagctccctgatggctttgccctcatacttgctatcgtgttcttgcatgtgatgactataaaggacaacaattatataactaacagaaaaaccattctggtaagcacaactgaactacataaactatcttctaggtgaaacctatagtagtataggatgaaaccaaggagttgtggcattgtcgcgactgttacatccttcagcctccacaaaggtttacactgctagataaaaccggcgatctcttcaattgtctctacggaaacaacataattccagatttatggttgaattgttgattttctagaagctctactggactaaacaaaagattgccacaaagttatacttcaaatctaaggagcactaacatcaatcttgttgactaaggttgcataagcggttggcgctcaacccgaatagagaccatgtcatggttactactctctccgttacaggttataagatgttttgattttggttaaagtcaaactgcttcaagtttgaccaagtttatagaaaaaaatagtaatattttcgaccaagataaatttattttaaaaatatatttaattattaatttaataaaactaatttggtaatgtaaatattactatatttcactataaatttagttaaatttgaaacagtttggctttgaccaaagtcaaaacatcttaaaacctgaaacggagggagtattatgaaagaaggaaatagaagacaccctccaaatctagtatacattaatcgtcaaaggatccagatggtggcgatgcatttaacatgtataaatgacggtggacaacatggaaagcagcaatcaacatgttggcaacagtgaccttcagatagcagtagttgagagccaagccatcttgaagggtttgccagtaaactagcccttcggctctccagtttagttgtttgccgacgctggatccttgagactccattggtacatttatgtcacgccccgaactagtaccgaccggaactggcccgtgacgctccaaattaacctgttaatcgataccagtcctaggaaacagtgctggtatcacaggaagacagaatatcacagcaacagaggtctctttattatagagtaggagtacagtcatgttgggctgcggacagatcccgagctcacaactgcattacaaaaggaaagcggaagccaagacttgggccaaacaacacaggcacgacttgagaactaggccgaaaccctaaaactcatcgtagccggcttgctcctggaagaactcctcatcagcaggatccgcttcatcttcttcagcaactggggggggggggttatttatatagagcaagggtgagtacgggagtactcagcaagccatgggaaataagtgtttaatgcaggcttcaaggaaaggctgttgttgttgcaattgattttatttgaactcttttctgaaaacaactaagtgagtgcttctcaaacgacacggttgagacagtgcgtctcgtccggtcggagtatgtgcaatgtatcagtctttaaaattgatcaagattggcacccggccaacagctttcaaacggccacccggaccaacaactttcaaacggccacccgggcctacaactttcaaacggccacccgggcctagctgatcccatcagctgcagattttccaaacatcgatcccctttccacaacagcaatttcacaaacagtaggcaaacaaaactacgctaggaatctcctcacatccacccatgaccgtgggcacggctgttcgaacagtttgttaacctctgcagagggggtacactttacccacacgacattactaacccggatcacccaacccgtggggatcagccacgtcgggagacctccaagctttcatgacaaggcatttcgaaagccgacacaggtttaccatatgccgacgagaggggtcccagaccgacaacaggttaggtcccagaccatactgtgctaggaagcccaggggtcctccccgacaccaccccgacgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacccggtacgttccctggtccgcggttttggaaaattcatttagttcgcaagcaccgacccaggtgtcgggttttccaagtcttttgtaaaacccatgttttacccaagatgtttttcagattttaagtttgaagacgaccgttgatactcgtgcagagtgcacgatttccgaggcgcaactgggtggttacaagggaacatggtataacaattaacagaggaaggatcaaatgcaacaagctaggtaggtgtagcgcccgttccgtcgtggcgcctagcgggaaaactatctcttaaaaaccctatttgcgaaatttgtttccttgcttgttgtctagtgtccgtgccatctcggatctcaaatccccgatctatcgtcgagttcaatcccgaatccaaatccttccaaatcaaattcctccgcaaaagtctattttgcctccccggggtcgatgggccgaatccctctcggcccatctcccccg

SEQ ID NO: 79653 - DNA, 5652 bp, Oryza sativa
cctcaaacgtcgacaatatcattttttttgtttcatgatatgtactgataaaccctcatgtttcattatttgtttttttttttactcctagctcgattgtcccaaaaaaatatatagaaaattacttaataattctcgcagcaaagcacgggaaatcacctaattttcttaataatcatgtctaacccaaaacttcttatattctgagacggaggtagtatttatttgctaataagctggtagcttatactcggcataggaccaaccgacgagggctaaactatggcatcatctctgtgacttgagaggtttagggttgatgatgacagaccctggtttcgcgcgaattggtgcagtttttgcatcttggtgtacatggagtgagtcgaatgcatcgattggttaacaaagatggtgaaaaccacgtgagatcaaaaggggatatataataaactcagtttccgttgttatttttctggtggatggaacttcagaactcgcgaaacacatcgctccatctgccggtcatgtgaaatctaatctaatatagaggaagtgacaagtgaggtgtttaatggaaaaaaaaaagataacccaacccttttcttctccatttttgaatgcaaaattattgccaaaatatttaaaaaaaagaaagaaagaaagaaaaggaagtcaagcaaaaagcaatctaacggccgggctatttggtaatgttccgtagatttatcattctttcttagtcaagcttatcaaaggtgaggccatcaaaatccaaaccataatttagccaccaaattaaagctgtcacaatttacataaattcttatcatacttatggatgtcaactaaaatatgcatctaacatgattatacttatataacaatgcataagtatgataaaatgtagcaatctgtggctatcaactaaaacagcctctaaaatcttctagtatagatgtcttcccatttcatttcttaaatatgattcggtttgaaagggaattaaagagaatcgaagattaacagaaagggcatttggttgccatcccatgtgcacagctacttaggagtacacattttggaacggaaatatgctcatttggccgcaaagaacaaaaaaaaagaaaaggaaaaagcacgccgactgacagccgtaccccacatacaccctctgctcatgccctgccccacatgtcagcctcacgccgcccgtgggccccaccacaccgagcaagtccaccttcctttccaaatcccagaaaccgaagcgcgcagccgcaagccaaaatttgagggatttttatctctctctgttttcttttttttaatttaaatcatcattccgttccccccatctccgcgtcccacggtttcgtattcgcgaaaaaatcttacccgccagcgagcgcgcggccgtggcggcgatcgcattggcggcgacgcggcgagctccaatcccctcctatggcggagggggagggctcctcttccaggtgagcgcgcacgctgccctcccctccacaccccgcgcagcacacgcgggcgctcgctgctcgggtcaagtctgatgcgtttctttgttcgttttgggggggttgcgatgcgatgcgatgcgatgctggggggtttttggtcgcaggaggtgggcgttgggcgatccggatgtcgtcgaggtgtcgccggaggcggcggcggcggcgcgttggagctccgcgcgcctgaagcggaagcgcacggaaggcctctctgctctctttcttcttcttctactttcttttcttttcttttttctttttttctttcttttttttatttttgcgtctctgaatcttgcaagggtttgggctgtctctcggtagggaggttccaatacgcgcgtgtatcagcattgggaagaggattggaaatggcctgattctttttttttcttttcttttgggtgccataatgtgttgtatgcctgttataaaacatggaacttgcagtttgttcattcttgattgatcaatggaaatccaattctgccatatagatcaccgcattggcttctgtagtgattccaccaagtctattgtggtggctggttgtgttcgtgtaatttatctgtcaaatgacaagatataccccatgctgaatgtggagtcgttgggtgtaatccaacttatagccattaggcatatcctctcatgaaagtagcaattgtttactggaaagccagcacaagtcatacatagttcactttgcattctgaagtatgtttttgtatcccatttccctttctatgtgtcttttgattgttcctgggaattagtttgtgccacacaagccgtgttacgacttttaaggtccatttcacgaaacccctccgagaaataacagtttcgttattgcaactttgagtaagatgcgaagaatctaatatgctatatgtttaatcaacagactgttgctcacgaaataattgatctcgacgccaatgatgatcctgatggagttatgataatttgtgagaaggcgtcgagtcacaagagtaatcattctgttagtcatccttcggattggccaaagcatccaaaggttaattcattggagtgtttttgtttaccattgtttagtgtgctatgctaacagttgatatatctttctccattgagtaattctagagtggcttggctgaggatgttcctggtccaagccatcaacctggcacgagcacagttctaccatggggatgcacaactcctgggagaccacggaagcataaggaaattaaaaccgtggataataaaattgatgagaagtataaggcatttaagcagtttgatactgttaccgaccacagtgatcactattattcaatgtcaggcaaagggaatgttcctgaagtcaagaaggtatgagtttgcacgtgcacgtgctctatcttcacttgatctctgcaattaaatgtaatcattgttttttggcagccatccaaggactgggtgaggcggattcaacatgaatggaaagttctggagaaagatttgccaggtagagctctctgttcttttatggtttatttactccagatgttgcacatttgattaagggagtgctcctttttttccccatactattgttcttcattcctctttctgtacacgcacattaggtgagcaaaagctctaatacatgtttacaataaaatatgaatccgtttttcataatgcatataatgaccttgagtatattctctgtaacttctattggatgtagctggatgttaaaactgaaatgcagtagttcatgtcctgactgcatctttcctccatattgagcaggtacaatttttgtacgagtttatgaggataggatggaactacttagggctgtcattgttggaccggcaggcactccttaccatgatggacttttctttttcgatgtatatttcccttcccagtatcccaagaaacctccagtaaggatttgttaataatgtcatatgcatccataaagctttgttattccttctctctattctgagcttgcatgtgtgacatataattggctattctttcagctagtgaactaccgctcgggagggttgcggcttaatccaaatctctatgatagcgggaaagtctgtcttagcctattgaacacttggtctgggcatgggtgtgagaagtggaacccatccaattcaaccatgctgcaggtcctagtctccattcaggccttggtgttgaatgcgaaaccttattttaatgaacctggttatgcagcttctgctaacacaccccagggggagaaaatgtccatggcttataatgaatcgacatttctcctatcctgcagaacaatgctgtattctcttcggaatccaccgaaggtatgactacactacgcttacatgttttccttcctatttgttgtggatatatatgttctattctttttcgcatccaataatctttgttgtcatttctgttgatgaagaatgcctaatcgttaactgtttccattgtaatggtgtaaataatgtgtctgcccgtttggtgaagaagattaatatgctgaattgttgataaagatgggtgtgatgaacctgtattgttttgaatggtctattttgctttgccatgcgttgatgcctgagttccttacataaagctgctgaataatccgggtgcaacttttgcagcattttgaagacttcgcaagggttcatttttgcaagtaccggcgcaatatcctcgtaggatgcaaggcctacatgaatggtgcccaagttggatgccttgcaggaaacggagtgcaggatgttgatgaaggcgacaaaagctgctcagcgaacttcaaaggctccttgaagacgttatttgatgaactcatcaaggaatttacccggataggagttcattgccatgaattccagcctcagagggtgaatcctgggtctaccagagccaaggcggacaccacattgaggctatgataatagtaacgataggtggtcaacatgaggttgacaattttttttttgtttcttggggatcagagatatagttgttggtgctatcctcagaaatcaggaggataggagggcaaaaggcctgcatcagatcatgtccaattatctaaaccatcatgcggttagttggtttttgtgtatatccctgttaaacatgtgggttctattcatctaagaacagtagtttaccacattcatcaaagggccatgctggtgttacctgtttaccttttgtttttgttttttttttttttttggtcaagcaaaaaaggctgtttacgttttgttcgccggttttggtgtccgcattgagcgtgaagattgtttatccccgccgaagaaggcgatttgctggagctagagataatgccggaaggagagattaatttacaaattaatcttagtccatagagtagacgatagtcaatcgttaggattggcttaaatccagacgatagagatgaggccaaactccagagaatcgattggcacatggattaggctgtgataactgataagggtttgtaacttgttccccgcactaaaaacaagacagctcattagagtattaattaagtattaacttaaaacaaattaaaagaatattaagttaatttttaaaagaaactttttatacaaaatacatcgcttagtgcttactagctccgtcccaaaatataacaactcttgactatgaatctagacacatattattatccagatttatagttaaaaatatttatattttggcatggagggagtacctgtgattccaaacacaacccgtagagagtagagatagtagaggtaagcagtgttcttgtgcttgaataagttcacattaggtcactctattggtcacccagtctaattttcatcctcagtccagaaaaccggatacaatacatccctcaactttacaaaaccgtgcagacgagatccctcggcagtattatatctggttttggatgacgtggcgcctacgtggctggtttgactagatcctcgtcccacgtggtattgacgtggcgcttccgtggcaattggatccctgaaaaataataaaaaaaacatgggacccatatgtcagctaaaaaaattaaatggtggggcccacatgggccccacat

SEQ ID NO: 79654 - DNA, 3797 bp, Oryza sativa
ccgccatcactgcctgcatcttcgtcttcctcctcgctcccaccgcgcagcaaccgcggcaagcagccggcgacgacgacgtggagatggccgaggggaggaacaacaaggtcgccgacggtggcgggttcggcatggtgctgctggagatgctgacgggaatgcgggcgctagacacggggaggccggcgctgcagcacagcctcgtggagtgggccaagccgtacctggcggaccggcggaagctggcgtggctggtggacccgcggctggaggggcagtacccgtccagggcggcgcagcaggcggcccagctcacgctgcgctgcctctccggggaccccaggagccggccctccatggccgaggtcgtcgcccagcgccccccagtgctgccacgccgtcacccgctccagccgacctcctcgtcgctcagccgccgcccgctccagccggcctcctcgccgctccgccgcccaggagcgggagagagataagagggggaggaggatagagagaggggatagagagaagatagtgaggacgacatgtgggtccacatgggcccactatttttattattcgtgtgtgcagctgacatgtggccccacaagttttattattatttttttatctaattgccacgtcagcgccacgtcactaacacgttggacaaagacctagtcaaaagaagccacgtcggcgccacctcagacaaaaccggagtcaaatactgtcgagggacattatttaaacggtttcgtaagttggggatccgttgtacccggttttgcgattaagggacaaacattggactgggcaataaatagagggaaccaaagtgaacttattcctctcgtgctgggccggacttcagtttaggcctgccgaagtacctaattgggctctctgggccagattatctgtaaattggagaacaggctccttgtggaaaagcgttagcttgagggggggaatttccaatttaactcgttgaatctgattggcatccctaaatcaaaacagatagaacagttcctccaagtccaaatattaaaaccgtgtagaatgactccgcgatgggcacactcgaattagtcttttagcatgtgaatccatgctaaactgggtagggaatcaaagattattcgtccaaattggttatgaccgtgggatatttcaaagcgatgaactgagcattttcgactatatatttccatgtcactcgagaaactagctcacattcgtatgattctaccgccgtatcgataaagcgactagccataatatttttattatggctctcatttcttctctctgcctgtttatccccccccccccccccccagtgctggaaatcaagcaatatccatattcaggaaacatatattttacctagcatctcactttccctccacagggcaggacaaaattctgaggtgactcattatcagtttttggccaaacttttcacatagagcaaaaataaacctgtggctgaaactgggcttactactcacatcacaaattgaaccatgcacataagtctcaggggcggttcaggtttatgccattttcaacataccatttttttttcaaagttaccaaaaaaatatctgcgtttagtttgttgccaaatttgataaatacataagaaatcctgccaaaattttagcaagataggctgcctatcttgctaaaattttggcaaggtttattttggctataatctgaacaggccctcaaatgaaaaaaaaatagacatataaaatccacacactgcaagaatccttttatctgcatgcaactccaattatgcgtatacaatacacacaaattggtctccatcaagtgttccaatcactcaccctatcagaaaagcttgagatatagtatgaatctatgcaatatttgtgctagtggtgtctatgcaatctttgtgctagtggtgtcagacccctcacgaaatccatgcagagcccacaaatgctacatcctattgcgttgtttgtggcgcttcggattctgacaaccacatgatggtggaaatttggagaagctggagaaactagcttttgacctctaaaaacaattaagattgagaattgaaatagatatgattgattgaaatggaaaaatatgtgagaaaaaactaaatttgaggtagatgtgattggtcgagtcgaggaagtacaactctatattttcattttgatgaattttaaactccttatcacggagggaggatcctgtatccaagagcgccgcaaccacaaaaatcagaagggtctcactctaaaacctcatgccgtgccgtcccattgtacggcgcctcctccgttcgctgaagagacacccagtgagcagtccatgagtgaccgatcgatcaacaacaattgattaactagataattattagtgattaacggcagtaacagcagcaacatgaaagctgtcagcccatgctttacatgcatgctgattaacaatgagcttgaggcacaatgaagttgctaattgcattgagtaattgtaaaggttgtttgattagcatttgtctcttctctgggcagataatgctgctggatggctttagcacatggaccctgatcctgtctactgcagtaggtaactataggtgcatgttcttctgctttggtgaaaagaaatggaaggaggttaattaatggagtcatggagagcaccatgattcgataggtaaatgatactctactacagtctacacactccatgttctgcttgattttgaaatgaaatttccctggatcataccatacttgagtcccctgttggatgatcctcatgcagaaaatgtgagggggaagaaggaagaagtggaagatacgatgaagaacagcaagagggactgaaaggaacaagaggatgagtccctcctccaaaaagatcctgaatccacccctaaccataagttgtcagcataaacttgcatgtttgaggtggattccaaaacttgaccaaactccgattaatcaactttcacgttccataacttggtttaaatttcggtctttctagacatttttgcatttttgtctccttctatgcattgataatttaaagcctgtggccggtgtcatcgctaaaagcggtaaaactccaaatatgtatcctacacgcgtggagtgccacctttgattccctacgaataatgaattttcgaagaggaaaatgtgtcattaattgtgagatattttcttggcatatgatttagttgagtattaatttctatagacttaaaaaaatgtgcttacggaaaatgagaaaattgccgtaccttgtccaaacgaagtcaaccttaggccccatttggcagtgagtttaggacggtatagctccggttccttttttttttttttgagctgggcattcctaacacataaatttatagatctacgattataacgataacatttaaataaattaatttatttctattaaaattttaaacatatatagttaatatataactttaaatctatctagagctatgccaaacaagatgtaggtgtggcaactttcttgttctctgctagcatgcttcacaaattgttaaacggtgagttcttttgcaaaaaggaaatactttgtatataaatgttttcttaaaaaatcaaataaacctaattttttaagtctgtaataattaatatttaattatcatacattggcttttctcattttgtgtcgtgaattatcgtagaacacccaaaacaaactactcccttcatcccataaaacaaactaataggagacgt

SEQ ID NO: 79655 - DNA, 1277 bp, Oryza sativa
ttcctgcagcccttactctactccttttatcaatatagctacatggtctgtctagatttattaattgtagtaggatatgttttatgtaatataaggttggatgaggatagttaaacggtaaaagtaaaggaaacagtgagtgccctttgaatcacatgaatacaaaaattgaggaaaggaaaaacacatgattctaacaagagcaaaacaaatgattgcaaaatatagaaaaacatagggataatcatttgattggaccgcagtaaaaacataggaatcagatgagagagataaactcaaaatgaaattttcaagaggtttaagctcttactaaattttctgtaaaatctgtatatgattgtttattctatagggatttcgaacgatgatataggattcaatcttttgtttcaaataccttcgtagaaaatttttctataaaatttaaatcctttaaaatttttatattttttcttcaaatcaaagacacatgaataacagccaactccaaagagaggagggggccaccaccacattgaagtcactagcccccaccccacccccccagagccagattataccggtgcgcaacgcatgcgcggggggacacacgacacgagagacagcgacgtgtgcacgcaccgttcgcgttatcgcacagtgattttggtgatttgattcgattcgccgcgcggccaccggtagccgtccgcctcctctggggctctgctgtcgccgtcgatcgatcggctcctttccgccaactgccgccgcgactcactttcactagctttgcactaacacaatcgatcatgcatgcacacacccccgcctgagaaaacaaaaggcgcgaattatttttgtgttcctctgttgcctgttgtggtttgtttatcttgggtattccggccaatatgagatctgatgggatcgaggagaaagcgacactgccatttcacatcttggagatgggaaattgctcctgagttctcactcaattattctgggaattgctaaaataattaccgcaaatattgttaactatgatataactgcactggaatttttatatagcttaagtacattttttatggaagttacatgtattttaataatagtgcaaatacattataaattatatttgaaagttttctgacaattttctaatagtcttatcatttttaatgtctttgaacttatcccttatatacgcacttgaatttttattttgattctcactatatgcattacattagttaactgttagttttattcaa

SEQ ID NO: 79656 - DNA, 2802 bp, Oryza sativa
tgaaaacaaaaattttttttagttgatttaaaattttggtgaaattgttgtatgaatatcattaaattttatttttatatttattaaaaaaggttgaattttcagttttcaatttttcagacaaataatcttatcttcttttttttaaacaaatgaatctttgttcatgttgagaatcaagttttttttttttaaaaaaataagctagtgtataagcaagcgagtgggataatatagtcattttgaaaaaaaaaaatcaatgactagttcacattgaactatgtaagattgagatctttccccagttttcccaactcatcttccttgtttttcgtccgcatgctttttaaattgataaatggtacgtttttttaaaaaagtttatatacaaaaattgctttaaaaaaatcatattgatccatttttaaagaaaataattagctaatacttaattaatcacgcgttaatggatcgttccgttttccatgcgtaggagatgagtttctaacccaaatcaatgaacacagcctaagaggtcaaataaattgatggtaaactcagggatatataaagaatttcttcttttaaagaagcgtaaacctcatttagattgagtgcgtgtagaatctttttcctgagttcctacaagaaataatattgtactcctacgtatcgaagtcatgcgaaactcatgcatggccttttcacgtttttcttgttaagaaaccccaaacaacaagcttctaaattaaaacgagcatcgcatgggctgtgtaatttggtcgcatgattgttatgttgggcattaatattttcagcgtttaaagaaattaacttgacaagctaatcactttcaaaactaacgatatactaaatcagagaagtagagagcgtaccacaaatgaggataggcatgcatgattgaagatttgaagagcacatgagaattatacttcgcttatttcagcataactaaaacttattattattattattattattattattattattattattattattattattattattattattattattattattattatataaccaatatctttgtctcgctggcaatacgattccaagctgtgtgtatttttcacatcagtttttttacacatattgtaacaaacctaaaacctttgtgtatttttcacatcctaattcacgctgacaacaaatcgacaaccaaatttaatttatagtgtcattgtccaggttcatcagtagaaaacaaatctcgccaaaccttgcaaataaaaaaacaaaaaaaaaagaaacaaagtactcatccggatataattataattaactcggcaatttggttcgacgacgtgatgaaaaagccgcggcgggcgcgggcgtgcgcagctacgcggcgtgggtgcgggggttaaacaagggaaggggtttttggcgtcactcgcttctctctctcccctacgcgccgccggcgagatgcggagcctcgccgtcgcgagccccctcccgcccgccgccgcggttcgccgccggccacgcgcatccgcctccggaaggttcgggacacatccctctctctcactctcacggccatcccattccgccgcgttgtgtgtcgttgttcgttgctgcgaaatgggtcgcgtgcgtgcgtgtgtgggtggtgggacggactcgcagaacggccgtcgcatttcaggtggacgtcgcgcgggtgggtttccggccgtcaccggaggggttgcggtcaccggcccgatcgccgcggctagcgcctcgtcctcctccggagagaggccgcaatggatgtggctggcgtgcttgcagttggttttgcatactcaatcggagatttgagatgttcgagtgatgggaggtggtgtagggaaatccggctgtgggtggtgttagagttggtggatgaggccgattggttgctcccttctctgctttgatgggatttattaatagttcatgaactgagagttctgcgtttcatctctctcgacgtaactgtggaatttctcgtacaaactgtttcagaattcagattatgcgatagttttagcctttgcctgtgcagagtgcagtcacggaagaagaaaacagacgattgatttcttagtattagtgccaaccatgcaaattcaggataagccatgagatcttcagatttcatactgttggcctcccaagccataattggtacaagactgatggaattcaattttttcctaaataccagtctccataagttgtgaaacaaatggtgggtcaatgaaatatttgaatcaattgtaatctggtgggcttcaacggagattagtttagtccatgtcaatttcaatcaactcattacatcatttttagataagatattgcattgttaacttgctgttactacttgttcactccatgcaacgtcttctgtacaagttttagcttatcttcttctcataacattgatgctatgctgcttggcaaatcttcagggaagtgatttcacaatgttggaagtgtgagataaatcaggaccaacctttggggaactccctaaggtagataattcccccttttgcagtgaatgctgctgtacattaataaagtacctttcaactagaactatgctgtcatttgacaatttcacttgctgtttagttgtaaaagtcattctcagatacagttgcattttcactgcttgctgtccgatcttctaaaagttattcaatacaatttttagatacagttgcatttgcactgcttgctgtccgatcttctaaaagttatttaatggggtgcaggaat

SEQ ID NO: 79657 - DNA, 2155 bp, Oryza sativa
ctgtccgatcttctaaaagttatttaatacattgttcctggaacatgtttttcagtctagtctgggacggagggagcagtaattaacttctgaagtcttgtgttatcatctgcattatgttctaggagtatatgataacgatatttcttcatcagttaatattccttttatcttgttactgtcttattcaggataggtcactcacaaggtagtttgcaaagacatggttccaggaatttgctcgcagctgctggtatatctgctttccaccatgcaagactattatttgattttcttatctttcaagaaattaaattagcactgccttatcttttctggaaatatttataatttatttcttaaaacgtggctgttaattcagctattagttgaaaaatatggattggtcttcattttgactaaccagggtgctttagtgatactttttattgttcagacttgctcaaaggcctgggtatggcaaggcacaagacttgccctgggccaatctaccttaagcttgatgcctggaaaaaaatagtttatctgcttttatgcaacagtgctagtttatattatgccatattgcaatacatacatagtttccttcccatatttggcttgcgggtgcctcagtttccaaggtcaacctgggtcagtttttgaatagctcatttcagttaatctgtttcaattcaacacaatactgcaatattagcctctctctttcttgtttccatctcagttttcaagttcatatagtgctattggtgtcggtagtctataacattctaaccttattttaccagacatttaaccatgttaatttattacgtctctctgcatgcatactttttgcttgcagcggctatttcaattgaacaagctgaagtcagtacttatcttccaaaaggtgacatgtggtctgtgcacaagtttggtggcacctgtatgggaacaccccagagaattcagaatgttgctgatattgttcttggtgactcttctgagaggaagctgatcattgtttctgcaatgtccaaagtcactgacatgatgttcaaccttgtgcataaagctcagtcaagggataattcttatgtgactgcactggatgaagtttttaataagcatatggctgcagcaaaggaacttcttgatggagaagacctagcaagattcttggctcagttgcattctgacatcagtaacctgagagcgatgcttcgtgctatttttataggtttgagctttatccatatccatgttaatttattttaagttagaagtcttgttttcggtggaatatgtgttgttgcatggctcataggaagtttgtttgcttgatcctgagctaaccatgctttgacatttacatcagaagcaccatcgcttgatagtatttatcttttatcagtgtttattttttgaggcctatgcatctgttcgaacagtgacgttttatccactgctgccagaaacttgcagtgaccctgctacatctagcctaaattagggggaaactatcatactgtttccaacttcactgcagttgtttgagtatatatgcagtaacatgagtgtcatgatttttttagatgtttaatacctttgtttgtttatgtatgtttcagctggacatgcaacagaatcgttctctgatttcgttgttgggcatggagagttgtggtcagctcaaatgttgtcgtatgctataaaaaaggtgacgtaaaaaatatgcctgaaacatttttacaaatatctctaaggttcaacaaaatggattttgcagatggtttattcattctgaatcaatatttcctacactgcatggattatgttaatggacaactaaactacaatgatacaataacatttgcacatactaataccctctctttcaacaaaccagagtaaaatgtgaagttagtatcaggggtaaaattaagccttgaagtctgaagaggctgttctgactttccaaaagttcagttacaaatcctgcagcatatgcagcaacaacatatgcttttgtagttcagaccttgtcttaatatattacgtgcaactgccagtctgccaccatatgatgctgtagttcagtaggacaacttggttaatattagtgtgtaaatgttacttctccattcttaaa

SEQ ID NO: 79658 - DNA, 848 bp, Oryza sativa
acccaggtgggaggatgcccaccacccgtgtcgccgcccgcaccgccaccgaccgctcgcgccgccgtcgtggaaggccagaggtctccaaggccgcccgctcgccaaatccgttgccgtcgaggaagttccgagctaggacgccgatgccgcacgcccactcgccggatccgcctcccccactgcgcgccggccgtcgccgtagccgcagccgctccctgggggggatccggccctctcgagggcggcaccgccggatccaccgcccgttgatgccatcgctgcccggcggcgctctcggagagggagagggagaggagaaaagaaagaaagagaggagaggataggagaaaaagagagagagggcagggtaaaagaatagaggggagagagaggggagatagttagaaaatatttgaagtggtgggagggaaaagagagtggagggagatgaaaaggttggggtgatatttttgcatgcagaccacctaaggagccgcatgcgtaaatagatttttgcatgcagttccttaagtgggccgcatgcgaaaatagtcattaaaaaattaatttaaaaatataagaacttcgaatcaaattatatgatattaaatgaactcatatgaaaaggttgttaaaaacaaagttgtagaagtcgttgagatctaccaattttcttttggttatttctccatccgagtttgattgaactatataaaatttaaattttaaattcaaataatttttcggatagtaaatgatttcaaatggaaaagttatcaacaaccaagttatataacttatcaagatctacaacttttgtattggtcatttttctatatgacttt

SEQ ID NO: 79659 - DNA, 570 bp, Oryza sativa
ttgtttttttctctgcatcgtcgtcgtacctagcactggcacgggacgaagctagtttaagctagctcgcggccgggctcgtcgtcgtcgtcgccggccatgaaaggcggcggaggcggattgtggcggccgcgggtggagtcacgggggacgttcaggcggcggctgctgaccgtcaccgccggctgcttcctcttcttcatcgtcttcctcctctcctcccgccacgacgccattgttctcctcgacacccgtcgtcagtgccactgcctgcaactactttgcacttgcactagttgagttctcttctccctcccgcacggcaccatgatctcacagtgttccggccatgacgtcatgcagtgggagtgggacgtcccacggcggcgtcgttgcgctcgccggcggcggccgacaccctgccggacgccggctcagctggtcgccggaatcatgaggctccctcctcgccggccttttcttcaggggttagagaaacggtgaccggggtggagactaacgacgactgcgccgagagaggggcggagcccgcggagcgcgacaacgccg

SEQ ID NO: 79660 - DNA, 21556 bp, Oryza sativa
tccacaccgccccgccgtcatcgccgtcgtcatcgcctcggcctcgccactccgcgcgcaagccgccaagggacggaggcagagcccctcctccctctgccgcgtcgcccccgctcccctcctccttttctcaaagaagcaaggggcgagccccctttctctccctcctttttccccttttcctcccgctggcgttatcctccctccgccctgtcgccgattggacgcgagcgccgagcgccagctcgcgccttgaccgcccaagtcggttccaaaccgacattgccgcccttaaagcccaggcgccctccctctcttctcctcccatcgccattgttgccaccgccttccgagctctgtctcgcctccgccgttcatcgccaagcgccgggagagccggtgcgttcgaggacgcggaaggggactccgggcgctcgtcttcctcctcttccccggcccgaggccggagagattactcccgcgccgtcggcctctcgtcacagcgcccctcctcatctcggtagtgcctccctccgttcttcctcctcgctccatctcccccccttagttttcggtggtagcacgagtagcctccccgtagctagccggcgccgccccgaccattgctgtcgctcgccgtgtgctcgccgccgtcgccgcccgagctccgtagcacccgctcgtcgccagcctcgctcggcgtagctctgcccaatccgacgctagcaacggattcccgtagccgcgtagatgctctcaccgccgggaattggcccctcgtgacctcgtcgccgtttcccccttttctctccgccggttaccgccgccgaaatccgccgccgatgggctccctccggcgaatccaagccgttggctcgctccctctcattctccctcgtcatcccggtgtacgccccgtcgcccctcatcgtcgcaaggcgtcccggagaaaccgccgccgcccgccgtccattcgtggccgacgccttcgtcttcctccggccagcccgcgtggcagccacgtaggcgccacgtaggtgccacgtcggcgccagctcggtcgagatcgggtcgggccgaccccggtcagcccctcccgtgcgcgcgttccaccgcgagccgtgaggctgcgcgtgggcccgccgcatcctttccactgcgaaccgcgcgcgtgcaccgcgtccctcccccacctacgcgcgtgcgccgtgtgctcgctccgcacggtgaaccgtgtcaccgacaagcgggtcccacccgggaccgcgcgcggtgagcccggtccactggctctctctctcctccctcccgcgcgcgcgcccgacttgggctggccggcccatttagctcggccggaccgctccaattctcttgggccgcgccctagccgcccgagaaaagtctattttccctccctcttttcttttcttttcttttctttttcaaaaaggatttaattaaatcctttttcctttagaccaaaaatccaataatcttagaaattcaatatcttcccaacctaaatccgtttgactccgttcaacttccaaaactcctcaaatctcgagatctatctaatggcacgcttaggggtcattaatagggctttattttcgccgtttgttgagttgtcccgtttcgcgtgtagcttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatccttcatttgataattgttatatcatgtccccttgtaaccatctagttgcgtctcgatattcgtgcaccctgtgcgagtatcgacggacgccttcaaacttaaaatctgaaaaacttcttgggtaaaacatgggttttacaaaagtcttggaaaacccgacacctgggtcggtgcttgtgaactaaatgaatttccaaaaccgtggaccggggaacgtaccgggtgtacggtttcccgctctcgcacttaaggaccgtttccttggaatttcatccgaacataagacaagtacgaccacatgggtggaatgggacacccctggctgagtaactagcttatcagggaagccttgatgccgagagacatgtggattcgccggggtggtgtcggggaggacccttgggcttcctggcacagtatggtctgggacctaacctgttgttggtctgggacccctctcgttggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttattaaactgttcgaacagccgtgcccacagtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgagagttgttggccgggtgccaatcttgatcaattctaaagactgatacattgcacaaactccgactggacgagacgcactgtctcatccgtgtcgtttgagaagcactcacttagttgttttcagaaaggagttcaaataaaatcaattgtaaaaacaacagcctttctttgaagcctgcattaaacacttatttcccatggcttgctgagtactcccgtactcacccttgctctatataaataatcccccccagttgctgaagaagttgaagcggaacctgctgatgaggagttcttccaggagcaagccggctacgatgagttttagggtttcggcctagttcccaagtcgcgcctgtattggttggtccaagtcctggcttccgtttcccttttgtaatgcagttgtgagctcgggatctgtccgcagtccaacatgactgtacctctactctataataaagagacctctgttgctgtgatattccgtctccctgtgataccagcactgtttccagggactggtatcgattaacaggttaatttagagcgtcacgggctagttccggtcgggactagttcggggcgtgacagtaggtccgccaatctgccttgcagacgggacaaagagattaagtgcgatcctatcaatgcataatatttttcaagcaacataattaaattcaaatataggctcaaggtgttcaaaggtggcttgccttgcttgagatcttgagcttgatcctcgaaatcctcgcactgcgggtcttcgggctccgaaactacacgcaaaacgggacaactcaacaaacggagaaaataaagccctattaatgacctctaagcgtgccattagatagatctcgagatttgaggaattttggaagttgatcggagtcaaacggatttacggttgggaagatattgaatttctaagattattggatttttggtctaaaggaaaaaggatttatttaaatcctttttgaaaaagaaaagaaaagaaagaaggagggggaaaattagacttccctcgggcggcgagggcgcggcccgagagaaaagaggcggctcggccgagctaaatgggccggccggcccaaaaggcggcccaaagcgcgcgcgcgggcggggaggggagagagagccggtgggccgggtccatcccgcgtggtcccgggtgggacccgcttgtcggcgactcggctcaccgtgcggagcgagcacgcggcgcgcgctagggttcggggagggagacgcggtgcacgcgcgcggttcgcggaggatgcggtgcggcgggcccccgcgcagcctcacggctcaccgcggaccatgcgcacggggggggggggggggggaaacggagggagcggctggccgggtcagccgatctggtcgcggccgaggtggcgcctacgtggcagccacgtgggccggcgggaggtagacgacgacgccggccagaacggacggcggacgacagcggcgagcggcggagcgaaccacggcgatacaggcgaaagcgagcacaccgggtggttgcgcgagacgaggggagacgagccaacggctcggattcgccggagggagtgcgtcggcggcggattgcggcggcggcaaccggcggggagggaagaggggaacggcgacgaggtcacgaggggccgattcccggcggcgagagcatccacgcggctacgggaatccgtcccttgtgccggattaggaggaaacgcatcgagggaggccggcgacgagaggcgcttccgagctcgggcggcgacggcggcgagcacacggcgagcgacggcagcagtcggggcggcgccggctagctacggggaggctactcgtgctactacccgagtctaaggggaggagatggaacgaggagggagaacggggagatgcgctaccgtgcgggacggggcgtagtgacgatgggccgacggcacgggagtgatctctccggcctcgggccggggaagaggaagaagagggcgcgcccggagtccccttccgcgcccttgctcgtgcgggctcctccgacacgcgcgacggcgaaaggcggcagcgaacagagcacgggaggcggcgacaatggagtggaggcgagagacgaaaacgagggagattggaggagggaggagcttgggtttataggggcggcaatgtcggtttgggagaggggaaccgacattggacggtcaagcctgcgagctggcgcccggctagcggccaatcacgacgacaggaggtgacgccggcgagagggaaaaagggagaaaaggaagggagaaagggagcttgtcccttgccactttgggaaaaggaggagggagcgggggcgacgtggcagagggaggaggggctctgcctccgtcccttggaagctagcgtgcagagtggcggggtcgggttgatgacgacggcgatgacggcggggtggtttggagcggggcgacgacacgggcggtaggcgcggcagaggctgacggcggcggcgaccaggcggtcggccaccacggcgcgcgcgcgcgggaagcaacgggcggcgcggcgatttgagcggcacggcttgggcacgcgtgctggctcgcggggccgagcagctgcgcggcagggcagcggggccgggcggcgcagacggcgcaggcgcggcacgggcgatgtccacgcgggcgcgcgcacgcgaacaacggcgcgcgggaagcggcagcgagggagcggagagggagggctcggctcggcgcggctcacgcgcacgcgcgcgcggcacgcggacagagcggagaagagggagagagagagaacagagagagagacagagccgcctccctcggggtagatgggccgagagaaattcggcccatcgaacccgagggaggtaaaatagacttttgcggaggaattgatttgggaaggatttggattcgggattgaactcggcgatagatcggggatttgagatctgagatggcacggacactagacaacaagcaaagaaacaaatttcacaattaggatttttaagagataattttcccgctaggcgccacgacggaacgggcgctacaatttagcatgagcactagcttcactagatatccactatgtccaattaatgctcactgctattgaatccacctttccgaggcccaaccaccaacggagccgatgactctgagcacctctaccaaccattttgttgcctccaagcagtagcggacgcatatatcagttcaaaaccacagtgggtcgaatgatgctaaacaatcaatgagtgtaagactctgtttagatgggctaaaactttaagagcaatagaacaaaacacatatcatatttatatttcaatcgcatactgtctcaatcattgtttgcgacatgcatacgttgtgaagagacggactaatatgttatacgttcacaccttgttatacctaattttgatggtccatgactactgtaagggggtagggggtctcgagggtgtggcgacacaggtcgtagctgtgttggtcgacccaccctgactaatgggtagattggtccctgcctctaagatcctcctccctacatgtgctgcatgtgaggctccaaatatggaccactggctcctgtacaacacacaacatcgctccgccttcatcacaaggacaaaggcgttgaattccagctatccctcaagctatacaaatggaaataatcctactagggcatggtttagttcccaacttgttctttaaacttacaactttttcatcacatcaaaacttttctacacacacaaacttccaacttttccgtcacatcgttccaatttcaatcaaacttctaattttggcgtgaattaaacacaccctaggaagagatccaaccatgggagggacccaactaaactaaaactagcctattagataagtttttttttgaggtggggggatttgatagtgaggtcaataaaagtatatacatgtttggtggaacgatttcatttataattttgtactgggacggatttcattccgtacacgatctcaattagtaaaaaaagaatcttcaaaaggcctcatgatataaattagaaattaaattatgatctcgtctataaataaatcactccacaaatatatatacaacgccaacttttagaaaaaaaaactggttggaatatgattacatattttaggccttcttgaaacataattttttatacaatgtttataggaaatagtttagttcccatagtccaaaggacgtctcacatgcaaatgcatcccccccccctttcatgtgctgagcaagctcctcgcacgcattaaacacaataatttattttgtaattctcttataatttttcatggctattttaaaagcatgcagaaatgattaataatggttgaagcagcagagatttaaattgctgaagcttgccagcaaatctcccaagtcatcccaaacttcctggagatccaacgtaagcaacgtgtcagaaaactcaaacatatgcatggtctaaaatattacttcaacatcggtattgttgagaagcatgtgcaaattcagtaaaacacggccaccaacatgatatacttgtcaattcaactaaggtttattttcgccatattctccagtcaaatggtcgaatgcctgctctaagcatgagtgttacactcatgcaactggtcaaagtgttcgcactagcactcaacgtacatatactctgtacgccacctgcacgacacggccaacacagtcatgtgcgcttaggctgaagatttgtacaaatgcatgtatagacgataaatgcagaaatggaattcaatcaaagtgtaattaggatatcagcaacgacatcgcccaagaaatttctctataagtatatatatcaccatatttatgtggttgggttcttcctgggagatggattttcaaaaaaaaaaaaaaatcataactggcatacaagagaaaccagtggacatcctcttgaggaacaaaattacttttccgtgctggttcttaaggggccatcatcgtttccgtttctacccagagaagtacgttcttccggcaacaactataacacattgtcatcaaatttcattcaaaacaattcgtcgatttccttgaattggaagtgagattaatggagatgctagctcgacacgaatcaccttttggtccttattgaagttgaagtgctcgcctccaagagctataggtgcatcacataaagtcatgaactgcgtacatacgcagggagtctgagtggctgaacaagacaacaagcatgagcatttcctgacagaagatcttcgagtggatgataagttttgactgtaaagttcagatggagctagctagctagctactctagctgcttgcactcacaatctcacatggtactggtaggaggaggcaatagcgatatgataatacgaatgcctctttgactaccagttggaccagcaacaggctacgacccttttctttttctcatcaggcaccatggatctccatcggttaaagttacttggagactgagcgatgcaagtctcgcaaaactcaccagagagacaagcaacaatatgcacaagatggattctaatcgatctctcgggtgcatgatgactagtagttgtacgaactggaactgctcaactgcatcgaccacctaaaagcaacacgattgtcgttaaaccaggctgggctattaggctactccaacagagcgcgacagcgcatgacatactgagctgtcaagttttggaacttacggcttcaagagcgacaggtgtttcctgcatcaagctttgatgcttggtagatatagagcaacatgcctgtagacctgcagatgttgcaactcatgtgacatggacaagtagctgggctctaggcagcatctgctctcctgtggattactactaccctacgtaccaccctattaggcgacactggatacattgccatcgatctctatgtatacgttgccgccgaatgcgacgaagctgccaggctacgcgtgcaactctcatcactgtgaagttgcattcattcaggcttgcaggaagctcgtgcagtggcaatatgcaggcataactgtatgtatggcagaaaaaaaagcttttactcagggaaatgagacatgctatgccagcagagactgtctgtgtaactagctacatcctcatggctgacagtgtgaaaacatttcgatgcgttattccggccaggttgtccaactatcaaaacacgcgacaagttgtgcaaatcgtggcgtatatagtacaatactattctctctgtgggacatccacctagccagataagtatcagtatgactgtatgtgcaggttggaggagtggccaatgcaccctcacgcacacgaagggacgttgtacactagctcgtttactgtacgagcaagttctcatgccacgctagacaagcacatgcatgctttcccctcgatcccgaacggcgggatacttgcttgggtctgctgcgagattcgtcaaagtaaacctcggatgcatgcgtgtacgagtacgatggaatctgattttgtacgtaccaaccgcagaaaacaaatgcaatctgtgggcgcccttgcatgccatggccccacggcctaagcaaaccgctggattttgagcagtagagaaagctgtgtgctcgttgcattcgagtttttcttggtctcccgtcgcaagatggatttagaactttttagacgatcaggcgagccgtgccgcctgaaactacctgggcttgactgtgccgagtgcccagaagatgtgtttcctgccctgtcccgctgcatcagccgtatcgcggtgcaaggtttcgccgggcgcgcgcggcgcggcgtcgactggtcgaggcgcatgcgcaaacccagcaaaatttgggcgggtggtggacacggcatccgcacaccgcgcggtcacacgcgcgacctgcaagtcagttggcccatgacaccctgtgcttccgcgacgcgctcgatcgggaggtcgggagcaggatggtgtgtcgcgcgagaaggtttgcttccacaattgagcccacgaggcacgcgggtagagttcttttcgtggggcgccgttcgcgtgtgacacgcacgcacggagtcccacagggagaggggtacaaactggaccgaaactcgcaaggggatgaacaaaaaaaaacagggcctagtaggcctggagcaaagaagaaaaaggttcaatgagcctggagctgttgtatgtcaactgcgaaaaagaaaaagggcctagtgcagttttattgtccaatgcacaaaaagaagtggatgttgctgcccaggatcgaactggagaccttcagtgtgtaagactgacgtgataaccactacaccacagcaaccgacttgtttgcaagtatcacaaacgactacaagtaattgaaggctactgtaacgtttcatctctcagatttcgcattattgaaggttactgtaggtgctttatgtttttataagaaagaatagtgtcctaggacgctttatctaagacgaagaaaagcatgcgaagcttaaatagaacaatattttgaatccaaacttgaaaatataaatagaaagagaaggaccatgatgaatatatgaaatattccctccgtttttttaatagatgacgccgttgactttttcgcacatgtttaaccattcgtcttattcaaaaaatttatgcaaatgtataagatataaatcacacttaaagtactatgagtgataaaacaactcataacacaataaattataattacataaattttttgaataaaacgaatgtttaaacatgtgcgaaaaagtcaacagcgtcatctattaaaaaacggaggtagtacattaataaccaagggctgcatagttgcatagggtccgaatgctagataaaggaggtgctctagcttcagatgccttagattttccaccctttgttccaataatactttttgacacagtctgaaactgaagacacacgagctgtttatttcatagttacaatatagatatcatacgcaacaagttattgggttcacaatttctttattattacaacagtggaatatccaataggtatattaagtctgaggaactagttggatgtgatagccttgagggaacatgatctctgatatgcgcagtacttcccctccttcaatctccgtccaactaaacggagagttcacccggcaaaagaaaagaaacagagttcaacatgtatgtcagtgagtttttctaagactatatcagtgagcatagcaggcaacaaacgaacatcaacatgcgtatgtacctatactcggtcaccaagatgtggaggaagagtgcaatgaaaagcttgctaaactctgccccgagacacagcctgacgcctcctccaaatggcatgtaatttttcagcatcgagcttctcttctcctcctgtatttgccatttgcttcagtgagtcagatagaaacattgtggtaaaacacaacacaagtgaagaccaatttaacaacaattcatccttgaatactaatagatcaatattgaaatgtgtcttccactaaccctccacctccatggatcaaatttaagtggatcctcgaacaattttgggtttaggtgaactgccatggggcttatcatgactaaccacccggatggaattgtatatcctgtgtaaaaaccaaatattataataaccatttgtatggcctgatgtgattctcatgagtaaatactatgctatatgcacaatatattatcttattgtttgtgttagaagtttacctttcacttgcacatctgttaatgttttcctgaaaactccaggtgtgacgttactaattcgagtaatttcattcataaccttcaggtaaaacaagctcaaatgagttaacaaaagcaattgccgaaatcatcactatggcaccaatgatgcttcaaacataagcggacaacaacgtgaaatcacctgagtactgaatttcaaggacctgtactcctcccatgtgaacccggaattcacaccttctcgcttctttagaattgtcccgtgctcctcctagaatgatgtgttaattttagaattcatccaatatttcattatttgtctcgaacataaactacccgcattaaaaaaaatacagaccttgagctcttcaacaacttttggattgtcggttaggtacttaaaagctacagtcaaggttgatgacagtgttgcaaagctcgtaaacaagagcgcagcaagtgcgtctatagcaaagttttcatcgatcattggcttttcgctctgtagctcttcaacaatgaggtctacaaggtcaccatacttctttccaggtgcacttagcctctctttcattatatcagtaagtgtgttccgcacatttctcctacccttcattagggaacaaaaaaatcaggacaactgaaacaagtaatctagaagaccagtgtcctagttaatattcaggacatgtatttctaatgaagtagatgagtataccctgattaagctatttggacaagtaggaaagaaacccgcgcagatacacaggaaacttatttattattcataaaaagaatgttaaagaagtcatatctcaccgtatttactataagaactttaaattatcttataacaataaaagaaaaaatatctctaccataaaatagaccataaacattgatatcttaaatgataataacatttcttatattcaaacattttgtcctggttatatgtaaactcacatattaccactacttattacttgttttcaaagcaggatgcatttttaatagatgaaactatatatgtaaaaaaaaaacacctagtacatcattaatatagaaaaaaatatctctcacctatgtctaaatctttgtgcaaatatttaaaaatacaacaactaccaattaatgggataaacccattaaaatgtgtataaataccgctctaacggatgaaaccgagggctttttttctctgatgccttgaaacatgagtctcgcatcaatggagttgtacccctcgagattagcgtggattataattttaacgcctaactcaccattggcacactgataaaagattgcattgttaagtaccctggttacatcttattggggccactcaacttaagcatatgcatgcccttactatacttacgtcggcgtagaaaatttcaatgcaatcccccctggcccccggcccccggcccccgcccacacacacacacataatgcatttgtcatccacctagtaaactctaatacattgattgttttaaaaatagaaaatgaagaaaaatgaaaaatgccttatatttgaaaagtgagggactacataaattcaaattgtgaatagctggttcttggatggttttgttggtattgattctgtaactataattttgtagatgagtttgctacctgggtctaaattcagtgcccgtttgattacacgcgtgttgtgtttcatccaaatcttcttgtgacttgtgagatgggtcgctgtaatggatcgactgcatgtgctgtcacgcttgatgtggagaatgctgaacatgatttataattttgcagggtaggctaagatacattttttttgccgggtattccttttttttctggcgttttctctctcccacatacacgagatctagagggatatgaggaattagttccatagatctaatctaatgcatggttgaataagatggatccaccaatttaagtgtaaatcaatggtttagatattttttagaacttttctaatttattagacacgcgtgacgtcttagtagcgtttgtaggagtttcacatgatggcatgagagcatttatagtaaatttaatggacttttagtatataatagaggatacaaatacctgcatggatcggtagaatgatgtccctggaaaatatattgggaaggaaaccatcccctgaaagaagtcctgaaagttctttctcaattctcttgagttggtgacatcgagtccgatcaacttcttggcaactaggtcaaagatcatctgcaaaatacaattcatagtaaaacaataggaccattttgtgagacagttaaccggagataatctaattacagtgcgcactttgcgttcttaattatctaccatttattcatattagacatctatagatccaacaacattagaaatgccttaaccgaaacatatatccatgtagcgtcgcatagttttgcataaatgcagttgttaacttacgtctgacacgccgtcctgtacctcgacgctgggtttcccagtccatgatgcgaagctctccctcatagagttttctagctcaggaaggagtgattctttcaggttttcaaggccaaagagcttggccgcgacaccccggataaacttgtgaatggttccgttgtatgtggtgaggctcttcttgccaaagatattaattgcagtttctggataccaactttggaacaatttaccctcttgttgaaatatgaatcggttcacctctgggtcaagggaaatgatcactggccgtccaactaagctagtcttgaatagaggcccatacctgatgatcaagcgcaaaaccagcatggcatagaacttagatttgttcatatttatagaaagtgtgttgttcgtatcaacaacgtgcatatgtttgttgcatatttaagtagaacactggtactaaaaagttatcactaacctctccagtctttgcttgtagtagcttggcatgtctattgatgggcttgctctgaagaactggaaggtctcaccaataatagggaagcccatggagccaggaggaagcctcccaatgcatggaggattcatccatttgtatacccagtgagctaaccatcctatgatgagtgtgacaccacatagagctgcatatgaatacgatcctagcaagagctcagacttttccatgtcctagctaactagtgagcaagtatggaacaaggcttctagcttgcactgctgcccacgcagaggggaggtatctagatctttatatagcaattgtcacgtgtactattagttgactagtagaattttacttcatgcaagttgcaggtatctatgaagaaaatatattccttcccatggattgattgctctcctttagtgattggataattgagattgctctatacataatatgtcattgatcgagtttgtcaatgatttctactccatgccgttagacagaatactttttcacgagagcctcattacggtgccctctactagtaataaaaaacaatatgaaccgttgtagcgcccgttccgtcgtggcgcctagcgggaaaactatctcttaaaaactctatttgcgaaatctgtttctttgcttgttttctagtgtccgtgccatctcagatctcaaatccccgatctatcgccgagttcaatcccgaatccaaatccttcccaaatcaattcctccgcaaaagtctattttgcctccccgggttcgatgggccgaatctctctcggcccatctccccctccctccccggcgctctctctctctctctctctccctccctcctccgctctgcccgcgcgccgcgcgcgcgtgtgcgagagccgcgccgagcgccactccctcgctctgcccgcgcgtacgcgagagccgcgtggtcgccgcccgtgccgcgcctgcgccgtctgcgccgcccggccccgctgccctgccacgcagccgctcggccccgcgagccagcgcgcgtgcccgagccgcgccgcccgttgtttcccgcgcgcgcgtgccgtggtggccgaccgcctggtcgccgccaccgtcagcctctgccgcgcctgccgcccgtgtcgtcgccccgctccaaaccgccccgccgtcatcgccgtcgtcatcgcccggcccccgccactccgcgcgcaagctgccaagggacggaggcagagctccttctccctctgccgcgtcgcccccgctccctcctccttttcccgaagaggcaagggggcaagcccccttttctctccctcttttcccctttttcctcctgccggcgtcatcctcctccctcctccctgtcgccgctttggccacgaccgccgagcgctagccctctcctttgaccgccctaagtcggttcccaaaccgacattgccatcctataaacccaagcttccccctttcctttcctctcccattcgcctccacgccattgccgccgcctcccgtgctctgttcgccgtcgccgttgtcgttgcgcttgtcggaggagccggcacgagcaaggacgcggaaggggactccgagcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagccgttggctcgtctccccttgtcctgtgcaaccacccggtgtgctcgctttcgcctgtatcgccgtggttcgctccaccgctcgccgctgtcgtccgccgtccgttccggccggcgtcgtcgtctacctcccgccggcccgcgtggcagccacgtaggcgccacgtcggcgtcagctcggccaaaaccgggtcgagtcgaccccggttagccgctccctccccgtgcgcgcggtccaccgcgagccatgaggctgcgcgtgggcccgccgcatccgcgtcctccgcgaaccgcgcgcatgcaccgcgtctctcccccatcctagcaccgcgccgcgtgctccctccgcacggtgagccgagccgctgacaagcgggtcccactcgggaccatgcgaggtgagcccggtccaccggctctctctctcctcccctcccgcgcgcgcgtgccttgggccgccttgggccggccggcccatttagctcggccgagccgccccttttctctcgggccgcgccctagccgcccgagggaagtctaattcccctccctcttttcttttcttttcttttctttttcaaaaaggatttaattaaatccttttcctgtagaccaaaaatccaataatcttagaaattcaatatcttcccaaccgtaaatccgtttgactccgttcaacttccaaaattcctcaaatctcgagatctatctaatggcacgcttagaggtcattaatagggctttatttttgccgtttgttgagttgtcccgttttgcgcgtagtttcggagcccgaagacccgcagtgcgaggatttcgaggatcaagctccagatctcgagcaaggcaagccacctttgaacatcttgagtctatatttgattttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactatgcagagtatcgacggtcgccttcaaacttaaaatctgaaaaacttcttgggtaaaacttgggttttacaaaagacttggaaaacccgacacctgggtcggtacttgcgaactaaatgaattttccaaaaccgcggaccgggaaacgtaccgggtgtacggtttcccgctcttgcacttaaggaccgtttccttggaatttcatccaaacataagaccagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgtcggtctgggacccctctcgtcggcatatggtaaacctgtgtcggctttcgaaatgccttgtcatgaaagcttggaggtctcccgacgtggctgatccccacgggttgggtgatccgggttagtaatgtcgtgtgggtaaagtgtaccccctctgcagaggttaacaaactgttcgaacagccgtgcccacggtcatgggtggatgtgaggagattcctagcgtagttttgtttgcctactgtttgtgaaattgctgttgtggaaaggggatcgatgtttggaaaatctgcagctgatgggatcagctaggcccgggtggccgtttgaaagttgtaggcccgggtggccgtttgaaagttgttggtccgggtggccgtttgaaagctgttggccgggtgccaatcttgatcaattttaaagactgatacattgcacatactccgaccggacgagacgcactgtctcaaccgtgtcgtttgagaagcactcacttagttgttttcagaaaagagttcaaataaaatcaattgcaaaaacaacagcctttccttgaagcctgcattaaacacttatttcccatggcttgctaagtactcctatactcacccttgctctatataaataatcccccccagttgctgaagaagatgtagcggatcccgctgacgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtctgcagcccgacttgattgtactcctactctataataaagagacctctgttgctgtgatattctgtcttcctgtgataccagcactgtttcctggtactggtatcgattaacaggttaatttggagcgtcacgggctagttccggtcggtactagttcggggcgtgacaaccgttgatctcatttgatcgaagggttcagatctatttatactactaccccagttaacggtagtacaaacgtggagggacattattgtcaaaaataataggtgggtataatcgccatttaacagtgagtatacttttttcctcctttttagctttttcgatgaaatatgagtgatgttggcgcaataaatggtcatagatggaattaaccgggaaaaaacataaatgacaaagtaacctctagtcatcgtgttagtaaattgctaatctatcctaataatactagtagtataacaggtagagagcatctgagcatcgctatttccaaaaacgtgcaaaatatatttatagacataaaggggtggtgatgactcctttttgaagagaaggggttaggggtggcaactaattggcccaacccttacaatatacgagtaggagtcggtaaaagaattctggctaaggataacctggttcattaggggttggaaaagctgaaatgcattctacttttggtatgaaatccattacctggtagagtcgatgtttttttttctactaaggaatttattgatggttaggatgacagcaattctgcgggtgttttgcaaaatttcaaccattattatttgatgcaacctatataagatggctgtatttattcttccccaattaacttgattttttttctaggggttgttttaattagtgtaggcttcgcaaataaatatgtaggtaggtagataagattgggaatacaccgattgctacaaacgaggccatgtttaggtcaggagtgaaaagtttttgcatgtcacatcagatatacagacatatatttgaagtattaaacgtagtctaataacaaaataaattacagatttcgcctgtaaactgcgagacgaatttattaagcttaattaatccgtcattagcaaatatttactgtagcaccacattgtcaaatcatgacgcaattaggctttaaaaatttgtctcataatttacacgcaatctgtgtaattagtttttttctatatttaatactccatgcatttgtccaaacattcaatgtgacgggatgaaaagtttttgtttgggaactaaacagagcctaaatcagcatgaagaatacaagtatcgaaaaggaatgcatagtcaactatgaattcgagtttcatgcagtgtgactttttagaatttagaatgtctcattttccttaattaccagctcgattttgatattttcttttcatgagaaatcacgatatttatgcttttccttaccaattataatatgtgtatagattgacctttgattcagttcgagctaaaattattattgtttaatcttttttggggagagggggactattttcatagcttcttttccaagggtacaagcgcacaataacttgcacaaaagctatcacattaaagaaaaattccttgacgtcgtctagacagccctggctgaatcctcccagacttttctcccagacttttggtgcaagcgcgctctctagacgcatgtcctcttgtgttagcgtcctagcttacgcaagttggccatgtcggagggtctagaggggagagcggttccatccttctctctcacctctctctctctcaatcccaaagatgttgctagagttagggtttggtttcagttgttagggataggttcgggcgacctcggctgtagttcatttgttggcctagcggcggccggtcacgcttagcgatggctggtttggtgctagccttctcccgggtttgtgtttgatgtcgtcggtgcgtggagaaatctttgtattttttttcctggttacgacctcccagggttgtaatcttatattttttccctgctctatcaatatgaacgttcgcactgtctggtgcgagtcgttcaaaaaaattccttgatgattgttgcaaaggatgctttgcccttgtaaatgatgccttatttgcccgcggtgagtcactgacatgttattaagagtgagggccaaataaggggttgagttaacttttaggggtgaataaagattttattccttcaagtaacatttttctgggtgaaaaccatatctttcttagattggcgatggcggtatccttgatgtcgtgacctccatggtggcatcgttttcggagtctcgtccctgtgatgctgtcgtaggcctagcggcgattagccatacttagcgggggtcatttttggtgctaggctccactctcagttgtttgtgcttgtgtggttagcacgcggtgtttggtcatgcactttggtgcattgtggtgttttttcttgtaacttttctccttcttaatatattcgaatagcctccttcagccttcttggtgaaaaaaaagcaacattttttcagcattttggcattcaatcgttcaaattaactgcaatcaggagcagatctagcgtgggtgctcgagggactcgagtcccctagtccccaacccctacccggctaaatcactattgataaaaggagagatgggaggaggaggaagaacagagaggggaggaagagtaagggacattgaaggaggaagaaaaagataagtctctctccaattttgttctagatctgcccctaactctgattgaattattgacttgagagttcggaaatagacatgcaacggtaccactgttttcgaaggatgcattcacctaacaacccgtttgaattgg

SEQ ID NO: 79661 - DNA, 40153 bp, Oryza sativa
tttccttgtaactcaaaagaacttgaatttttttttaggagcagagtattatgtgatcaaaatgggatcaggaatgcctaatctgaggccatgtatgcacaaacaggtttgcagctgggttggtcagtgttttcaagggagtggacggcaacgctcattgcagctggtgccactacctcacctgcgtgccgacatccagctggaaatgcgacaaatgaacaggagatcagtgacgcattagcatgccatgcctcccacttgtcactgcaggggagagaatgccaccctgctaagagggaacaatcgagatacaatagatattgtttctgtttgagaccacactgtaaaatttttacgctatatagaacttcaatattgtccattcttacctatattcttctgtgaagtgttgatcagaaatctgcttgtatatgctgaaccatgtaaccctctgctctcttacctggtcaagtagccagttcctgtcttaaaaaaaaaggcctgtcccatttgcaagttaagactaaaaaaaaaatcagcatgtcccatcagcaagttaagactcaaagacagatcacttgaagaatgaatcatttcactagctcaatgaattcttgtgataaatatgcgtgaaagatgaaacatatatactccctccgtccctaaaaaaccaaccaacttctggtggacgtagacagccataacttggttttttttaagggatggagggagtacttgacaattaaattgtataaggatttaacgcaatcccttatgcgacttgcaataatagttgatcttgcgggatgataaatggatgcagcaaccagcgatagagcaaactgaacaaccattttcacaatacatacattctataacatcaatcagaagtatgcagggagagccacaaaatgtcaagaattacaccacacttctatgcacctaactcatcgctgaagaacaaaaatagatttcagaaaagaaagaccaccttgattaatctattttcttgctaacctgataggtactgaacacccgtcacccatccccaaaagctcaaaatcaggggactgagattgtaaaggaagtgttcaaaacacgggtagaaattgaattataactaagttaatggtagcttccaaaatgttttagtagccacaagaattttctctgtaccacctgattcaggctcactgtcatgcacctgaacagtccaccgaatcgactgagcaacctgcgctgccttgtcaatcacatctggggagtctcgtacaacagcaattccttctggacgcagaatgcgatccatctccaacatgacatcaaacaggtcacatctaagaaagaaatggaatcaggtagagctctttttacagttaagtcggcatatggtacacgtcccatcaaaacaaagataaaggtcagtaaacgtgttgcatactgtattgtgtgggactggggagcgacaaatttacttttagaaactttcaatcctctaaacgatattaatagttaaaaactcctgcataattcaactactaattcatttacatgataaatcataaaatgtgctaagaacaggcaataagggctgatggagatatatactgcttgggccgaacatcttaaattggtgatgataattttaacatgatgtttcttggttatcattctactctgacttttcagcaatgaattagaccactccaaaagatgtagggagaacagaacaagttaagaatacaagatcatgagacaatgatagctaagtttatgggtggtgtacctgctcttgccagaaattgggtctcttatcaaagagttgattctatcagcatgaatgagatcataggtacgaggataagttgagaaaggctcacacctggaaccaaaggcatatcataataattatattaatcagcatgcaagcattaaactattaatctattccatgaacaaatcctcaatatattgattcgacagacgaatacatgtttcttggggaaaaggtcttgaaaatttatggatagtgcaacaataaatattgcaggaaagtaccataaaagccacagaatgcatgagatctattaagatatacaaatatccaatatatccaatgaatatcaatactactcaaaactcaaacaaacagttcattgtgagtggtagaacaggtctgagcatatgtaaattgcctgatatctttggtatttaacttacaaacaaaaatgaatttgaaagaagttgcaaaataactacaatcaataagctgcaaaggagtatgaacatgctctttttaaaaaaaaaatagatgaacatagtagtttatattgagaaaagttgggattacaataaaacatatcagcagaaagatattgcaaatttctgtaatagtaagtccttaccagtcatgataaactccaataaggcccctgtcatatattactccaagtgtcaatggtttttgagcaggaacaacattcataacccatacaggatcagagacagcagcagctgccaatcctccaaggtatgcattcatgtccatcacattacgaattttggcagtcccaagcttcacgcccagtgatttcttataaaatgatacccttttgacccacttctgagtatctagttcaaacaagtttgctccgttgtccattagagaggctctagcagaaggtttggataacctatctggccacttcagaatggaaccaacagctatttcatctgccaaagaaactttactgacacatttcttcaacttgaaatacctgcatggtaaaccatacaagcaaacatatgaaaaatgtacaagagactttctcgtatgcttttttttttaaaaaaagtacatatatttgtaggcacaacaaatataattggcgcagacaagtattaccatgcttgatctggatcatcatcagtgctacacaagtcaatgttaaatccattttggttaggtagacatgaagcttcagtaggtttcttccaaattgcagtgttaccatctacagtgatcaacttgtaacaaaaagccagtgccatttcttgaagttcagcccattctttctcttgcttcttccactggactgggggtcctgatataatcaagtaacctcctggcctaagtagacggtcgacttcaatcaaatagctcccatctgccagtatatacaggtaagagacagcatttccacgaaccatatcaaacactgaagaaatggtttacttactgtaggccataaaaggtatcaaacaccgggagcaatgaacgaaatcaaaagactgtgcaggaaatggaaggcgcctcgtgcccagcatcaaaagaaatgcaggaattcctctctccagagcaaattgtatttgagatttatgtgaatctcttggggcaaaagagagtgtcaagatattctctttaagcaaaaacccaccaaaactagccaccttcagagaggaaagatcttaataccataccatttctttaaaagtaaaacataaattgattcatgtgaagatttagcttattaccccacatcccatatcaagacccgtcctcaggagaccactttttagcggaacatactgggcaagcttttcaatatattgttcagctccatcgggaaacatagttccgcctccaggaaaaataaagtatgagccttcctgcttcatccacccctgatgaccttttctttctgcaatcttaccataaggcatattatcatgccatatctgcatagagaataattaaatgaaataagtctccaactctccatagaaagttggaacgattagtctacatcctgttgagacatgcaatcagaacaaaattactcttcatttaatttataccatccagtccaattacgcattattagtgggtaaggtcaatctaaattttccaggggctagacatgaaactttgaagcaattgatctgatggaccaaatgccaacattttctgcttgccaaaaattacttctaagcaaacgaaacacaactaaccaacacctgttgtacaaatgtagtgacctatacatcattcagtaaactccacaagttgcaatcgtgtatctgcaaacccatatggaacatgcatataatcagaaagccacgtgcatctaaccattgacagcataagatgcagaagccggtcatacactagcaccaagctgcaattccataaccaacagaagcaaccataagcacacctaaccgcacacggatcagatcaaattaccccctcacgcttctccaaaatacatggaaaccgagtcagtaagcttagaccacagtaggcagtcacttcaggtgctatttttctactatggcttagtggaagcaagcgccaatgcggcaatgcctacagcacacgcaccttgtggaggctctcgggccagggcactgggacgcggtagccccgcggaggcgggacgaggcacacgggcgcctcgccgcgcgcggggcagtggcgctcgcggtagtagttcatctcgcggctgaggcgggagctgcggcggggatcctcgcaggggaggaggtccacctccgaggctgcgcatggtggcaccgtcgcgccggcgagtgcggaggaggatgcggagaggggctcgccgcggcgcggcgtgaagacgagcgcgaggaagatgaccacggcgaggaggaacaccgcccagacggcgtcgaggaacgaccactgccactgcccgccgccgccgccgccgccgccggagagggcgccccggcggtgcgggcgcaaggagctgaggaggcccatggcgaggcgaggaggcgtcggcgtcggcgtcggcggcggcggcggcggcggcggcggcggcggcggcgagggtgctagctagttcgatcggatcgggccattgaggttgttttgattcgatttcgagtgttttttgtgctttgcgtattttctccattcggtgatttcacgggaggttggcccgtgagatctgtaactgcagagatggcattgggcaaactttagcaggttctccttttctttcattagtttatcaaaaccatcatacaaattttagtcatttcggatttttgtactttttcaataaaatctcagggttttgaatcacaaaattcttaaaatacacagaaacaggataaaaaaatagattgtctcaaccgatattacatgatttcaacatagattagcactagagataatgttttggatggttcgatggaatcgaaacatacaattttgtatactatataggagttagaggaagaaaaattaacttgctaaataaaagtaacggttttgctatcctatatttacccccttttttaaaggtgggagggaggggggatcacctatagtgataagattcatgtcaggtttctcctcctatagatgtggtgatcgaaaacggtccaactagtaagggtataaggtttggcattggggtcaatatcggagggggtgagaatagaaaagaggggagatgtttgcgggttgagaaggattgttgtggaaagcagtagcctggtacgcgggatgcgatgcagctgtgacattgctgaagccatagagatcaatagctatgcaacgagttgttgttggcaacaggagtcataggttcctaatgagttaggaagtgcacgtgaaaacaacgagacagggcactcgttactatcctgcttagggtggagaatggttgggggcgagaggcaagcatgtgagccagcgcacgccgttgggaggatgaagagggaggaaaaataatagggttaccgatcacgcacaaaatttatcgtgatttcgaccattcaaaaaataacgagatgatggtggagtttttatcaaatgtggatatgcaatttcaaaaataaaagaagatgtattagtgatgtctaccctttgagtaaaatatacgctaatcatctagtacatgttttaatgtgatcaagcggagtatatatctctactacttaaaaataagaggtgcttccatcgtccgtaaaaaaaaccgagaaaaaaaccgggtcaaaaaagaaaaaaactaaattggtccgatccaaaaaccgggtgaaaaaaccgaaaaagaaaagaaaaaccaaatgtaaaaaaaacggggcaaaaaaagaaaaataaacaaaatctgtccgatcaaaaaaccagaagaaaaaataaaaaagagtccaactcccgtcaaaacaaaataaatagcgaaaatatataaaaaaaaagtcgactccttctcagaaaaaaaagtccgactctagatccgattcccccttaaaaatagaaaacaaaacacaccacttctcttggtctcggtttgagtccagattccagggagactcctgtcagtttcaatctataccgtgatattccatacatcttggcgaaaaaaaattgatgtgccgggttaaagatctgtttgcaaaaacggaacctaccagtcgagagcattccatttttatatgattttaatttttgggtttgtacttctctatttgagtccctgtaatttttatatttacatttgagtccctgtaatttttatatttacatttgagtccctataatcttgcaataagatactataatcttgcaataagatatatgaggtcgttttttagaaaaaataataaaagggagagaacaagggcataaaggtgcataaaaagaaaaaagaaaaacttcaaaaaaagaaaaaaaaaggaaaaaaaaagaaaaacaacaacaataaaattttgtttcccctaagtggcaaaaaaaaccgtagatccgattcctttaaaaacggaaaaataaagtttgattcctgtacaggcgaaaaaaaatctgaaaaaacatctaaaaaagttttgtccgattccctaagaaagtggcgaaaaaattggttcgtacaaaataaaaaatgcatgcgagaaaaaagggaaagggtgaaacaaattccgatttctaatcagtatatatctcttctctatctctaatctaatctaactatttaaaaagagaaaatgcacgagaaaaataaaaacagttcaaaaaaaatgcgtgagaaaaagcacagacgatgctaaaaaggttttccatcttcaataaaaaaacgtgtgagaaatattatttccatcgtcggtaattttttaaaaaaaaacatgcaaggaaaaaactgtaagaaaaaatgcgccatttctaaaaaatgatttgaaaaaaccgcgcaagaaaaaaacaccgtctattaaaaaacaaatcgctttgaaaaaactgtcagaaaaaaagctaaattgatggatgcttgagtcggataagatacatcgattttttgccatctattacacggcttttatttcgtcatatattgtcctgtattggaaaaaaaaagcaaaaaatgaacattaaaaaacaagcaaaaaacgcgtgagaaaaaaaaagcaaaaaagagagaaaaatatgagaatagaaaagcaaaaaagagagaaaaatatggttttcgtcgtcagtaaaaaaaataaaaaaaatatgctaggaagaaactgttagaaagaacattgccatttctgaaaaatggtttgagaaaatcacacaacaaaaaatacaccgtttataaaaaaacaagccgctcattaaaatacaaacattatctttgacatgattatacatgaaaaacgtatattattattagaatttattcacccgttgcaacgcacgggcatttttgctattataataaaagaaacgccaaataatcgttgtggttcgtagtcggtccatatatgctcagtgaggcccatatatcctatttctggcccagcttgactacgtgactgggcattacaactgccacatgggccctcggcccttcgtcccgtcgaattcataacgctaaaggcccattaaccacctgttttctctcgctcctcttccctagaaaaacacatgcgtgcactggtgcacacagggcgacttctgcatgttgtacgcacgttatgttgaccgagtaagacataggtcaaccgtattgactggagtagtataggagtagtagaattattgccacgagtaccccatgtagaacgaatcttgtgtttgactagtgccacatgtatgtctgacatctccatgactccatccacactcgcgttgaccgcctagccgtgttccgtgtgacaacatttagttttgctgggaccagattatggcaataatggagacatggagtacattctgttgtggatgccgcgatgctgaatcacttgtgtcagcccgaaaacttgtttatgacgaacacccctgagataaaaggagtaaaaaggactaccatttggtctggatagtacagtaatgcactattgccgtgtactacaccaactcgttttacatgataaatcggcagaaagctgtccggcattgtcctaccaagtcccaggcaaagtgtggacgagtagaccttcaagcttcagcaccgtattctagtcacggccatcacgtgacattgtgaacgctttgaatagccacccgtaatactactactcaaggtaatacgatcactagtatactgcaaattgtgccaacgacaactgtcgtcgacacatgcatcgaatagtttagaacctgttttgtaccatgaattttacagatctcttctggcgattaaaaaaaaaagggctgttgcttgcgaagtccgcatgcgagacgacaaggaggactcgaacgaggattttgaagtaaaaagggtgtaagttaactgtctcatcttttcgcttatacttatacttatttaataaaatttaaatctttaactttaaatttaatgttaactagcatggtggcaaacacagtttgcgcggctagcatcattatattttctctcatctaataacatatatgttttctcattatattattcaaatatattaaaatgacaacataattttaaattttgcgataactttacaaaactactaatgtgtaatattcatattgtattttatatacgtgttagttattaattttttttaatatcaaattttagttatttgtaaattaaatatattcctatataactatagactcgtcttttaatattttttttaattccaaattttttgtaaattgtatttctatatagactctatgctcttgttccaatattatttatttttatttcttaatttttattatttctaattgtatttctatgtggactctaaactcatctttcaatattctttaatttttaatttcgaatttcagttacttctaaattgtatttctatattgacttaaaactcttcttcctatgattttcttaattttaaattttagttatttgtaaattgtatttttatacggactctaaactatacttttaattttattatgtttattccaaattttagttagttttaaattcctatatggactatatactctactttccttattttttaattccgaatttttatattttttaattgtatttctacacggactctatactctacttctaatattccttatttttaatttcgaatttctattatttcctaattgtatttctatatggactctatactctaattctaatattccttatttttaattccgaatttcagttatttcctaattgtatttctatatggactctatactctacttctaatattccttatttttaatttcgaatttcagttatttcctaattgtatttctatatggactctatactctacttctaatattccttatttttaattccgaatttcagttatttctaaattgtatttctatatggactctagtctcgtcttttaatattccttatttttaattccgaatttcagctatttctaaattgtatttctatatggactctagtctcctcttctaatattccttattttttaattccgaatttcaactatttctaaattgtatttctatatggactctgtattttctttttctttgattaatgtgagaatttctaggccatgagagcgaacgtggaggctcctttttctattcctttaataatataatagctttttagggttttttccatcaaagggcttgttcagattgatgccatttcaaaccatatcatttttggcaaagttatcaaatatgtgtatccatttagtttcttaccaaactcgataaataaatatgaaatcctgctaaaacttggtaatattgtcaaattgtccaaattttagtattaccaatatttagtaaaatttattttggatacaatctgaacataaccaaagtttatttttcagactttgcttttacatggctaagaacatgtatataaaaattttatttttattttccgtttgtaaatatagtttagcttattcccgtgataagccaagcaacggggccgtagatgaacttaccctcgccacatcaaatcaaaccatggaaatattggcatcttgaggctgccggctactgtagatggtcgacaagtcaattccatcacgttaggattccctcgccgtaccacctgggatttatatatatacgtcgtcgtacgtagcacatgtcaataggataagataaaaaggcggttactagcatgtcctacaaactgttgacgtacacgtactggtactacccttcctcctccgtacaaaatccatccatctgccctggtagatggattaggctatgtgggtgggtgccgtcgcttcctactctagtcaggtgttagctagagccagccgatcatgtgccgggtgtacgtgctagaccgcccggccccctcgcggcctacgtgccgtgccgccctgggcggcgccgagcggccacagttctcttccgcgtcgctttccgctggtgcattgcatccacgatcgccactcgcttcgcccgtggacgtacgtacgtccgttgatttggccccggggatgacgcaggctacttgctggacggcgagtccaccaccggtttccgtcgggccggctcgggcggccggactcgtgttgtgagtcaataattgtagtacttgccggctcgcggctctactgaatcgactgtttgacacacagatcagatcaacgagtggcgtagttagaggacgtacgcaaaaggacaagataaaaaggggaataacagagccagccgcagagggcagaaaagaaaacgcgccaaggcacgctaatgcaattggcgcccagcaagtggatgccgtgcccatgggtaaaattggcaaggcggatcgatcccattcatagagagcacagaacaccaccacaaggaaggcccttctcaagacaggcactcaaaactaaaccggaagaaattgcgcccactgccctgcgcagcgcatgcataacgcagtgtgtggcagacacatggaacgagacgcatgacgcagaggcaatggccactttcttggcatctggcatgcgacaaagcaccgcatcgcaggcgcagcatcctttgggttctctcctacgcctccccctcgcacatgctgccctggcgctctccccgcacggagcacagacacacaatgcgcatcgaggccaaaacccggtgtgctgcgtcgaagcaaccgggccgttcggctcccgcgcgctcgcggaaggagcgggacacgcgcgggcgacaacaacggcgagctgggcaaaaggacccgcgtggcgccgtgggcagtgtcgcgtagcccagggcatggacgtgtgtacgcgcgatccaccgatcggtcggggtagattcgatctctcccagatcgccctcgctgcggctgcatgccttcatggcgtcgcatgcatgcatccacaccgaattcctcgaagcgttccgctaatccgggcgggcgcgctagacgggatggcgctgcctgccgtggcccatgtgcacacgggttcgcgatctcggtcgcacgttcagggcgcaaaacggcacgctctggagacccatgctgctcaccgacgtttgcctgctccacagtgctgtagttttgtgatttttcctctagaagcttcacttcatttcctttctcatctactatacatatacattggtggaatgggccctattgggctgaaatacacacgcctacactcaacactccctctcaagatgggcgataaatatctatcatgcccatcttgccacacgaagaagtgcactctctagcacctaatgccttcgttaaactatcagctacttgttcaccagagtttacaaagcctaagtttaaggttccctcatccattctctctttaataaagaagcgatctatttccacatgcttcgttcgatcatgctggactggattgttagcaatatttatggctgatttgttgtcacaccacaacttcatggaagtgcttgtcgacagcttcaattcagccaaaatatttttcaaccataacaattcactcaagctcatcgacattgacttgtattccgcctcagcagtcgagcgagacacaactgattgtttcttgctcctccaagataccaaattgccaccaataaatatacagtagcctgatgttgacctcctatcatcaagacaactgccccaatctgcatcacaatatccctccacatctaggtgtccattcttcttgaaccatatgcctttacctgggcttgccttcaaatatctcaaaattctatacacaacatccatgtgaccacttctaggatcatgcatgtatcggctcaccacactcacagcataagttatatcaggtcttgtgtgacacaaatatatcaaccttcccacaagtctttgatatctctctttattaactggatctccagattcagcacataacttatgattttgttcaattggtgtagaagctggccgacatccaagcatacctgtatcactgagcagatccaatacatactttcgctatgaaagaactattcctctaggagatcttgcaatttcaatacccaaaaaatattttaattggcccagatccttgacctcaaactccttgcttagattttctttcaacctagatatcttcaagcaatcatctccagtgataatcatgtcatcaacatacacaacaagaatagttttaagacctctattatggcgatagaaaactgtgtggtctccattgcactgtttataacccataccacacattgcacgtctaaaacgatcaaaccatgctcttggtgattgtttaaggccatataaagattttttcagtctcaacactttaccttcagtttgtgaggtagcaaatccaggtggaatttccatatacacctcctcttgaagatctccatgtaagaatgcattcttgacatctaactgatgcaatggccaatcaaaattagctgcacaagagataagagttcttaccgtgcttatctttgctactggtgcaaaagtttcatcataatcaattccatatgtttgactatatcccttagccacaagccttgccttgtatctttccacatttccatcaggattttgctttactgtataaacccatttacagttaaccactttcttccctttagggaatggtacaaggtcccatgttttgttcttttcaagagcctctagctcctctagcatagcttgatgccaccttgggtcttgctttgcttccctccaatcatttggaatttccactgaatttagtgatgtcacaaaggccttatatgtggatgacaaagaagcataagagacataattggctatgttattcttatcatcattcacaccttgagcttcaaaaccatacctttgtggaggtttacctgcattgcttcttaccccctttcttatagcaataggaagattagtttcttctccccctgtttcaaactcctctccttccgtatccgatgaaatctgtatagtatcacactgatcagatggtttatcccatccataggagactcatgttgccccattgtttgcgcctccaaagaccttgttttcctcctagtataaacttgtagattttcttcttcacgtggccttctccaattttgctcatgaatgggttcactaacaggatatgggattgagccaaccacaaatttcatgcttcttgattgtgtgtcttcttcagtacctgatgagccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcattcttcccaaacaccatttcatatggagtcttcatcccaagtattcgtgatggcatgcgattgatgagatatgttgctgttatgactgcctcactccatagaaactttggtacattcatcgtatacatgagtgaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatccagataccacaacccattatgcctaacgccggttccaagctttcttccaattcttctctcctcaattagacaattctctcagtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttaaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaatggacaacaatagccaatagcaccaaatccttctctgttgatcctacagccaacagctgcgcgtctctcagccgctgtgctccctacagcttgtgctacaccaaatccttgcgcagctcaaccagcgagtgtgcgccctgctcctccttcacgctgctcgcgtcgagaacctctgcagcagccgtcgccgcctccgccgtcgacactgccgctccgcctccgctgtccgacgtcgccgctccgcctcagccgtcgacgtcgccgcagaacccctctggtcacagcgccgccgccgactagggttcacgtcggcgaggtcaccggtgacccaactctgataccatgtagatttgtgatttttcctctagaagcttcacttcatttcctttctcatctactatacatatacattggtggaatgggccctattaggctgaaatacacacgcctacattcaacaagtgcccgccgcaacacagcgagtcggcgatacccatacaaaaacgtggcggtgtaaacaatatgcgacactgttccctcctcgtgcgctctgatgctgccactggaattcgctagtgtcattaggcatttaggcttaccatgtgagcgaacgaactgtaataaactttgaccgaattcataaacaggaattgtgggggtactgctgctacttcaaaataagtattcccaacaaccagattaggaatggactagtagtggatgacaccaacgcaataatcaacgaatgtgatcactgatcacaccatcattacgagccagtagggtatcatatatcaagattccagtgtcaaataaacaacaggtccagagaaaggtgacaatagacgaaaaggggcgtcacgaatcactgaacagtctttgccttcattgcaaggcgccaaggcctcgaacgtcaaaggaaggagaccgatggttggagccttggagctttcattatgcttctcctccatcatagcactacaacgagtcaagtaaacatacagcatttcctatatatcatccatgcatgccagattatgcgtggtccccgtcgtctgccgttgctcataagcatcagtcttcgtactaaactactactcgtgcgttgtgtctcatttctatccaccgtgcatggatgcttggaattatttgtacaaaccaccaaatccagagtaattaggaggtacggaaatttatttctggcgcagggcaagcacatccagccccagagacagcttcgaggatggtaccatgtaccattaactatgctagtgtatacaagcatagctaagattactgtagaagatggcaacgaaaatgttggagttgtgaccaccctcaacaactctcgcaggccggacgagcaaggccacaggcagagtttgcaacaggagcatctctataatgctttggtttttgtttggtactgcagtacatttgtctctcaggatggtgcagcgcttcgtaacttttttttttcttcagctactgtgatcattgatcaaaatcttcagcttgttacgtgacattaatctcgccggctggatggatcaatatgctaccagtacggggtgcacattgaccccatctggagatcagataaccggacattttcttcccaccaatcgctatctccctttccacaagaacatggttctgacccagacatcaaccgctaatctttattacagatcgtactactaaccgatatgctactactctaccagtatgttctaaacctgtctcgtgtgaagcaaatgctataggagactaaaattaaggatagacgaacctggtcagggaccaatcctttgacacgggattagcattagcggtaggccctgatcgagctagattctctgccagtttggcctccatttgtgcttctatgaactatgatcagccgagccgaaagccggaataggagtatatgtgggcgcaaggaaggaggaggaatgcaaaattaattgcgtgttggtgccttgccgtcctccgggggccatgcatccatccgttcccgacggaatggcgactatttttggcattgaaaggagcaaatacagcgacgaaacgtcgcctcaccggcgcggcatgcacgcccaccgacacaactgcaccacccatctcggaacgccaagcacaaaacccccctccctgctcgcctcccaaaacgctcgcaaaggcttcgaaaccatactctactcggctaattccaggtggtgacagtttggaattttggcggtgtcatttcgtcatcgacacgcagttgatagtacctgtggctgcggttaacgatgacttgaatttgcttaagcaagtttcccttttcacggagcatctcgtaattgtgcaatggaccaatggttaatggttatcgtttactaagagcatccgcaatggttatttataggctctatacaagagatccatgtcagcatatttttctacttgaaagagattaaatgaagagagagagcaaagctatctactaacctgaagatagtctatagagaaaaacgaggcaatggattagagagctatagatatccatgtagacatactattgatgtggattactattaatttagtttattactgagatgtatatgttttatatagagtatcttattttaccattgcaggtgctctaatacaccggtggttagtacgggccaaaggcaactgattgcaccagcctatcacaggcgtgaacagatccaatggctagaggacagctacggccattaaaacaagtctcacagctcaccaggtaggtccgaggcttggacaaacatgccaaatggaccaccaatggacaatgcaggctacctttcgctaatatgcagacgaaatggtgaataggatgatcagcttgtggtactaaccatcatttttcttaccatggcatgtagaagtactagcgatgagcaacgcaccaaattgcccaatcatattgcacccacggccagaggcgacagtagctacagcatacagaacagtgtgcacttgcgcgccgacagttatagtactaattctagctatagtagtaaatcaattcatgggtccagttgtagccagcagatttctagagcaagaaatgggtaattagctgctgatctcctatgccgtaattagtgggctaatatgtatggattcattcacccgcttctgctctcgtgtgttgtttagcttgcaagatgcattatcgctaatcaatacaacgaggtcagattaaaacccgtgcaggagtatcagagcgtacggagtacggagtagatcgacaccctgtcaccataggagtattaccgaagcacaagactggaattgtcaggaaggttaaggacgcatagatacttcaccaaacagctaccagcaacttacacttcataactagttaaaaacaagaaagaaaatctgtgacggtaacagcacccataaaaagctcaagcctaacaacgaccaattgctaaattcactcggtccttgctaaacacagtttgacacacttgtcgctttcattcacttgtcccggttgatcgcgagaatccggcatatgatcagtacttgacgggcatgcctagccgatccaacctgcccgatccagggtaggccttgttggtgaacttgctatgcaaggaggccgttgtcctctgtgccaccggcgcgcacgatccgggtccgaacgcgtgcgccgacgccttccggagggagctggacttctcgtactgcggcctctgcttcggcgcgctctgggagcgtgccttggcgcggaacgactcggtgttcgccatgtagttcgggtagtcggagtagccgccgaacaggctgcgcgagcactcgctcttggtcggcgtgaacgccctgctccgcgagctccccggccgcgacgtcgccgagaagaactgcgggctgtcgcagagctcggcgatgtcgacggccatgagcagcgggctgagcgcctcggccatgcccaccgacggcgggctgggcacggactgctgcgcggtcgtggagtccttggacggagactccggcatggtcgcgtagctccggctcttctgctcggatgtcatggacgagcatgacgagtggtggtgatggctgccgctgcgcctccgtgaggcgtgccgcccaggcttgccggtgtccacctcgagaatcttggcgttcttctcgtcatccaaataccgttcctccacccacttgtcaagccagttcctcccgcaagattctgacctctcccgggtcagtctctcacttcccggcgtcttcgacgagctcccctgcaacacaaatcgccatgccattaatctccaaggctgtcgcaatgtactacacataaaaatctgaacaaacaaacggagcaataccttcagagaaccagaacggccgtgcttaggcacgccctcgtgagtcgcctggtcgtacttctccggcgtcggtggcccctgcaatgcccaaccaccaccaagaaccatcatgagaagacgtcaacgacattaaaattgaaaaatacagaattgtgacataacattttttttaatctgaagtatctacaggtgaaaatacaggaatcatacagaatttttacttacgggatgggccgagacatgctgggagcggatagcgcgacacgcgcgcgcccgcctctggactcggacgagagcgtgcatgcaccggagcgtctccgccgcctgccgccgcacgatgttgccgcggacgagggcctgcagcttcaccaaccctcgcaacgccttcagtgcccgtctcgcctacgtacgcacgcgcgcaacgacaatcagagaggttaatcagcaggggacccccggtaacaacgggagcatgcaccgcaggccggaggttgacatgccaaccaccaccgccattactagagctgcttccaagaacagtaactcggtggtaacaaaatgcaaacggcagtgttcttgatgtgcaaaatggagttaaagcgccggagcccatgccttgcttggataaaagaagtctagggactaaggggcagtaaagacgcaggaatggcagagcagaagcacaaagaggcttctcttggctggagatgacaccacggcgtgttttttcctcacaagagtacatttgctaccggaaatttcttttggcgaagcgaaaaagaaagatgagatttttggaagaaagtgttctcctttttttggctttaaaattaaaagtggagtttccaccaacttaattctaaaacgtgaagttatcagaaaagattaggaactgacgagtcgagatgagaagctttaccaggtagccgcggaacgcggcctggatccgaacagccgcatactcctcccgcttggcggcggccggcgcgcatcgtccgctgctcgtcagccgcaccacggctgcggccgcctgggcagcggcgacggcagcctcggccaccgccgccgtcgccgccgccaccgcaatggcccgcttgctctgctcgtcgtccccctcatccgacgccgtgtacgcccgccgtggcgtcaccgccctctgcaccgccgccgacggcggtggcggcggcggcggatgggccggggacttctcacggaacgacttcccgaacccccagcgcttcttctccctcgccggcttcgggtcgccggagccggagttgggcttcttgccgccgccgagcagcccgcgcagccacctggacgcccaccccatctcctaggccttcagctcggccgttcccatggcttaacctcggctccgcttccagcacttcgccggagcggcaaaatggaagagcgggagatgaaaccgaaacagtgaaacgcgcgcacgcttacaccgagaaaagaagaagcggagcaaggtcggagaggaagagcctagtggaaggttagaggggattgtcttatagaggaagcacaagaggtggggccatttttgcaaatagtttatccgttttaggggccgcttgtgctaatatttttcggcgaagcgatcgtaaaactgtaaaatgtccttgttttgagggaggtatggggaaagtggtaggtgttgatcttctgctccgccggccgcctagccgtttgactatttattgttttgatcagacggccattccgggctccggcaaaataaaacatgcaacttctttataactttgttttactagctttccagctattacttctcttcttacgggtcacaaattattattagagacacatttctcttaagctcataaataatgcttttttcatcctaaaatagaccccctcttttcagatttatagttataggaaatattccatctcattctaggttcttatattttgggacggatggagtaagagattttgaatagatatgacatattctacacattcatatttgtattagttggatacgtcccatccattcaagattctttatattttgagaaaaaaaagaaaatatgttttagaataatctctataaaagttttttaataaataggagtactttttacttgactgagtaaatcaggatgtgtacttcaattgtttacttagctcaactaatatagtatttgatatgtaagtgttttgcgtgttcaaaaccaaaacctattacgactttacgagtttatgtccctctactaattctttttcctgtgctaatggaactatagattcgatgtaaagaaggcgggaaaaaaaggaatatgtttaaatacaaatactaattgcaacggttagttgtattagcgccttgccttaaaattgaaattatgctaacgtcaaaagtggacatcgtctagataccattccataaaacaagtttcactaatttgtcactttcgaatgacggttacacgctagagtgctaactcggatgaaattgtccataggcttctcttgtcgtgacctattcctttccaactcgatatacttgctagtgatgatgacaaaaacaagaggagcctcatcacgctcgccctctatgcctacttgcaacccactgcaatggtcatcttgcttaacctccagtatattgctcttatgccatttccttcttgctctacaaccactgagccactatggtgggtgtgtcaacgtaggatagtcactaatcccctatagcttatctccaccagcaaccttcccatgatgtctgtctccaccgtggaccctagtggctccaaccctcgatatacattggggctcgagaaggttgcaacgatgtttaggttggagaaggccggtggtgcaagagtgaagagatatcgtcgtcatcacctgttggccatggcatgtcaccgccgtagttatttttctcgccacgtcggaggtttaaattaaagcagaggcaatgatatctcgtctattcaaaggacaaatatcgtttcattattgatgcacacatcgcttaagaaatcacattttaattgagttcatttgcgaaacgacatttaaacgaagctcactttcaatgatgtggcgtaattctaaatttctcgtcacaacgacatacacatccgaacaccaccactatacttgctattacaacaaatccagaaatcctttatgaaattcgtccattgtcccggacgagggttttccttggtgctatatttattgctcgctcattgtacggcagagtgaccattgcacaattcagactcttcttctcataagatccctgcaacattactgggaatactagcagtactgttcttccctgggggaagtcagatcgtcggggcagacatttcttcgacgccccgctgacagcagggaccaccgcaacagcagcaacccgccacctccgtgacgacgacgccctactcgtgcctcccagcgcatccgcagacacagccatccatcgtcatcctctccctcggcgccgttggatcgaatgcgacccttccttcccacaatccgcgcgacgcgcgtctcgcaagagaaggcgtccccctgtcccgcggtagtagtactgggcacgctgtccacggagctgtgcggttgtctcatgtgtgcggtgcacctggttgcctacgcacggctggctacccgggcctaccccccacactgtttttttctgtttgcaaagctgacgaaagggggagctcgctggctcgtagtactaccgcgcgggacgtgacggggccaaaagcgcacccaagcctagcaggaaaacctgttgttttgtgctctgtagcctggcctgtcacggaggggggtggcgtgagcacaagaaaggctaatcctacctcgcctcgccagattcacaggacggtcacgtggccggaccggcgggtcgacggattggtgcttgcgcggccttgcgctgcgcgctcggtagagtgtggggccgaagccgaacgggggaatcgccagtaggttgccaggattccaggacgctgttgcagcctttgcagcgacgaggtgcgtccaagatatgggcctattacattgttgggcattagcagcagcccaaatccatcatccatggaagcagcggttctccctgttatatgggcctgaatggtccagtatgatttccgcccgccatgaaaaggaataagttcactttgagtcccttaactagtgaccgaatcaaattcatatacttgaaccacaataccggatatcttgacccctcgactattaaaaccggtgcaatttaactcctatggtggttttgaagggtgatttgctgatgtagcgccaacatggcagcgttgacctagtctttatccaacgtggcgttaacgtggcacttatgtggtattagaatttttttaaaaaatatgtgggacccatttgtcattcacgaaaataattgtgggggcccacatgtcatcctctttctttgcttcctttcttcctcctccccccctctgaataggcacatttgtaatgcacggatcaaattaacccttaattatttgtcacttatagtctatgacacatggattcttatgtgtctataacatatggatccaatgaaaaatcattgattatcacatttaagagtggtaaatttaattatcttttattttacggtgatgtctaaccctgatatgaaacaaggctttaaggtggtgtttggatccatggactaaattttagtccctgtcacatcggatatttggatactgatttagagtattaaacatagactatttgcaaaactaattacataaatgagagctaattcacgagacaaattttttaaagcctaattaatttataattagagaatgtttattgtagcatcacataggttaatcatggattaattaggctcagtagattcatcttgtgaattagtccaggattatgaaatgaattttattattagtctatatttaatacatttaattagtatctaaacatttaatataacaggaattaaaaaattttagtcccatccaaataccccgcaagttctggactaaacttagtcaccggagaccgtctgaccgctgacgtctactttcggtcacagtacactgtaataacaggtcaataatcacagtgacgttgccatgaccggaaagtccaaacttgttttcgtgctaaggtcccgtttagttaaaaaacttttcacaagacatcacataaaatctttagacacatgtatgaagcattaaatataaataaaaaatactaattgcacagtttgcatgcaaatcaagagacaaatcttttgagtctaattagtccataattagccataagtgctacaataatccacatatactaatgacgacttaattaggctcaaaagattcgtcttccagacgagtgatgaaattagttttttcatttgtgtccaaaaatcactttcaacattcgatcaaacattcgatgtggctctcaaaaatttttatttccccaactaagcaggccctaacagagcccaagtcatcaccattcagaaaaaaaaaacacagagaatcgagttgactacaggtcacacgacgcaaatatgcaatcatggtgacagacgatgggggatacgattaaagttggctttgccctttttacgtggaccgtgtcgcggtcacgaaagacggacgccatcattcgggatgatctgcccggacccctggatgacttgagcgatccttgttggtctgcgtagcgccatatccttttttgttgatcctcgtttactcccaaaagctctcacggccggcacaagcgacagcctaatcgaaggcaactcacgtcgcaatgagcgtcttctgtgagcacttcatctggtccttgtgcctttttctttccccgcggtccaggttgccaaaaggcacgctcgcgggcgcggtggcttcacaaaagcaacggggtgacggcgggttgatgagagccggaccggcccgaggagcgcaggcgtaggtgccggtgatgcttacgtccacacagctcagctgtctccctgcctgctggctttgccgctaccggcaaggcggcaacggcaaccgagcccccggccccgcgccggcgccgcccgtatcgcacgggccgcacatccgccgtgacaacgacagcgaccttttctctgtccgctcttcccttgtcgctcggcgtgccccgttccaccacagtgtagtgttgtagctagataaaaaaaaaccgagattagaagggagagaagtctttcgaaacatttctctactgttataaaaaaataaaaatatttttatcggtactttggtacgtcatctatatatatgagacggtttttaagctcattcacttttgaaaatacatattcttatttgagttagtttttaaatttgttggctttgggaaatataaaatgatctctttaaaaacctcgcatgttaacttgagacgatcaaacttctaactgcagctcatgattagattttctaataaaaattatatccaaacgaattacttgagatgatcgaactcctaactgcagcttatgattttctaaaaaaaatatatccaagcgaattcccacagtgaatttcaccttaactaaccgtacaacaataataagattaaaatagccttcacttgttgcaacgtacgggcatttttttctagtttttttttaaaaatatgaacatgttaaagattaaacataagacatctgattaaaaccacacacaacctgtcactgtattatcaggtgcatcgctttagctggactggatattactccggctggcaaagcaaaaggacacaattcagtttgttactctggctgggccgattcagtttgttactctggacgggccgggcctgaccaggccagtgcacagcaggactgcacatctgtctcctgctgaacctctttgttcggcccaagtactaggaaaggcgctcatcaggttcatgattcatctaagtcatctgaacataaaactgcaactgagcattatactaaccaacacaaaactagctgatctcacggcgttgatgctctgcatttgctcaacttctgcatcaaagcaaaactgtattgtgttgagcgcgcgccattcctgcgggcacagaccttctggaaacaaaggtgtcatctaccagctaaaagttcagacttcagagatacctcgagatccacgtcgcggcttaaccaggcatgccattcaaacctttgagctgacctgctggataccataatctctatcccttgattttgttcctgcgggggagatcttgtcgttgggatgtctacagaaagtttatcttcatcgtataataaaacaccccacttgtgtgtatcattctttatcaagtctctgaacattaccagtattaaactcggcttgggctatacgacgtcttgcaaatacagaaagctaaggttagatttgagtcgcaaaggatttcgttcagagcaacttggcctgtggggcttttggttgattacaaccagggacacacaaagatggcgcaattcgagactgttctgccaggggaacagctaggactgccaacttatgcagttccatgagattcctggtgtccgaaacacatcaattttaaatcttcagacaaatgctgggtttgcattattaagcgcgtctgttaacctgccatgagacatatcggcattgtgacagttactcctgctgctgccctgcaagtgagtctgaacaagcttgagaataattgaagccctaagtatggctcacaaacacttctatgtacataacgaatatattcttgcttcattagacatgtataggttgatttatatacggagtacaacacatggatagttgacttgactaaccacatgaaaaacgaactaccaaggtacaaaaaccccttttcacggactagaggtagcactcggtaacatgacattacttctatctgagatgtgtctattctatcactagactaagtatgtgtttccatccttttctgttgtccttaaataacctaaaactagcctaagttatgctcccccacaacaatctctcccatcatacatcggttcattcagactggccacttgttacagcccccaaacgcatcttggatccagtctatcaggtctagtcgaagccacaacttaaggtcgacgggtctacacaacccgagaggttgaccaagtgagtgatgaccactccatcttttaagttgtgctctctatcaccaattatcgacgtaggataaaaacccaacgacatctttgcacacacatttttgtgtttagtggcaaaaaccaaaccgccgaggtaaaaaaacgatcagttcttagggaagagctggatatgaaaaccatctggaaagctgagaccgggggttcggactatgtttcctcctttcactgtcctccaactgccatgagaaaaaaatggttattcagatgatgtccacaggatgagccaacgtgagaatgttatatttaggttgagaaatggtacctgtattttgtaactaaagagtgtatgaatgttgccatcaaaaccttgctgagatcagttccaacgcagaaccgaagcccaccaccgaaggccatgaaatgcttcgttcctccagtgatctctggttttccctgttcagacaagggctagtttagagccatatattatttcaatgcagatattccttactaatgtggaaaatgcatgtgatgctcccattctctccctttcctcgttatgctacccattactcattttccacaacttcaatgcaaacagttgctttttttatagggtaatggaaacacttgtttattgaaactcttggttctcactttgtttatttctttatacccaatcacctaggagagctcactgaacctgaaatcagcttgttactgcatctatagatccatgtcatagacaggcaagacagcttgcctttttacagattgcattgctctttatgcaatttatcatcctttttgttttacaagggactggtgaaatagcacatggttcacctaccggattgagatactgtcggattacaaatttattaccacaagccccaatgatagctaacaattttctgtgcacttaagtagtacttgacagatgagatagcttcatggtacttgttttttcataggttacactgtacttctcttggcatttgaccttgttgttaaactactgagcaggaagtttctctgttggttctggtattaaacccctgaccgatcaagctggtacttgagatcagaaccttgcaaccttatactaatcacagtgctaataattgggaagttgcagttaattaaagtattcttctttcataatttccgttttaatgtcgaggcttgagaggagaatatatgcaagttcggtgagcagatcagataattacagttcctacttcctagatgaggagagagctcttttttttttaataaaaaaggtagacgcctaaaataaactgaaggaccaaagctcaaggctggagctgccgctcaacctggcaagatggaaccctaacctacgtgtaaacttagaatgtacatgcagaaactgctaattactgaaagttcatattaagaagactaacctgccacctccatggattgaaggccaacggatcttcatatatctcagggtttaagtgcactgccggtgggcacaccatgataccccatcctgctggaattgtgtagcctgcacaaagttcagagttcagttttgtgctgcaacttgctgaagtgaacctttctaattaacaagagatgtcatgtgctagatagtattcgagatatgtgtacctttgatctcaacatcctgcaacgccttccgaaaaattcccggcacgatgtttgcgagtcttacaatctccattatgaccttcacataaagaacatggaagcgttagttttggcagttatggattcagaaatcgtacggaaatggcatctactacataacctgcagttgccaaaacaattaactgcggtaaaaattcaggttgccgagttctgattctcttcctcttttgctattttcaattgtaaaaataggagtttttcttaatcagccaagcctgttcaagaaagttcttacagttattattaactaagattatctatcattcttgaagattgggccttggttaaacaacaggggaacacgaactctgcacttgcagagttgcagtcttgttggcaacagctttgggctcccaagattcttgcactagttccagatcaatctcattgttccccaagtaaattcgagcgggggtattacagtacgtagcagtgcagattggtctagcgcacactagtcccgggttaggctcacctgagacgtgaacgtcatcgatttgtactcggcccacgtgacgccggaattggggtccttcctgttcctgatgattgcctcgtgctcctcctgcatgcccacgcgatcgacaaggtttaattctactttgctttaacttgtcgatcgattgatctgatcaatgacgagctagttgaactcatcacactcccgttgagtgaaatatgatcaacagcgagagtagagagtagactaacccttagtgcgtcgacgactttgggattctcggtgaggagcttgacgccgatggtgagcgccagcgcggtggtctcgaagctggcgaagaggaggacgaacatgaggtccagcgcgatggtctccgtcagcagcggcttctccctcctcagctcctggatcacgtggtcgaagaagtcctcgcatggccgctccggttcggccatcctctccttcatcatgcccctcagcaccttcatcgcgttcttcctcccctgtgtacgtatcaattcaaaaaaacaaatttaaaatcggaattcattttttttgagtatatatcagctagctgtgtaacagtgagaagcaggagtttctgaggtttatggagtgcatgtgcgcggctatacggccaagtacaccgatctgtctgtgcgtgtggtccttagtttagtggcgtttcgcatgtgcagacggcctagctagggtgcaatttgaagttgtacaaattatatcgtgttcaagagtatgggggcagttgccgagttgcgggcggctgcgggcgtgtgggcgccgtacctccatgcactcgtgataggccgtgccagggatgttcagtgggaaggatatcaacccgcaaatgaacgcgccgaagttcttcctcaggttcacctgcgacggcttggacgggtcgtagccgatcagcttcttggctgtgagatcaaatatcatctgaaatatatatacagaattaatcctcgtcaattacgcgcaatgcggctagctaggcagctagcacatgctgatgcatgctggttgatttggcgtccggtgtgtgcttacagtggagatgccttccttgagctcgacgctgggctgggaggcccaggaggcgaggctgccgcggcaggcggcgtccgtctcggcgaggagcacggacttgaggttctcctggccgtagagccggagcacgagcgtcttgaggtacttgtacatgaagccgtgcagggagccgacgttgtcgcggccgaagatctcggtgaaggtgtccgggtaccagctctcgaacagcttcccctcctgctggaacacgtagtagttcatctccgggtcggccgacaccaccaccggccgccccaccacgcttgtcttgaagatgctcccgtatctgcgcccaacgccaacgccaatgtcacggaccgaactcgatcgatcaacaacgtcaatacttccgcacgccattgccgcatgcgttcttggttctgaggtggaggtgtgtacctcttgatcctctccttgacgaagggggagaggtcgcaggtcgggttgggcgcgaagaactgcagcgtctcgccgatgacggggaggccgagcgagcccggcggcagcctgccgttcgacctggggtggctccacctgtacgcccagcggaggagcgcgacgacggctgccaatgccgcgcacaggagcgctatataggccatggaagaagccatggccgccccggaggcggcgagaaggttcgcgtcgtataatcttggggcgagagggatggtggtggcgaggcggagagaagctagctgaagatatggctgcatgtgcgtatgggggagagttgtgcgagaggagaggtggtttgctaatgctagctagagttgctagcaaaggccaaaggggaggaggcggaggggttatctgtgggtttgtgggtaaggatggaggggggtcagcttatataaccaccatgctgaaagtcatggccttaaaataaaaggagggagggaaaattgcatacatgcccaagattaaactctaattgcatgcagttaatatatttgctctttttttttggctaatagatttaccaaactttttctttactactggtaggcgtacgattgtaacatatgtgttgatgtatcgaagcacatatataattcaacaatcaaaaggaataggttagctagtcttctggttctaaagtaatgctcgattagcttgaaacggttagacttgaaaatgcaatattttgaacccacaagtaatatatgcgggtgtaactcaatttcaccaacatatatgattgagtttttcctttctagttttgtgcaactagtttttaatttctaaggggtgccaaattatttttttgctctttcaaaactacatatatggttaacatttttttaaacaaaattaacatatttttagattagtcccttgtttactttgcacgcccatgggaacttgatgtgttagaagtagggtgggtattcggtccgactgatcggttcggtctcttgttcatttaaaatttttgtacatctaaaaccgaacactaaattcattgcaaatagttaagaccgagtaattcagtatcattatttcgtttcgatctttggtcatggctaaaataattggtagctttgtacgattaaaaaaaacacaaaacacaattaaattttagcaacatttcctctcttaaaggacatgttttgatagtaaaatatcacaagatatattgtttgctattgcaaacaatatataacacatcaagtcatcaagatatcatcatagtaagtccaatttagcattaatatttacgtcacacatgatacttaaataggctttaatgatataattcgatctattcagtcatttccaccgtactaatttcagtagtaagaattacttatcaaaatattcggtttcagtcttggttagttcgatttcagtcattcttttttttttaaatcgaagccagtatttgctggtgttatattaagtaggatagaagttatttatagagtcacgaaatatgaaagagataaaaccgaaaagaaactgaaaaggaaggaaaataacaagacaagacatcctcgcatgtgttatattgggatattctcgtaatacctttggcgctgcacataatccacaccttgttctcatatgtgattttggtcactagttgagggaattgagcctactgattgtggaacactcgtttatttcgttcgcaccagattccccaagctaccatcatatgaattaattcaattgccttcgttttgtgtttttccccttgggatgtccccttattcaccggtcaaacagtggctcgtcaccatcgtgcacgtttggtgtcttgcatcccaactgttgtaagatcttctcccaaacttgttgtacaaaggtgcaatctttgaaaaggtgttcttgccggaacctagttagaagcatagaaggacatggctgtgatatcaacattttgagggataggcttgaaatattcatacatcgacgaggcagagtgggaaatggggatgctttgccagtccagtgatcaatttctctggcaaccctattggctgttgagagctggtcctgattggttaaggattatatagaaggggaaagggaatagcaaagtattgccggtgtgtctccagaccatggattattctgctgtccctatcaaccccagacgatgcctttgtttatgcaaaagcatggtgcgaagtgtaccatactgaattccatcggagtgtgagatttcagcctcaacttcaggtgagtctgtgtattgtacagtgtacataacactcttggagcagagtattactacctgacaagtactgcagctggcaaatactgcctcaacttcagaatattcagacccattatagggggaaaaaaagattcagatgcctaacatctgcaggctatctgaaatgtagtatacatgcaaagtacattgtactctaatcacctatcttgcactaatttcagagcttatagtcaagaatccgaacttggcgtgcaagaaactgaaccttttgttaagtaattcgtggcctgcgtgctcatcacagaaatgaactgattgaataactcacctgggacgccaaactgtgtagtgtgcttgcatggatgtgagtcaaaagcatagctttcaggatccatacaaaattctctcttcttcttagctgtgcaaatatgtgtcacaatctaagctctacaccttttggtaatcagtgacagtatactattccaccagctagccagacagtatatagattaagttgtttcccctagacaattatatcaagattgctagcctgaatccagcccagaaattggcactggagcgaaatacgtcagatcgatccgatttccgaatcttcctggaagcatcagaagaagcggtcctgaagcggtgcatttccgtgtcaaatagattcgacatggttggctgtccatttcgggaattttatacaggagtttaatttcttctgccattcgatgcctatgcagcaagtgcaacaagaagaaacaaagaacaggccatttcccagcagcactgtctgaacttttcgcgtcaagtcgtcaagattcatcagggagaacagccagatattcagacaccttttcatgtagttgctggagcgcttaagctggaacagccagagcaaaacgctcgctctggctttgtgtttccttcaccgcctctcatgatcgaattctttatgcagcggagctccttttgtggcccccgttggcttctcccatatcccaacattatgcatgcacctcgcaacatgcgtacgtgttcctggatgcatatgggtacagatcatttggctccgtatgggaagcagtacgaacagcgggggcgcgcacgtactacacaagtcacaagtggcccatgccgcgagtaacatgacaaacagcgaaacataagaaacggggtttcccactggcaattaaaaaaggaaaaatctgaagaataggatccaaatcatggagtagggtaagcggagcaaagagagaaaccaaaaaaatttgcccagaaattctgaacagttctccataggcggggctggttttcacaatttagaccatgatctaaagtgattccgcggctgcagcatgcagccacaacaatcactgccgaaattttttggaaaagtattggtctgttcggctgcaacatgcaacggttattgacaaccaattactgcttagttgctgccactaaagaactatcgtccggctactaggcagagttgcaacaagccgtggaataggctcatttttttttaagctagacacctagtgaagctttttaccgaaatggagttttgtaagcaatgctatgacatttgaaaccatgtatatgccatgactcatatgatttggtgccatgtagaaattaggacaccacataggataatccatgaagaggttaacattagcacacttttcaaattgttaagcagtgtgttttgtgcgaaagcttttatacatgaaagctgctttaaaaaactaaataaatctatttttaagtttgtaaaaattaaaacttaattgatcatccgctaatggttttcttgtcttatgtaccctaactttatcttcatctttcattagaaaagaacactacttacatatcacaatttgactttgtcgctaactcggagtaaatcaattgactgcttctaatcggatagggttttgaagacggggtttccaacttgaattgtaggtgacacattgagtgactacacattatactactccctccgttccttaatatagggcgcaactggttttttgatgtgtatcaaaatatagggcgctcatgcacatgcaagcaaatagcattaaaacaaaagtataaaatctggttgacttccgcacgcatacatgcaaaggctttcaatgcttcttcggtttttgcgttgcttatcctttcacatgccaaaataacaggttgtttgcagggaagaatgcaaagagctgcatgcatgcatgcaaagaccgatgcacacgggagaagcaaagcatcgcatgcgtcgctcgagaaaatcagttaagtcttcttggtattgccgtccagagcagttgcgctctatattaaggaacggagggagtatgtgcttgccatctttggtcaaatcgattgatgccggtgatccccttctctagtaccaaaatacggagtagatgtaaaagagacacggatttttatgtagaaaacacttaataagaccacgaatattgtcacgccccgaactagtaccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccatgacttggaccaaacatcacaggcgcgacttgggaactaggccgaaaccctaaaactcatcgaagctggcttgctcctggaagaactcctcatcagcgggatccgcttcatcttcttcagcaactgggggggggggagattatttatatagagcaagggtgagtacgggagtactcagcaagccaggggaaataagtgtttaatgcaggcctcaaagaaaggctggtgtttttgcaattgattttattcgaactcttttttgaaacaactaagtgagtgcttctcaaacgacacggatgagatagtgcgtctcgtccggtcggagtatgtgcaatgtatcagtcttttagaattgaaacaaggttggcacccggccaacagcttttcaacggccacccgggccaacaacttttcaaacggccacccgggcctagctgatcccatcagctacagatttttcaaacatcgaaccacttttctcaacagcaatttcacaaggcagtagtcaaacaaaactacgctaggaatcaccccacatccgcccatgaccgtgggcacggctgttcgaacagtttgttaacctctgcagagggggtacactttacccacacgacattactaacccggatcacccagcccgtggaaatcagccacgtcgggggacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctggtaaactagtttcttagccaggggtgtcccattccacccatgtggtcgtacttgtcttatgtttggatgaaattccaaggaaacggtccttaagtgcaagagcgggaaaccgtacacccggtacgttccccggtccgcggttttggaaatttcatttagttcacaagcaccgacccaggtgtcgggttttccaaatcttttgtaaaacccaagttttacccaagatgtttatcatattttaagtttgagggcgaccgtcgatactcgcacagagtgctcgagtatcgaggcgcaactggatggttacaaggggacatggtataacaattagcaatggagggatcagatgcaacaagttaggtaggtccgccaaactgtcatgcggacggaacaagcagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgcaaaacgggacaactcaacaaacggcgaaaataaagccctattaatgacctctaagcgtgccattagatagatctcgggatttgaggaattttgggagttgaacggagtcaatcggatttacggttgggaagatattgaatttctaagattattggatttttggtctaaaggaaaaggatttaattaaatcctttttggaaaagaaaagaaaagaaaagaaaggagggagggaaaacagacttttctcgggcggctagggcgcggcccgagagaaagagcggctcggccgagtttaacgggccggccggcccaagaaggcggcccagagcggcccaagatgcgcgcgcgcggaggaaggagagagagagccggtggacagggctcacctcgcgcggtcccgggtgggacccgcttgtcagcggctcggctcaccgtgcggagggagcacgcggcgcggcgctagggtggaggatggacgtgatgcacgcgcgcggttcgcggtggacgtgggtgcggcgggtccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacagacggcggtcgacagcggcgagcgacggagcgaaccacggcgatacgggcaaaagcgagcacaccgggcggttgcacgtgacgaggggagacgaaccaacggctcggatttgccgggggttgctcgacggcggcggattgcggcggcggcaaccggcggcgggagaagggggaaacggcgacgaggtcactaggggctaattcccggcggcgagagcatctacgcgattacgggaatccgatgctagcatcggattgggcggaactacgccgagcgaggccggcgacgagcggcgcttccgagctcaggcggcgacggcggcgagcacacggcgagcgacggcaacggtcggggcggcgccggctaacttcggggaggctactcgagctactaccgaaagctaaggggggagatggagcgaggaggaagaacggagggaggcactaccgtgcgggacgggcgcggtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgagacagagcacgggagcggcggcaatggcgaggaggcgaatgggagaggaaggaagggagggggggaggcttgggtttataggaggcgggaaggtcggtttgggagagaggaaccgacattgggcggtcaagccggcgagctggcgctccggctagcggccaaaacgacgacaggaggtgacgccggcgagaggggaaaaagggggaaaaaggggaaaatgagggagagaaagggggctcgccccttgcctgtttgggaaaaggcggagggagcgggggcgacgtggcagggggaggaggggcgctgcctccgtcccttggcggcttgcgcgcggagtggcgggggccggg

SEQ ID NO: 79662 - DNA, 6622 bp, Oryza sativa
ccttcctgtcttttccaggctagcgcttacacatgttttatagttgcaaagcttaattataataatccgcaaatctccatatgacagcattaaacttcggatgaccatgtcttggtcatacgagctccgaatcgacccgttcaagtctcttaatgtttgttataacctaaagaaccctgtgctttctttttatgtattgttattgcttctttataggcttgtagctttgcttgtgtgcttcgcgtagtcttcgtcgttctggaggttcccgaagcgtggttcgtggtcgtcgccgaaggttcggaagtccgttctctctgagcaaggcaagtcacatcatccttgaacatattgaatcccagtttataaaattattctgatttaaattattgcgttatcgctctatttaaattcccgcgttatcaatgttttatttagccatgcctatttacctttgttatgaccttattattattgctattgttattattaccttgttcaccctaggttaaacaaaaccccaactagtgggtactctattcatggttccactagtatgaatttaggtagatgcttcgctgattaattaggcaatattaggtggttttataactttagactttgggaattctcatatcatctggacagtatggaatggttggcttatgttggaattggacccacatctccccctctattcaaaacccccaaaatggttttaggctgggctcgaggtgcgtggttgggtttggttagtcgtacctcgggtactataaggtttaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggttgtcgagatgtcatggcacagggccggtgtcctgctgctgggggctcagtcctgcctacctgtcccgggggttccggccgtaggtgggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagtcgcgccctcggttatgggcaagccgagcaatatacccaagttagtgttttaattcttaaaacctgcttaacaactaaaatgtggaatggttggcctgggttggcttgggacgagctgggacccagggtcgggttgccagtttggtctgaatcatcgtaggccttgggttaaggcaggttcgtgagggttcacagccttgattaataacactgtgtaactctaggatcgtctttataaaatggctttgggcaactaagtgactttaaatgctgttttctgcaaaacttaacccctatattattatccccttgtactcccttgcattaattgtgcatctccggtgtggcttgctgagtactgtggttgtactcattcttgctcaacctttcccctcttcagtaagagaagctttggagaagatgttttaggtgaagtcctggcttataccccagttgagcgcctgtgaagatggagccgtaggcccgctagtccgctgctgtttatttttgatggtcaggccttaagtgcctttgtaataatgtaaatattattgatataataaagatgtgccttttgtatcatgtttgtgtggtgtaccccggcttttcctgggacggggattaatacactagcgttcgggaaaatgcaattttcccggtcgcgacagcttctcctagtggttaacagccgatctcgtctcattttcaaccctcaaccatgcgggtgcttctccctctgtttctttttggttaaccagttcaaaccttagatcaagaacgaactgatgggagaagaagaaagaagatgcgatctaatatttttggggcaattgcacatttgaccctatttagaggtctaactacaccctgttctcgtcactttgctcatttgaccatccctttaaaaaacgaagctacactctaaccctcttatgttcaggacatttaacggtgttaacaaaagcttaaaatatcacttctacccttgcttatttgaactttttcttccaaattcattgccctttgagattagccctgacagttggactgtaaagaataccgacattgtctccttctaaatgacatggaatgactcggggggcggtatttatccgaattacttcggatgaaagctctgcctcccttaaccattcgtcaatcattatatatgtcagctcccaaacagtttcccttaggaatccaagttccataggatcgggaggtggcaaaggaacaagtggtttctttttgctaaaataactcagggtgttgtcgtaatcttcatcaaagccatccctgaatagaactggagcattatccagagtctgaatttcttcattctcaacggatgatggctcaggaactgcttcatcagtcaaatcagtcgaagtggaaggttcaggttgcgattcaactattgatggttcctctatcttagacgccaatgcctctggaggggttttatcgcattgtgtcatgaaggaagtattttctagaagtcgatctagaattactttttcttctgacggagttttgtgcatgaatgatccttcggcacatactcgggtatagacaagcttggttcagaccacactacattagtgaatctggaccaagctgaaccgattgattcgttattgatctgctggaaactaagtatttctactcgaagggtggtaatacgagtaactgggaagaaggcgagacaaaacctgtcttgcaacttttcccaactatcgtttacgcatcctacgatagatgtgtaccattgcttcgctctctcttgaagagagaatagaaacaacttccaccgtatagtttcttgcttcatgccatgagcaaatttactcgaagttccgctgatgatggtaggaattttccagatcgagaccagaaaaaggtttttccctaatcatactgattagttcggggcgaatttcatagcaagctgtaaaaatcggctccgatgaaggaggtgactcatagaattcgcacctaggggcagagagctcgaagagaggttgctccatggtcgagaagaattgaataggaatacttctctgggatagcaggggtagaggtagaatagaaaaaggtaaaaagaatacgaggatgaacaagattcggaaataatcagcaaccgttccccggcaacggcgccagaaatgcttgttagtatttcttaacgtcacagatagaatctgcaagcacacggaaaatactaatgtagcacttcacccggaagtattcttaggtatcgatttccacagggaacggataattgcttccttgtcaggttcactcaaggacactaagctaaggtgggcaaaggacagagaagatttcctggtgagaaacagcgtctagggaaatcttaattttaatcctaagatacttcagtcactggcaacccgttgttcccagatgtcgctctactacatacccggacagggaggacttaagtgcttttgagggctgtcaccacctctacatccaccttaaacatactgtgggatatgtaacaataactggataataattacctaaacaccacgtctaagcaattaatatctactttaatgtttataactcactaaagtaatcaccatcttttagttggttatagtgaacaataatcccgtacgctgattagaaactaatcaagaggtcattctcacaagtaaaatctaaattacgcagaataatatttcaattgaaaacaaagtaattaacagaataaaagaaacaggaaagaattaccgacaactctggaagtcctccgacttcttctactctactctcttcctaattctaatatacaaaatagtacaatagagcctcttataattcagctcaaacttggaagtgtgtgaagaagtgaaggagtaaagttccttttatagggcaggtatgatggttggaatgatgcgaattatctgaattgccccgcaaccatcatcaggagagcatctggagcgtcccgccaaacccttggagatcagggttcggccgaaccttggctggcccatctagccctcaattttggcctatggactcctcctgtcctaccttatccatttcttcaagttttgagcaggttctctgatattttaatgaagtctaaagcccctttctggtatggatatgttccttcttcgcttagtctgattttcctcccaactttggtggcttataacctgcatcaattaaacaccaacacttgtggaatatgttagaattaacacctatcactatgttggatgttttattatctgggttttatgcagatgttggcggtataaaatgagcacttaacagtttccaataggcattgactgagtcctaggggtgcacctagggtgaagccgaatgatggagcccgacgggtttgccaccaagctcactatccgaccacgtcatcactatgggcgaaggccactgagtcctaggggtgcgcctggggcgaagccatagggcgaacctcctgagcgaagctgaacaatgaagaccgaagggttcaccaccaagctcactatccggccaagtcatcactgttgacggtccttaaatcataatatctaaccatcaatacctgcatataatgaaataaatatggtatccaacttagtggtagggtttattactaatcatttccactagtattgatgaaatatgtgtatgcaggtattttaaggagaaaatacattcgtcacgcgacaaaaggcacttacgcacgatcaggacgcgtttacacggattggaggccccataagtcaataaaaactacttagaattgggctttggtatagtacatgatgttgggggcccattaagctacttaccggccagaggagaggccgggaggacgttttttctggttcagccgaaccaccagttcggctgaaccggtttggtgtccgttcatcgccatcttccacgtgtacgctcctggtttcgtccaaatgacggttggagggcacaatggtcatttcccatacttgtaaccgtcatttggagcctataaaaggaggtctcctttacacttcacgacacacaactttgagctaaattacaagaggctttattgtatcttttgtacattataaataggtagagagtgaggggaagctctggaggagtgcccagaagtttggcgctcatccgacttctacctcgacgagtgtagctttctaggaggaattctggaggagtaccggagctgtcggtaaactctgctctaggttcggagaaacttcttttataaagtaagcactcgagatcctttcttttgttatttaattacttagtatgagtaagatatatttccttgtttgcgggttcactgtttagtattcatactaagtgctctactagtactctggataaagaaggatgtttctgcgcaagtattagagtagtaattaacaacttagacgtcgtgtctaggttagagattacctttgtttgttgtgtatcccagggatttgtcagagatagatggcaggtggtgacagccctgaattccgtcctagtaatcctccacgttcggatacatcatagagctatagccgaaaccacgctggcagaccagcaggggtcggtgcccaaagcaatagataggaaattccctttgcttagcacagataactaaaacacataaaagtccactctagcctagccagcctacctatagttgttgtccttggatcgccttagccttaggttgattacacacgttctctaagttcaatatccttttagggtcacccgaaggtgaagtgctatagcggtattctgtgcgcttgtggatttatctgtggtcgtaagaaatactaacaatcactatgggcgaaggccatgaagtggagcaggaggccttctcctgagtaggaggtgcctttgactaagggcttgggaggccctgcggcccatgggggcctttctgcattaatgggccggtccaaggaaatcaccagatggtacataaatacaaaagacactgtgtacccagtacccacactaatgtctctatcataagggtatccctataaattcccctgtagtaactaatccctagggccatgcaatggggagatcccaaaaattttcttaccaattaatacattgcttttactattccatcaactcatcgagtgaaccacgtccttcgacatgacgcagttgtctttcgacactagtaacaaatatttgacaaaactcaaaatgataacaagcagtatatgtataaaattttatcattaagatcaacatatggcattggtaggaagggaacatcaatgaggagaatgtaaaactatttattttcttctttttttgtaaaattcccaagggttcatcatcaagagtaagattcatatcatcgggtcatctcttattaatcaataacttagataacaat

SEQ ID NO: 79663 - DNA, 2864 bp, Oryza sativa
agggttctttccatcctgcgctattaaatataatgttcatcctatagcacataatggagggttgataacagaaccctaaccgtgatagcatttttgcggacaaagtcgcttatgcgatggcatttcatgaaactcacacttctcaatagcatttcttggaattgggcgcttgtcaatggtatttcttggattttctctttgttaattgatggagttatttgttcttgtgactcaataatacaaatggtgtaggatcgaacataattaaccaagcctaccagaggggggtgaatggtagattacgtcagcggaagtcaaataatcgaatcttactatatcaaaacacaccccaacctcaaaagccaatggaacacatgtttggtggtctatccgacctactaggatcggtctgaccgaactctaaccagtctgaccgcaggtcctctcgcggtctgaccgtcagcttgaaaatagcatgacagcgcttcggtaaaaacacgatttctcttaagccaaccgttggctcgagttgcagaataaactagacaaaccaagaaacaactccaccgaagggattttaaaactaataaacggtttaagagaaaacaccctcacaattcagctgtctcagaatttcagcaaatccgaacaaaacctaaaacttaagaaaattcgaaactagcaagaaccaatcaacgaaactttctagatctgatctatgaagtattagaaaggttttggatggattaacttgaacaaaatcacatcaaaacgaactatcacaagttaatgccaaaaccaaatataaacataaaacttatgaaatcagaatagatcgtcaatgtcttgatgattgaatatgatctttattgctcaagtatattgttcacatggtgcagccacagcaccctttacaagtttcttccgaaaccctatctattctctcaaacttagcttactctagaaccgatatagggaggaggcttcatgcttcctctctatttatacataaaaatcctcctactcaaagtagaagtaccactcctagtcacactaggactctatccaaattacaatctcctaaagcctgctgcctcacagccggctacagccaatccgtgtcctagccaacccgacatggacacatgtccgtctcatacgaagtcccggtcggcctcggtctcctgccatggcgccactcctgccttggactcaccgagccaacacacatgtactccgtatatgcatgcatgcttacatgtactgccaaccactacagtacacttgcatgcatcaatcaatataccaacatatgcatgctacagtaccatgccgtactatagcaccatatactcttctccaattccttcgtgaacaccgacgcttgcacgcacacctcgtgaagcccgttacgaagatctctcccatacgatgtctatccacagtatgccatctcgtatccaacttcgtcacccggtatccttgacagtctggacctcaactcctccctgagtttagtcccgatccccaccgttaaccgaagttgacctccaagaatcctgactctaatcaccttctcacatggtatcccgaccgcactagacctctactcctctctgagcatagtcccggtcctcaccattaaccaaggctgacctcaagccatctgcacacaataagacaaaacaaccgtttctgggcacagatatcacaacctgacccacattagtcacacgcactcacaccaacattcacagatactctcaaaccaattctttgattatatcatttgcatagccaattgttcatcacaaatattaatcatgacaatgatttcacaaatggaattagaacagttcgaatttatttcattatatgagtgcatatatagtttagttttgacatatcacatgtttatgcacataccgccaacacacgcctcttacaggaaaacacaacatcacacttccaagttgtgtgtttactgtccatgtcacctcctgactagttgtagtgatataggaaaaaaatttttgttacaatttcaatactggagctcataacaagacacgtcagcagtaagacttccatcaaggcacaaacctgcaacaacgggatggcagagtagttctgagctctgcgcacattcagaatgctacagaagaatccatgggcaccacacctagcccacagtggacgcgcgtgctgcactatcttccgcaataggttggtgcacaacgttacgcacaacagtgaaaatataacgcagaaggcaccaattcctgtgccataaaccttggctagatcaagtcgtgctagccgatagaggccaacactgtaattttcagaatttccaaaatgtattttcagacaagtccgaaaatttacagaagcaaatctcagtttcgcagccatttttggagtttccaaaatcttttcggagtttccgatattttttcggaatttccaaaaagcacatagtaaaacgatcacaacttttcgctcgggagtcccatttttatgatcttggactctatggaaagctcactcagaggactacccaattcaaccaaaaacaaggtctaaaccaatcaaaggattggttaaagtttgggtttctctcaaggtagcactatgataggtcactttgagcaccaagacttacacaaacacctcggcgttgatccctcttaatagtacggcattcctaaactcaaatataaataggaagagaattatactaataggaatgtcttatttccatctttcttttattttcttaagggacgcccatgtcgaaaccgtttcaccatatattcttcaaatgattgatgcggttacttgtagcttcaaatggtctcgca

SEQ ID NO: 79664 - DNA, 633 bp, Oryza sativa
attcctgcagcccaatcaaacaagaattgtagtgtagccgaacaatataagataatcttaaagtacatgagggatgacgatacatgtggatgaatacataactaataattaattcaacattgggtagaagaacaactatgagttgaaataattttcaacaatttaaattagctaagaaagtgtataaatcaatttatactgctgagtaagcggccctaccggcccagccaagaaacagcccgaggaaggatacacgcaagagcgcagcacagcgtgcggaataagttcacattgggttcctctatttgtcgtccagtctgattttcgttccttgatcacaaaaccgggtactacaggtccccgaacttatgaaaccgtttaaataaggtcccttggcagtatttgactccggttttgggtgaggtggcgcctacgtgactaattaactcggtcttcatctgacgtggcattgacgtggcacttacgtggcaattcgatccgaaaaataataaaaattatgggacccacatgtcagtttcacacacaataattaaaaaaatggtggggcccatgtggaccccacctgtcatcctcactacccctctttctctattcttttttctttctctctct

SEQ ID NO: 79665 - DNA, 616 bp, Oryza sativa
gaccaggcgttgggaactcaagcaggcgcagtcgccctccaacttgatggcgtcattggggcctgcccggcggcagcctggaggcgaacgttgtgccgcttcactgcaccccggggccactccacctgcatcgcggagacgacgcgggagcaggagggcggcgacggcggcggagacgacgcgacatcgcgcgcctgccaactctgcgcctctaataaagccacaagccaccggaagcttgacataacaaagtcacagcaaactcagcgcaagcatagtataaccaaccaaaccaatcagccatggcgtgaaggctctcgctgctgaccgtcgtgctggtgatggtggccgtgttagcgagcacggcgatagcgcagagctgcgggtgcgcatcgtactagtgatgcagcaagtgggggttctggcattctgcggcaccggcagcgactactacggcacggggtgccaggcgggtccctgcgacgtgtcgaccaccaatgacgtgtctgtggcgagcatcgtaacgccggagttcttcgcggctctcgtcgcctaggccgacgacagctgcgccgccaagggcttctacaccgcgacgccttccatgtcccatcga

SEQ ID NO: 79666 - DNA, 12581 bp, Oryza sativa
tttgtcatctgtttttcgctttgctgtccagttggaagtgttcaagaagacgcttatgcagtcactccaggaagatgaagatcctgctgtaagttatccacgactctgcgtttgcatgtttgtgttgtatttacttcaagaacccaacagtgactagagcattggaatttggaacttttgccctaattttatttgtaattctttttgattggaagtgatttttcttgttaaaaatactttgctgcagaacactactcctaaggcaagggtcagcgaaacttcaaatttctcctctgcaacatctgttggaggtactccaaatattttgggaggaatttggtggttgctaattgcatcgatttgcattgtgccatatgtaaccactagagtaaccttgacagtctgtttctatcagatgaagattctgcatttccagtttccaaatcgtcacaattatcagaaaccgcaagttcagtctcagaggaaagtagtcatgttgagccagatggtacattccattccatctcagttgattcacgttgttcaatgtgcaactccttttggtgataatttacataaagcacctttttatacttgcagtacccaggccaccccgtccacatgtatttttgccatcgtacaacagtacaccaagggttactcccccagactcacctccaaggagtttcgcgtcaatatcacctccaaggcggcattcaatttcaattacatcaaggaatttgtttgatgacaggtcctcggcctattctggtcatagttcagtgacatctccatttgatgcaggaagtcacacaggttagctgtgctagctcgaactaaatatctatgttcttgtttgcattgtaatttgctaatacttttgtgtgaaataaggaaccttcatatgtaggatgtattaatataaattttgtgagtaaattagtgaggctgagattcttcaaggacaaaaagctgactcaatcaaaatataccactgaaaattggctagtattctgctaatagagttctgtgttttcgtaatttagaacttataatatatataaaaggaggaaacctaacaaattgcctggtcatatgattcaatgaccatccatatgtgataaaggcttctatcaagtctcttgagtatttgcatgcaaaaaatatcgataatatctttttatgaattaatgaatgtcaaaatgcaatctagattccaaacagtcagtctacctttgtgaagaactagcaaactccattaaccatccattctgttgcactgatagtagagagctgaaatagataatctgcttgaagcaccagcattttaggacaaatgaaaaggattaattggtcagatagactggtaccagtctccagtgtagcttagggtttgatttctgactgagcatgctgatcatttccatgaatttagtagttctctatgtttattgtttgcgcgtttgttttccaggacgaacacgagttgatggaaaagagttcttccgtcaagtcaggtatgtggttttagatgaacatgactttggagagtacctctagctgtgccctttatgttgtgtaactttcctttagaaaaggatggaacatttgcttaggagttattgtaattccctaccttctcctagtccacttgtaaagttgcttaaggtctgccctgttgtgtttttttttcccaaaaagcttgacattataatgtacttgaagaaccacacaatattgcgctataggaattgtattaaccccggtccctgaagatccttttttcataaattgcaaaaacaaaattatggctgtcttgttgcttaaccaccagaaaagcaaccttttattgcaatagtcatggtgcacagttaacctccacattccttttgacttaaatttttgtgtgcatgcagaaaccgtcatggtgcacagttaacctccacattccttttgacttaaatttttgtgtgcatgcagaaaccgtttgtcttatgagcagttcagtgcatttctagccaatgtaaaggagttgaactcacacaaacagaccagagaggtataaaactatagaaactgcacttactgtatgttctactatatgtgaatctgtatctccctttttgtcctaggtttttcttctcttttggcgcttattgaagcttctgtgatgcttacaggatacactaaggaaggctgacgaaatatttggtccagataacaaggacctatacaccatctttgagggcctaattactcgcaatattcactagaatcctgaaaagtcaaaactggaacatttcttgtaattaaaagcggtccaggtttttttacaggaattatgagaaaaatacgtttggtactttttgtatttcagtggctactaatttcagatttctggtgtatagtttttaaaatttattcttgatgttaatgtagaatctgtaaggtatggttatatatgtaatacaaatgaaaaaaattggaataagagccaatgtgtttttctttttattaaattcaaaatgtttctaataaccacagataaaatgcagttgaaaacaagagcaaactttcctcgcatgtatcagtcaatcaaaccactttgaagaagataaattaaatagcaccagtgccctttcatacaagtgtagctctattgaatattcttttggtaaaaacggcttgatttgccgcagaggtaaataatttcagactgtaattatttatactgcttgaatgattcagtggttcagagcacaaactgaaaaacgtatcccagatttgctggtcacatcaatgctcaactacggtacaaaattcagaaagaaacataattttcctttttgtgtaatcaaaagaaaaaagataaatgattaattctccaggttacttcgcgactcatggagcgattcttcagcacccagtgacacccgttcttcagccacttcaagcattatcatgtcagctttcttattacctgtgctatgtaatctttaatatatttttttagcacgctaatgctactacaaaagttcacttttgtttttttatattccctgaactatttaccggcctgctccaaattgccttttgttcttcaaaactcccaataacggcagactgtctcttgtttgctaaagaatttgccaattgtttgctatatatttcaccatcgaaatcgctcaatacccttaccagctttgcactattcttgctgatgacaatctgcccgtccgtgcttttgtttgtgttggcaataacacttactggcttgagttccactgaaggtttcagtcctgatccttcaaccatgtaaactgctccaagaatttctcccagaaatatgtcctgatatcatgaaaatttacacaaagaagttatgtgacaaaacggtatcaaagtgagaaaaaaataagatagagatggattgtagtcactagtcaattaccaaatgatgatacagcttctgtttgatctgaagttcttgcagcaacgacaacaattcatggacaaattttgattcatgggtatgctggatgtcttccaaagccgcaaggacagcccgaaatgatgcagcctttcgttgcgccgtaagaggaatgagtgcgattttcagatcagattccaggactgtttttgcagctagtggatcaagaaatatgttaaactctgcatgtttgtttgatggaaccgtgaacaaatttccattctcatcgcctccatctttgatgagtccaccaacaacatagactctctgcattggaaaaggttgtttattgagattgacgaccactgatgaactcatcacaaactaaaacttattttggaagatcgagaactaattgacctctattacagaacttgcatccctgtcagagagtgaaatgttggccatattggtgagaggtccattagtaagaacagtgatcttttcgcctggatcaagctgcttcctgacagattgccaaacttcaagagccaaaggctgccgatcttctgggtgatctaaactttcaggagcatatctgatcgtgtaattaacaatgtaaaaaaaatttaggacaatcttcaattaattattcctatgagagagttcctttactgtacccacagattagtgtggactatatattcagagcatgctgcagaagcagaaggttaccttctaggacttcttggcagtgacctggctagtccatacagtgtatctgaatcaataaaaccaccacttccatgggggatagcataagaattgttgcagccaagggttggaattcccaatgcagtggtattgcctaggcctactggaatgtcgtcgcggcccatcatatgtagaatgtcgtaaacgatatcgatgctcgcaatatttgcccagccattgccattgaccaaaacagcctaaaacaatttttaagacagtgagttttgcttgatgttgtcaacaatgattcaaaacaaatgctaatccattgttgtacatatgagaaatgacaacatgattttgttcacttaatgcatttgccatacatttttttgtttccttacctttagatctattacttctattggtgtcttcaagaggtatattagggaaacaaaatctccagggctcatgtccatgtcaaaaatgactggcttccccctgctcacatttctgaaaaccggcttgtaaagaacttctctataatatgggaactgcgtattgatgttgaaaagcccagtttgttcgggacgatttaagacctgcaggaagcaatttcgtcaataacagtaactttattagacaaaacaatgaaaatattcatgtcataaccttgtcattccctaaaaataagaattcaaccttctcaaagatgagcaaggaatgacatgcatgcttacctctaagaagctcttggaaaattccttttctagtgaactatttttatccgtgttaggctttgctcttgttgcaacacgaacccgaactccttctggaccagacacttctctagtgtatccatcctaagaggatttcagaaaaatatcaaaatgtatcttgtctcatgcatagacagaattttgcatgttgagtattaaaaatgtgagatcatatcatagcaactgggagatcagcgatggagatgttcagaacaggaaattttaacttgctcactttctaattatcagtgaactaaatggatataagaacaatatccataaatacttttttttttctaataagcatatctatattgttaaagaacattccaaaagtataacaacatttttcaatcaacaacatagcgatggagatgttcgcaacaggaaattttaacttcctcactttcaaattctcagtgaactaaatggatataagatcaatatcaatatatacattgttacaacaactcgaaaagtacgatttttttttttcattcaataacacatgcacattacctcgcatctccctctgttgcttcccggtaccaggcagaagctatctcttattccagtctgaacatggccactgtgaactccaccctctttcaggccaagtttaggagtagcacggccatcgaaaaaggggttcgagccgtcacgtttaccatacggtttgtttgaagttatcactgtaatgttcatatattcaagctcagaaaattcattttcaccatcaacctcgccattgcgcatgctagagagagccacaccagcagcaaaggaatcccacatgtagtagctctgagtaatgaaagaacaccatgagaaattgggactttttttaggcgaaatttcggtaccaaataaaagttgtgttgtttttttttacaattgtgaaagaaaagggagatttgagctttggacttgccgtgttgccatggccgttggatcgtcccctcagcctcatcaagaccttatcaagtgactggaaacagtactgtgcctcgtaagtttgctgatgctgttggaattcagaaacgaattcctcggtgaccgaaattgtgttggtcgcatcaagaggaatcatcgtgattggaatcccggaatgtatgacctgaagatatagaaacgtagagtcggcactattactcaatataatcagttaagtcttttttttttcgattgatataatcagtgaagtcaagacatgcactgaagtagctaaagttcatgcatttcatcgtctgcttgttgacttatcatctacagcctacaactaaaatttgaatttcagagttgattttatggtttttcatcgtgatctattttccagccttacttttaaactgtaataatactaatacaaaagtttactcataaattatctttggttgcctctacctgtcgtagcttattaaccacattgttgaatgcaataaatcacgagataattgctggatcatatgcagcaaaattaaaattaaccatgggaaagaaacagtttacacctatattattgctgctagaggcagcgaacagttgatactacattattattgcaaatacaattaaggtgacctgaatacctgataagcagcgaaggggtctccaaagatgttgaactcggcgaacgggttggtggcgaaggcggtgaacaggttgccggcggggtccgccgccctgacggcgccgccggagacgtagacgcggtcgatgttccgagccaggcgcgggtgcgccatgagcaggagcgccaggttggtgtgcgccccgaagaggagcacggtggtgggcccccccgacaccgtgtcggccatcacccgctgcgccgtcggctgcgtcaccggcctgtaccgccgccgcccctgcggcaggaaccccctcctcacgccggagttcgtgtcgacgtccagccgcccgccgcgccccgccgggaccgcctgcctgtacctgcagccgccggccgtcgacgtgccctgcagtacacacatcgctggcatcgatctgcagctttcttggacacactacaccggactaggtcacctgttccaaacccttatctttaacgggtttaagcttggttacaaactaatgatcactggtgaggatcagtcacatttaacgggtggagaaccgtcacaatgactccacccgacacaatgatagtcaactctgacgagctagaactctacggtccgtcagaggtaagtgacacacagcaacacacagtactactatgagttttgtagtacctggtcgatgagtgggaggtagccgccgacgtcggggccccggagggcgccggagtcggagacgccgccgtcgccgccgacgccgacggggatgtcgtcgcggcccatcatgtggaggaggtcgtagaggtggttgacggcgtgcccggcgtcgctccactcgttggcgttgatggtgatggcctgcgcacgcgcacgcgcagcgcattgtgtacgtgcaaagaagaagcgcccgtgtcacatcacatcgatcgatcgatcactcagcacacaaacgcaacgcagagagcatcgacaagacggcttatcctgtggacaaatggcgttgaaacatgcaggtaggagcagcgctggtcaaaggccggtcgtctctctctgcagggtgtgctgtctacgtcaacgtttaattaattaattatttaccaacttaatgatgaaatgacagtgtaggtgaggaggagagccacacgcgtgcgacgatatcaccaccggagatggaccatttactccgagttggggagataatagatacgatcgaaatgatcgagatcgtcatcgtcttttcaagagattgagccagaggcctttgtaaaaaaggctatgtatggatattttttacggtatactccagaattatctggagcgagagaccgtctgttttgacagtgattaaacgcttcatatgtctattattacctccaataagaagatgattagtggtaaaatgatcgtatctttgggaaaattcatgaaacaaattagctagacgcaggcagtatcgtatggagtatgcaactcgatggccatcagcgttaacgcacgtattaccttgacgtcgaactcggagcggttctgcttgaggaggtagagcagcgcgaagaggtcgtcggtgtccatgtccgtgtccaccaggatcctcctcggcttcgccgccgccgccgccgccgccgccgccgccgtggcgcggcccgcgccgccggccgccacgccggaggcagcgggcgcggcgcccaccgccaccaggagcagcacggcggccgccgtcgccgccgtcctccacatcttggctctcctcttcgccttctccgcgggagacatgcacacagcagcagcaggaggaggaggaagaggaggatgagcttagctagctggccggtgcgcctttttatcgatcgccggccggcctcgctgtgggtcggtagctgcagggcattaatgggcggcggggcgggctggcagtggcagcagccgtcaggcgagcgtggatgatggaggcctccccaatcgggcaagtagtgatgaagccgatcgggctgcccacatccacactgcacctgtatttgatgataaacacgtagtacctccgctaaaatatagtaactcttagctgcatgcattaatttagacacacaattatccatatatatagttaaaaatatttatattttggaacgaaaggacctgttcagattgtaaacaaaataaatcttactaaattttggtaatttggtaaaattttgataggatttcttatgtatttactaaagtttgacaataaactaaaaggatgcacatatttagcaattctgctaaaaaataatatggtttgaaatggtatcaatattaacaagcccgaagtatatattactttccattttacaaatcacatagcctgcctagctaacatattaaagtatggatggattaatattctctaagaataatctacacgtgtgactatttatatatatttaactagttctaaaaatgccttcaaattatgtagtcacacgacatgtaaaactttgctgcaaaatacaataaccgagtagccactaacttgatgtgggtatcggtctaattgaactagtaccaatcaaaaagccactcgatcaacaaactggctaagctagctcaaaagatttatctagagtatattaatattaataaacacttgttatttataaatcatatactttcaacgtagtggcggagctagaacgaaatgaaggacgtacatcttgcttaatttactctactttagatcaagtgtaaattgatgcgtgtgcctaagtttgtattgaggggggtgcacacatgatgaaaatatgtgagttataacttaaaaatttttcttgaccaagttcctgggcacccctcccatactctacctccgcccctgtttctagggttataaatagttaaagcttataacaacatttttaaaatcgttgctagccgtggtaataaatagtgtggtaataggttattgcaatgatttttatttagttgcaaaaaattttgatattgccataaaatggatgtggaaaaaaaaatattacaacacttcacatcgttgcaatagataactattgccaccactccatgtgtggcattagatatttaaacccaatatctctccctcacacgtgctctccacataaaaattatcattgcaatagtacaatgtattgccacgaattatttttcgttgtaataaattgatagcgatagctcaattattttggctagctagctaattattaatatctaaaaatcagccgtggataagctctttgagtcaatcctcggtttcttgtttccatgtgtcacattagaccattagatcttgagtttacgatcagataaattaattttcttgttttccctaaaattaatttcttgtttatatgggatacatcatgagtgatagttacccctactgtacaggtaattaaaccaacgaaataaacgtgaaaccgctggcggttggctcgatcgtgcccatcccggcgtgcccggcccggctggtgggttcgggaccgcgtggtcgttttccaaaaccttccgttgtggtggtggcctcgatcgtctccggccggacggcgagtccactgtccaccagaggccgccacaccctcccgtcgttgaagctacagcaacaggcacgtacgaccgcgcgcgggtgggcgcagcgcggtggaagcgacaccaccgatggttatatcatcgatcgaaattgcttgcttgggcgccggccacgggagggaatcgtgtgtgtgagacttcgtgaaagagagctacgtagctaagggggtgtacgtttagatccacgggtaaattttttttcaccgtcatatcgaacgtttgaacacatgtacggagtattaaatattagaaaaaaaaactaattacacaaacttacaagacgaatcttttaagcataattgcgccatgatctgataatgtggtgctaaagtaaacatttgctaataacggattaattagatttaataaattcatctcgcagtttatacgcggattatgtaattttattttgttattagtctatatttaatactttaaatgtgtgtccgtatattatatgcgacccgacaaatcggtggagataacaaagcctaagctagctagctttcggtgtgcgtccaagccacgtgttgtgcaagttagcgaggaggcatgaagctaggcacagggacgagcacgtagatactgttgtgctgtgtctgtgtcaccattgacttcggttgatccggacggggacttattgtcacgggaaaacggatggaaattcacaggcatgcgcgtgcattatgcacatacggctggccctgttcgtatgggctgtttgcttcagcaagacagcaactccttaattatcttttagcatattttccgaactgataataaataaggagttttgtgcaaaaaaattatataaaagttctttcaataagtaaataaatctattttttgaatttagtatttaatacttgattagtaaggcgctaatgatctatttattttttttagacgtcaatggctattcaaattaatgatataattaagcagggacgacgtttcgtcggcggtggccggtggggagtttgaattttggaagaggggtacagagctaagaaaaaaaatctattgctcaatgaaaaagtaaacattagtacgtgcaggaaaaatatatctaaagcacatagagttcatactgacttgtatatctcacagctgctaatcgatcgtacacaatttaacaagacacagagagtatggccaacaatttattaaccacgagggtggtaagttttaaatacaaaatgagaaggaaaacgtcagaattacctcctaaatgttgtggcagtacaaattacaccccttaatttaaaaaccagacattcttcacccttaacttttcataccgatgaattaccctcctggtcgattccggagtggttttgttcttacgtggcacacacatagtcgacttcggagcggttttcggcctacgtggcgcacacatggtagtccagtcaacatgaaaaaaaataaaaaatggtgggcccaattatcagtttggtatcttctctcgatcaccacatgtgggccctactctttttgtattttttatactgactggactatcacatgtgcgccacgtatgatcaaaaccattttagagtctgttagggaggtaattcgttcgttataaaaaattgagggtaaaaaatatctggtttttgaattgaggaaggtaattcgtactatcgatcaccacaatggtttagggggtaattcgaactttttccaaatgagaatatggcatgtaggacagtatgctaacaaaatgtggtgtatcttaattgtggtatatccaaccaaatgctaacctaaaaaaatatggcaagcctaaagtttggtgtgtgacaaatttcgggcagtaaccaaatagctcttaaatgcctaacttacatatatatgctacacatttaattttaaactagcatggtggcctgcgcaaattaagtggctagcatcattatattttctctcatataatagcatatatattttctcaatgtattattcaaatatattaaaatgataacataattttaaatattgtactaactttacgaaactactaatgtgtaatatacgtattgtattttatatacgtgttagttattaatagtttttaatatcaaattttagttatttgtaaattatatttctatatggactctagactactctttcaatattacttttaattccgaattttcgttatccgtatttctatgtagactctaggctgttcttccaatatttttttatttttaatcctgaatttttattatttctaattgtatttctatgtggactctaaattcatctttcaacattctttaatttttaatttcgaattttagttacttctaaattgtattcctatattgactttagactcttcttcccatgtttttttaattttgaattttagttatttgtaaattgtattattatacggactctaaactctactttttaattttattatgtttatttcgaattttagttaattttaaattccta

SEQ ID NO: 79667 - DNA, 6568 bp, Oryza sativa
aaggcgctgtacaactcttacacgggttctcgggtcgcccgggcgggcggcgtgccagtgtatggtgccgttccattgccgggcggctcccctccctcgtaattcgggccgaccgtgccagggcacgggcacgggggggtgtcacgcagacagtacagtggtctccctttgactggccagtcaagaggaccagttcggcacagccagcagtccagcgcccgcggtcaagtcaccatacgtttgcttccatcccctgcacaccgtctcatcgctccggcgatttgacgtcggacgagacgcaacccgtagaagaaaaacagaactccggaccgtggcgcggcgccgcactggcgcgcctggcgagcgtgtgcgtccatcgatttgttttcccctcggtgcctcggccgaagtaggggaccggccacattcgctgtagcggactagcgggggtgggatcaccacaccgtacagtggtcaatggaactacttttctctatcttaaaatattatatctaaaagataacaatattttaaaacagagagagtagcgctcaattaaacgcatttagatggaacagtaaaataaactcttattttaagactcagagcagtaaacttaggctgtctttagatggtggaaaagttaggaagttagtagaaagttgatagtttatgtgtgtaaaaaagttttcgatgtgacgtaatatgatggaaagttagaaatttgggaaactaaacacggcctcaaaatccaaatcaacgcacggaaaacacatcgcatgcgatatgcgatgtggtcgtcaagtggcttcatagcccggtcgttgcgccgttgcgctcaagtgacattgtgacaatgcaatgcaggatccaacgtctggaattggttttactcaggattgggcggcagagacgtgcggccgagggatcaagagctggtagctgaccgtaaaataaagagaccattccgacctgcagttttgttgtccacgcttttgaaaaccttgatgtacaaatgtacccataacaagtcatctgtgtctcctcttgtctgtcccaaaaataacatcattttgaacaaccattgaaattaaataaagtggggacaattccacttagttttggtaaagtgagagtattctatttttttttacttttatattgttatatgtgagattgattaaaaatgaacttattttggtacaactatactgagatataacttctacggtcttgaaaacataatacactgctataaataaataaagtaatacaatacacaaactaatgtttccgttaggaattgagcatggcttgttggaataaaagagcaacatattgccaccacactatggctgtgttcacatatgccggtttccatcccaaacaatacgtatgaaaaacggagcggttcattagcacgtaatcaattaagtattcgctattttttaaaaaatgattcaatataattttttgagcaaatttcgtgtagaaactttttttaaaaaaacgtaccggttaacagttttaaaagcgtgcgcgcgaaaaacgaagcaaatgaagttgggaacttggagttccaaacacacccatattcacatattcacatgagaacattgttggttaaataagtctctcaatattctaacttggatgtgaggttagatccaacacctaaacattgattgtgttcccctgttaatatggattttatggcaatgtgaaaatattcttaacgtcaaagtatatagtgtcgagatgttttgctttaacgctaataaaatttacgctaatgtcggattccttttacaaagtttttattcaatctttaaatagtcttcttttgtttaaaaaaacccaaaacttcaaattttcagccattccatatccaagcgtgcgcgcgtgcctataaaacgcagcagggaggttttttattggtcgtaagcagaagaagcgcgctgtccactgtccacacccgcacacgccgctttccaccacggcggcgctaaaccctttcgaaagaatccccaaatctcccacgctccaaagcccgaaaccctagctcctgttcacatggcgccagggctccagcgcttcaccgacatcgccggggacggcgggccccgcctcgacgccgcctccggcgaggagctcctccgcatggaccgcgccgccttcgtcgccctcggccgccgcgcgccggagcccccgggtaccctgttcgtcaccaccaggttggtagcgtactgatgcttccgccgtgtccttatctcttattttgcgcatttgtgcctaccatcccgttcacgttgtgccttttttttttcgtttttaggagggtgatttggcttagcgagacggagaagggccaaggctatgcggtggacttcctcgccatcacgctccatgctgtgtcgcgcgacctggaggcgtacccctccccttgcatctacacgcaggtgattggggaaacgaactctccattttattatctctgtggtctaactgggcaaatggtccattaggtgtagctcttatgtttttacatatgtttaatttgttggggtgtgtgtactggttggagccctggaggcctggactgatcttgaaatggtttgttcaatcctctgggtgtttttagttatgtagtggtgatgatggtggggttggtaatttcagctcaacatgtgctcttttgatcagcaatcattattttgctacttccaatatactcctattttaaaaatatcttgcagcttggaggatcctgagctttgttttgtgagccatgaattgtatatttgtttggcacatagttcatcgattgtatgattggtgtcacatgtcgctatgacaatgtggtccgtcttgaactaatccaatcttagaaaaaaacaaaagtaacttctgtgcgtgaaaagttcataaactaatttgtgtcttgattcctgggtgatcactactttgctatttgttctgagtgggtgtacaatagtgtctgtaaggtggcttagtttcctgtttgagttccctgatggtaatggcaatgtctgatattctgtttgtttaatttgaagattgacgcagaagatggctctgatgaggaggctggtggatcagatttcgaagcaaatggtgatctgcagctagcaaaagtctctgagatgcgcattatactttcagaccctggtcaacgtatccttataaacatctctgtcacattcaaataatgttgtttcccacaattttagctctgatgccttctttcttgagtttatatacgccagctgatttattttttcaagtattattagtgtaatacttcaaaaccatcttctggagactcttcttactcctatttgctttccactaccaccacaattatttcatcattttatccctatttatatggtttttaagtaataacctgttcagggaaccaattggagttcattatctttctgatgtgtgaattgtgatacatgtgttttcgcagtcatgcttgaggcgtttaattggagattatcaactaaatttccatggtttattcttatgaaattctagaaaaaaactttaggatcaagacataattttacttgctagcagtttgtttctattttatgaaaatgttagtacaaagtaacctcacgaataaataacagatgtatagcccaaatcagtttcagttatgttagcagaactgaacctgcttgtcattttctgcgtaagttttggatcctttacaaagtttttcagttgatgcacttttcgatgtcttctgccattgtgctgaactgaaccctgatcctaatgctggtaagtactagtagtatgtaaattacagttcattactaaaaaagagctcttcaacaagtcttgactgtcttgaattccccagtgcgcaatgaagagaatggctggtccggtggtgaaaatatggctgagggtgggtggattcatggtgatgaagacatgattgatggtaggtatgcatgatacattttgactgcatttgctgttgatgttcattgtagctgttgatacttcatgcaggaaatgatcttgaagcccacatgttctttacgaacttgataggccaaaatggtctacatgaccttggtcgttctgtacgtgaggtatgcactgaattggttaatgttgtcaagtttagcacattactaggtaacctgatgagagacagttcctggttttgttcagctgtaattttaatcatttattgatgttgtgctaatatatttattaagattgactttttttttcttttggaactccctaaatctttcttgttagtatatcaacaatgttagtacttagtactatcattcaaatgaacaggattcctttcctattaaactgtactgaatctgtcattgacattatcgacttgcatcatatgaacctagaactgtctttgtgcgagtgataaacttttctgacatcgttggttttttgctgttgcagcttcaaattgatgaccagcgtttcgaggatgctgaggaagaagacgagatccaagaaaatggacattagaagcagaatgttcattttacttgttccgttccttgaggggactatgtcattggttcgtctgtagattaccactgatgctgcttggttcgcaatacttgcttcttctacttcctttccctctttcttgttctataggatcaacatctctagggagcatcgatggtaacttttgtgagaaaaaggtcttgctgctggtcaagaatgtaacttgtagagcatgatggtgaatcgagtgaaattagttcgatacttttgatctgacagataggaggggaaatcgggaaaagaaatatgttctcttttcccttgtatatcatggcactgttgtgttatcatttaggatttaaagatttaaatgccaaactggatggaattgggacatatttctacctttccctatctttacaatctgaaaacaccgaacgacacccatgtcaattgtcatgtgaagtcgttgcttattagttgtcccgaattattaacctggccccaaatttctgagcatgtaaatagcacgtcccgccaatagaacttgtaacaaaattgttgacggacgacgagatgaaaatgtgcaggcctctatatagtgcttgagaacacactagcataatacggattatgattcaacttctcttcagactaacaaatcaattatgtactctttgtgcgatgaaacaaatcaattatcaattatgtactctttctgcgatgttgtgaaaaagaagatatgcgttatgcgatagcatttcctttcgcgacttgcgagttgtggctaaaaaaaatagtatctcaagatgaaccaatcatcaatgaacaagtatgaaaaggaaagagaattttctaaagcgagaagggaaacatgctgggctggtccaaaactgcagagcctggctgcagttgggccgagacgagccgagccactagtcgcatgtaaatactcgaaccaaacgccgaaaccctaatcgaagccaccgacgcctcgagcacgagcagccgaccgagacccttccgcaagagcaacatggctgcggcggcggtgtacggcggcataaagggcgggaagcttggcgtcgagaaggcccacgagctgcagctcaaccgcattcgcatcaccctctcgtccaagaacgtcaaaaacctcgagaaaggtaagccagccggcaaaacccccccaccacagcttcgactcaatctcgtgaactgctcttaattgggcaattggtcccgtcgctttactttgcttataccgtgatactccctccgtttcacaatgtaagtcattctagcatttcccatattcatattgatgctaatgaatctaaacatatatatctatatagattcattagcatcaatatgaacgtgggaaatactaacttacattgtgaaacggaggaagtagtttactagtcactgtgcacctttagatttgtatgagaactgtatatagttgactggatgtgcttttggtctgtttgtcaagttgtggcatacggtgttgtaaccgctgaattatcggagcaatttaaatcttttgtatatctgttcatcaatacaatatggttggagtgtgggagagccgattggcgaatgccgttcataatatttgctcctgttactcttcattgcaaattggaccaagctgttatacccaattttgatatcttgtgtattgctgaacattttgtctgttgaggtgtgtccaatcaaggattgggctagtcaagttgggactggtctttgggttttcctcaccgtcattgtgaattgtgatcgaatatgctattacctcctatgtaatttggtatgatatactataaaaggtgctctgaatttcttcccatagacttgaatttgtcatctcatatatctatgtatttgcagtttgtgcggatctagtgaagggggccaaggacaagcagcttagggtaaaggggccagttaggatccccaccaaggtgctccacatcactacccgcaagtctccctgtggtgaaggtattgtatttctatgatt

SEQ ID NO: 79668 - DNA, 7913 bp, Oryza sativa
attcctgcaccccttttagttttaagtcttctcgaagtggtaaaatatccccaagataacctactgtcattttattctttacatcgtagtggatgacattttatctaaacccagcgaatagagtggcatattatcctttttctcccacctcactgcctcccgtatcccgaatcctactaccatcctccttttcgtcctatcctctcccagaccatggggatggaagcgccagatctaccggcccctccgaggtacgcgccactcgtcaaactccccttttctttttccagtaccccaagatctgtcaccaccgcctgccgccaagttctaaacaatgcaggattgaggtggagaactgcttctccctctctgaaaatacagggtccatggtggacatgatcaatgtcgcggcacgatgtgcctttttactttgtgcaagtgagatttcatatgatgttggagaacgctacaatttcgcgagcattctgcttcatttcagatacacctgttgctcactgcacaaactcctggtaattcccatggcatctgatgtgttagtagtgtggtatgatgcttcatgaatttatactagtactaatgtgctagtgttagttatagaatgtttattcatcacccggttctttccagaaaatattgtacagcttatacccaatcttatggcttgttttcatctggagtgctcaagcctcaagggacatacatgtattactgctactaccaccacttaacaagttacatactcattttcatctgaatcacaattctaatacttgtttcttatgcccagtcaacactaacttaaaccagttaccagactgaacattagataacaaatgtcccagctcccttatcatactagtggttaatctctcacacgtcatattaacttagaaagatgctttaaatgataaccaagtattacaactggtgcctgatactctgatagaaacctttgttacattctaggactcggataaatgacatcatctattatcaacaagggataactcttctgtagtaggatatggatatccatgtgaggtcatcagagtagcaagttgatggatcatcgccatgatgctattgctgcatacggaagatgacctgatttatctataaatgatgcagtggtgctgatgaccaatgccatctctgcatcagtcaggtccaagtgaaagcgaaaaaaaggcttttcagaagacaagatcaagtgactggacggtcacaatgagagcaaactcgggacttatctttgccgtgatgatcctgataatgtgtggcgcatctgcagcttccagtgacaatgatgagctggtggcaccgttcgacacatccaatggcctgagaacgctgtgaacggccacttgggctgctaccccgggtgcttcagagactgtgttacaaggatgcctgaatgctgttctgtgaggaaatttgctgtcagcatggccgatctccttcggttcacgcatcagtaattcatctatttgcgttcagataacgttgtgaccatttctttcagtagcagtagcttgcgtcgctctccgcatgagtaatcttaagtctttggcaattcactgtaatatatactaatatgctcttccgcggggtcccccattttaattcttcaagccggcgaggtgtgtaatagattgggatggcctatggccgtgatctaagggcagttgatgtttgtgaattcagactgttcctgtcgatgtcatggaacgcattgtggacttgtgcttggttgtatgaggtgatgtttgattcactagcagtcactgttggttagatgcaaaaggataaatggcgtcttgcattgctgaccccttactggttgcagtccagatgtaaaaaaaaaaatgcagatgaacttagaagaccttggacaaggataccaaactttaatacccatgtgtgtcaattactccattctgatctgaagattgactttgcagtttgcaatcttgctaaactgaagatagctgtaagtatggtgaaagaaaaacaaaagctaaaaaaaagatgttgtccggactgccatgtgcattgtattctacaaggcggtttttgcagggagataatagaggtgcacacaactcgagtattctgaactctcgcatatgatgcaagtggcattcgcgagttacttagtgcgatgaccacagatctcgaaccaatgatccattttctttttataactatgatccaatgatctgcaaccatagatgtattcccatgttacctgatacaataagatgtgtcagttcatctatataagacatctacagtagtaagacgaaagggagccaacttctgtagaacagtattagagagggtcagtattgctcatacaacttgtcctatatggccgtcactacaacgggatcaaaggccatcgcggtcgccttcttgtgcatcgcctgcttcgcccttgcagcgggcgccgccgccgacgcgccgcggtggcttcacatcaatgccgcgcgcgtcggcacgagctgcatggagtgcgtcctctcctgcatctccggcgggggcctactcgacgtgtgccgttctctctgcgaggatttatgcgatgatccagaagccttcacagtcgtaggtagcagaagcagtagtcactgaaacatcgaatggcccatctctgccagtattcagattgccgtcgcagtatcctcaggtccatcttaacttgccagctctgtccgctattactggttttggatcctggatgaatgaagtgatgtatttgctggttctcctgtttatgcactgtcgcatcatggccgtgatgtatcatgtatgtgccctgttcgatgtgtgtgtttgactgacaatgctagatttgccgagccaaagatgcctccgacttgaccctctagaaaggcagaaaccaatttgtcactacagatctgcaggcgctgcatgctagcagcaccgtaatttacagataaaaaaaatatgtgttcaacctttctcaaatcactacagagtctgtaactgcttggctgatcagtttggatgcacggactcaagtcaatcaacatccattctgatcccagcgacagagccactacttggctgatcaggcaatttactcttgtgtttcaatagttgtaagaatcgatctactagtatcattacctggtcgagattcgagagacacgatgaataaatacgtagtacggcatagtgctcgaggccaggtagcagttgttcgacctgtgcggatagtttcttcagaaagagaatccaagaaacaggcatattcgcaggcgcatcgttgccaaccgcccggaacaaacgtcaatcaagtttgtcctacgaacgcttcactcctcgcctccccgctccgcgttcttgcggtggattcgcatcttgtgaaatgcgaatccaaccgaaggagaatcggttctacaaatgttcgctttcgcctgaatccaccacaattgcgtgcatgcccaactcgaattctacgaggaatcggaatcatgaacctctcaaccacgattacttgtcagttgtcaccaggcagataacaagcacatgcgtgtaacacctcaaaaacagattctgaaatgcgaattccaaagccaagtggctacctgtacatcgcaatcaccaggtcggttcaatgttagcagtgtgatcacgcattcacatatatgagacccgtgaggccgtgacaaacatactgaacatatgttggaaatatggtcataaatcgatatattttaatccaaaatgttaagacaataatcatgatataaacagtgtagtgtgatccaatgacaacatgtaacattactagtagcatactaaagacatcatgaacaacattatgaatatcaggaataagaacatagcagtaacgcagtaacatgctagaggcatcatgaatatcaggaacaggaacatagcaataaagcgctaacaacgagaacaggaacaggagaaggatataccctgagaatggccctccgctggattgtgaggcagaactgcctccgttggcattgttgttcgcggcaccggctccagctcctggcgcaccacctccagctccagctccaggtggcgcaccacttccgccatctcctccagcagcagcagcggcgccagctccaggcgcagacatggtgggcgaggacgaggacgagcagtcgtgcgggaagcactccccaaaaacctgatcacctgcctacccggtacgcagatctcaggcgaaggtgtggttccggaggccctgctccttccgatctctcgtgcacgcaagcgatcagaagcgaggaggcgagagcagcacaggcgcggaggaggaggaactaacacccgggaaagaaacagcacaggcgcggaggagaaggaactaacacccgggaaagaagcaagcggatcgttctgatcggactcacggcctccttatctatcaggagagaggcagtcatgggaacgtgggatcatggacgcgctgttgtggaggcagtcgatcggactcacggcctccttatctatcaggagagaggcagtcgtgggaacgtgggatcgtggacgcgctgttgcggaggcagtcgtgggaacgtggattagtggttgcaaaagagtagcgacgtgacgcacgcacgccagccacgcctcgccctcggcctcggcccggtccggcgcgcttgcgcgtgtggctttccgacccccacctcaaccagtcaacagggagcctccaataactccctatttaggttgagatattcctcgcttaaatcctgaggtggtattattatccttaacacttattatgggcctttgagatttaataggataaattgggcctagcccatttattctaacaatccccaccaaatttcaaggcttataagaaatgttctcaaggttgtgcctgtttgatataccagggttttggtggagactgttaagttgaacttccacctaggaaatgagctacatcagaccacaactgaacaatggactatgccttgaattgtcagttttgtgtgatctggtttcactcagacccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttggaaaagccactcggatcacattaaggcatgagccatcttaccatgcaggaaagaagagaagtacatcatgaaaatgagcccttttcaagggtctcttctctcagtcacataatagtttgtttcgccatccaaattcacgggatctccgatcacaatggacaggtttccactattgtgcgaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatatgcttagatgacttcatgttgtcctttgaactgttcactttaataatcactgtttgattatcacaattcattaggatagctggcactggtttttcaactaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccactcatggcttttatctcatcagcatcagatatccagtttgagtcactatacccttctagtacttttggatacccggtatagtgaattctatagctcatagtgccctttagatagcgcattactctttccagagcctgccaatgatcatctcccggatttgagacaaaccggctcatcttgcttacagcaaatgagatgtcaggcctcgttgcactagccaagtacatcaatgaaccaatgatttgagagtatctcagttgatcctttgctattcttcggtttttccttaatagcacactgggatcataaggagtaggagctggcttgcagtcactatatccaaagcgactcaaaaccttgtccacatagtgggattgcacaagtgaatcccaccctcatatcctctttgtagtttgatgttaagaataacatcagcctctcccaaatccttcatttcaaaactcttggacagatagtccttgacctcctcaatcacattgaggctggtcccaaagatcaatatgtcatcgacatataagcacaagatcactccttctcccccaccatagcaatagtacacacatttgtcagcttcgttcataacaaagcctgcagatgtaagcgtggtgtcaaacttctcatgccattgcttaggtgcttgcttgaggccatacaaggatttcaacagtttacacacaattccctcctaaccttctattacatacctgtctggttgatccatatagatctcctcctccagctctccgtttaggaaagctgtcttaacgtccatctgatggacgagaagatcatgagaggctgccagagcaagtagtactcgaatcgtgatcaagcgagcaactggtgagtatgtgtcaaaaaagtcctcgccttccttttgggtataacccttggccacaagtcttgccttgtacttttcaattgtaccatcaggcctaagctttttcttgaaaacccatttgcatcctacgggcttgcacccatatggacgctcaacgacttcccaagtaccattagacatcatcgagtccatttcactgtgtactgcttccttccagtagtcagcgtcaggagatgaatatgtctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatgggcatgacagtttcttgactagaggtgctaggtgtatgtttcatgggaaattcattctcaaagaatgtagcatctctgaactcaaaaattgtaccaacatgcatgtcgggtactccagagtttactattaagaatctataacccataatgtgaatagcataaccaaggaacacacaatcaacagtgtttagtccaagtttccgctttttggctataggtacatttaccttggccaaacagcctcatgttcgtaggtatgagagatttaatttcttcctttctcattcctcgaatggtgttacttccttatgcttcattggaattttattcaggacatgacacgcagtcaaaactgcctcaccccaccattccttggaaagccccgcagtgtctaacatggcattcaccatctcagttagagtacggttctttctttcagccaccccatttgattggggtgaatagggaggcgtcctctcatgaataattccaaactcttcgcaaaaggatgcaaattcattggaaaaatactccccacctatatcagacctcaaccgtttgattttcctttcaagttggttttctacctcagctttatagatcttaaagtaatgcaatgcttcatcctttgttttcaatagatacacataacaaaatctagtgcaatcatctatcagtgtcatgaaatatttctttccccctttagtcaacacgccgttcatttcgtacaaatcggaatgaataagttctagaggtgccaaattcctcgcctcagatgccttgtgaggcttgcaaggttgtttcg

SEQ ID NO: 79669 - DNA, 21810 bp, Oryza sativa
  unsure (1)..(21810): unsure at all n locations
gcactaatatctctatccatcaagaaaggaccggatcgaaccttattggaccgcgagagcggcacgtggtagtcgtcgtcatcgtcgccgctgtcgtcctcgtccttcttggccttggaggcacccgcattgcccgccttcttggcccgagaaaccgcgagcggcacgttgtcctcttcatcgtcatcctcgtcttcctcctcctcctctttatacttgggggcggccgcaccgctcgctttcttccttccccgggcatgcgagagcggcacgaaatcgtcttcatcgtcgtcttcttccaccaccttcgggcgcctctggaccgctgcggcgccagcggaagcggcggcggcggcgtcttctccggccatcgctagggtgggggcgagggttttcggatttttcgcggctggaattgggggagaagcgagaccgcaaggccgagcgtgacgaggagacccctggctttacgggtatttgggctcagaacgctcaagctgctactttattgggctgcattctgtttaggtcctacacgaagcgttaggtaacatgggcctctcctgggaaagttctcccactagttacccttgtggcccatatccggatatgctttcatcaaaaggaataagttttgactcccttgactggtggtcgaatctaatccctattcatgatatcttgagccttaactattaaaaccgatattatttgactcccatgacgggtttggaggacggtttcattaacataacacctacgtgcagtgttgacttggtctttgcacaacgtgggatttatatagcattaaaactagaaaaaaatgtgggatccatatatcattcaaaaatattgggggacccactgacatgtgggtcccacaatcattcttcacagcttcacttattgttcctccctgtctatcccctctgtctctcctttcgacagaaccaaggctcatcggcggtggtggtggcggcgagcgggcaagagctcgggacggcagcaccatctctcccctctcccttctccaccctaggcgatagcctcggacggtggcggcgttgtcgacggagtagatcgcgaccacgatatttacagagtatggggatcgttggtaccatggtatatgcgagattgagataaaagagacggagacaaggattttatacatgttcgggccccttatccgtaagataatagccctactccagttggtcgaagccagtgttactcttattcatcaaaatcatacaagtacaatatttctgataacctatctagtcatcatcgacttagcggcatggaacaccacacatagtcaacgacgaggtagtcttcatcctcgaatacaaactcggcgagatcagacatagcgctagatccctcttgtcggcctctgtggcaccagattgggtatgtctaggcttatctctgatatcgatgtctggcggtgtgtattggtgtctattctgactgagcctcccctctcctcctaaggggtcttgtatttatacccccagatatcccctagtccaaatagaactagggagacaattatggatacaatccgagtaatccttataatttccatgcaggactctccttctacttccttatttgggaataccttccgtatatgaggcatgactccatatagacttggtatatggtggaccccgcagagcctaacccaaaatcattaggtatgtcttatccataacacttacgagcgcttcgcaggtggtggcgggtgggggctggagtagtggtggcgcgccccatggctggcggcaatggccgcagccgaggaggttagagacgagaagagtgacggcgacgggcgggcgagagctcggcggtgccacctctcccctctcccctctcccttctccacccccgacgatagcctcggacgacagcggaggtagaggagtagctcagcggtgttgcgaccagccgagtcacgagtcgacagcggagagcacctagccgagtgctctggggcaagacgatagtcgatagagacagcgatgacggggcaagtggcgacgagatcgttgaggcggaggtacgcagatgacgcgaccgacccaatcacgaaccctcgccatggaagtacacgaccacagggagcctctcatccccaccactagcgacagcggcgccgggctgagaggtagagtcgcagatttcctcccctctctctctctctccaacccttcttcctcctcactttcgctcccttatctatctatctctttctctctctctctcttcccctttgaccgggagtggggtatcgtggcgcaagcggaagaacgtggcggcgcggggtcataaggaggaggcgggaggtgatgtttgcacgccgcgcagcaaagacctcccgttcctcctgcaagatacgggccgcggagcccgagaggcggaactaggggtggttgtgcttcgccccgactgactccacgaaggcggcgggtaaccgtcgcaggaaggagatgacgtggtggtcgggggccttgagcgagaggcgcagcttggagaccacgaagatgggggtcggcgacgacgagaggaggccggccagcaacacgagtgaccggaggtcccgcgcctaggacagcatggggacggcgtcgaataacgtgtcctttccacaattccattgcatcttcacatccacacatgccatagatcagacgagcacaacgaggcgagctgtcgccgctcctgccgtcactgcctgccgccgcctgaaggggaagagaatggggagagaaagagagagaagggaaagagaaagggaggagaaagaagggaaagagagggagatggatgatatgttgggccacatgttcagtgggtcccatatattttttttgtgtgagtgataaataggtcccatatatatgtttttaattctaatgccacctaattgccacgtcaatgtcacgtgggatgaagaccaggtcaacactgccacgtaggcaccacgtcagcgaaatcgtctttcaaaaccgccgagggagtcaaattgcatcggttttaataattgaagggtcaaaatatccggtattatggtttagggatatgaatcagatttaaccattagttaagggagttaaagtgaacttattccccatcaaaatcaataaaatgttgaaccatactggcacagtccagcaaagtttcgtatccagataataacatctcaaaaataaaattcttttttgagcggtcaaaaaaaaatctagtatatgccaaccagctacaatactcctatatcatttgactgaggaagtggattcttggtgatgtggtcaagcattccccttagagcatcaccaacagtctatctattccattcccaatcctaattttttaggattttggttaaaaaaaatttggggcaacagattcccaaaagagctccggacgttttggagttcccatctccagttttctaggtgcatgtatttgagggcgagagaatgactctcaattctctttcccacgcgtttctcctctccttccccacgcgtgggcggcgtcaaggcaggtcgcgcgtgggagattgcgatctcctgcgcacgggaaaggaaaaacaaaactagaatttctattggaaatttaacataagaacccacttttcgtttttggaataaatttaggctatcttttgaagggaggggttttttcatcacctattttcagttcagaatacccaaaaattaatttttagagatagattattggtggactattggtgatgctatttaggcttgtagagttgtaggcaatgaaaggcactctgttgtgttgcaggtgcagaagatccggagctgagtctcgctttccctcacctttactcctttaggccaaaattaagggctgagcttaattagcgtgatccacaatctggcattcgattattgggctgccgcgcgagcccccaccagccgtgtcgtctgttgactactgagatggctctccccccttaatttacgtgtctttccctccacttcacacgttgctatccacggcggattccaaacgtgaaccgctctcaaaccggtttgatgacttgatgtcgtcgtttcattggtcaagaaactgctctgcaacgtctaattaaattcgcacagcgagtcagtgacagtgtgacacagacgttctctgcttccacctctagtacgtttctactctacccgccgctccgcggccgcgcgagtccaccgttccgctccacgcgcgcgcgagccctcgattcgtcacgcacacgcgcccgcgaataacccatttcatcatctcctcgcgcccgcgcgcgcggtggccactagcccaccactaccactacgcgctggtagttacccgcccctatcaccccgcgcctcggcctcgctcgctttcccctacttccagcgatttcatcaagaaccacctagcgagagcgagaccgagcgagagagagagagcacggcggcgatggcgtaccagaggggggagacgtcgtcggtggtggaggcgttcacgctgtcgccgctgccgtacccggtgatcctgatcctgctcatggtgatgctgctgctgggggtgtcgtggttcttcacgtacgaggacttcatggaggaggcggcggagcagctcagctgggcgctgctgctcgtccccgtcgcgctcgtcctcctcatccgctggatctcctccgtcgacaccttcgacggctacttcagcttctacccaaccgagcgccgctggaaccgctacgacccgggccccgccgaggggagctccccatggggcgtcgccatggtcgtcctgctcctcctcgtcctcgcctccttccactccaccttccaggacatgtggaagccctgatcattgattctactgctactcgtcgtctttgatatccgcacgcctattatgcgtacgtacgtggggttatacgctgcttgatttgcttgccggttagtaactagctagttatgcatctgtacatataccgagcttgagactgttaactcttgttttgtaattaacgcgtctggtttttgttcgggatcgagtttgttttctctgttcatccatccgtttcttcttctcttgtttgttgttcactcgtcgactcaaatattctttccctccctgttgaacgtgtgagattcttttcttttctttgccagatgattgatgctgctctcttcggcatgaagggatgcatctattccgttctgaaggcctcgatccttccttcaaaaacttgggtgacgattggtaggatcgagctgcaaccatactataactacaagaatcagtgaagagactacagatatatgataaatgcagacagtgcagagttcttttagatgaggctagagagttcgaacgcagggcaatcatcgcacttgttcgaacgttcgtttatctttctgcttggcctgcacatttttttagagatagaggctgtccaaagtttggatctaaacttcaatccttttttatcatatcaacctgtcatatatatacaattttcagtcacatcatttccaattttaatcaaaatctaaactttgcgctgaactaaacacagcaagagtataggttatttcctcaaggaaaaaaaagagagcataggctagggtaggattttgagagtcgagagctatgtatgatgtatctcctcagcccacgcttgtcgtgttgtccatcgtgtgctagcaagacgcggatgccgctttgacaaagcatggaggaagacaaaggcagggggtggttgggccgtccatatattgccgctgctgccgtcgtcgtcgtggcgtaattcaatccgatgcacgaaacctgcagcaatcagctgtacgtgccgcgacgtgcatacacgtacaccggaattggcgattcatacgagcgtattaacactgcccaaccaaccaccctttgctaattctcatcccgtccaggcggcgtgccggtccatgccgtcgtttatcatgccgatgccggccatcgtgcgtgtcatgcgttccggcgttttctcctgcactcgatcgtagtttggtgcgaatcaacgtgctgtacgtatagtcgatcgaaatcgtcgatcagttagccggtgcccgatgggcgatggcccatcgcgttgctattgccccgtgaaaatgacctcatctggcagcaggaatctcccgtacccgccggtgtccatcgatctgtctcctgtcaatcctgtgcgtgtccatcgaaacgtctgctgaaacagcgacggttttagcagagatactacgggtcgggtatgtttagttcacgctaaaattaaaaatttggttaaaattgagacgttgtgacgaaaaaattagaaatttatatgtgtataaaagttttgatgtgatgaaaaagttgaaagttttttaaaaataatttggaactaaacaaagcctacctccggacccggcctcgagagtcgagcaggtaccattgcctgtcagtgacgcggaccggaaggagaaagacgatgagcgatcgatcgatcgatcgagcagctagagggctagagctcatcatcagcgagcgccacgccgcgggcgcctgcatcaaacagcagcatatgtaagcctggatcggttgcccacttggaatgattcggagagagcaagcaaggggagcacgacaatgatgtggtgtccaccaaacacggtaattagggcaggctttttgccaaaagggctccggttcggttgttgccatgtcttcgcgaatcttttgggccgtctcggcctttttaattttctactatctctcatacagggtagtatgcctttggtggatgcttcatgtcatgctttcttttgacgaagccgcgtgcgcctgaccgacagtagtatgcatgtagccaaggaggactcttttattcgttgatgggaagtacaggattcctcgattgcgatcagcagcttacttgcggcaaacggaagaagcgtgccaaggaggcagcaactaaccggccgcaccaacttcttaccgctctttggctgaaaatttgacattttgacacttttgtacaacatattttacagctagatcgtggtaaaaaatttaacaaaaataacccttcatctcagtgtcaaatcccgaggcgccgaggtccaccatgtcaaccctaggtgtcttagcgctgagcatccaccgtcaaatgttcttataaaaccaaagaccttctgttctaagcatgatacaatggttttggtacttcttgtgtttctacacactgcaaagattcgaactttgggttaaaagcacgataaatggcaggagctaccaccgcatccgcaccaagctcatttccatcggaatcgctaattcgcgtgagcgccagcggcgcgcgtttcgggagcagaaggcccagcgccggcccgctggcgcgcgccgcctcctcccacgcttttcttttcatttttttaccgattttttttttcgttttttcttttcaccttttttattattatttttaatctttttaagtatgttttgagtttgaaagtttttaaattttgagttgaaattttttcaaatttgaacttgaaagtttttaaatctcgacttgaaagttttcaaatcttgatttaaaagtttttcaaaattttcaaatctggacttgaaagttttcgaatctcgagttgaaaattttcaaacctcaaattggaagttttcaaaattttcaaatctggacttgaaagttttcgaatctgagttgaaagttttcaaatctcgagttaaaagttttcaaatctgagttgaaaattttcaaaatttgactttaaaatttaaaacttaaatcaaaagttttcgaatctaacttaaaaattttcaatctgttagtaaaaaaatttccaaaaaattctctagaatcttttctaatttctataattagtgttaagtatatattaactaatagatatgtaattaaggcttaagaggggggaggggagtgctcgctagcagcgcttacagctaggagccccccatttatttaatccgtggaagcagcgccaacaatctcgtcgttaaaccgttgaagttcagtgttaggtaacctgctgttgacaagttcgtccttagcacctaacttcttggcgatgtttggtctattttttaatatagttaccacagtttaattataaaataagttctataaaagggttaaaatgtcaaaattgctctttggagcgtttgccggtgttggattaagagttcagctaaccagtccgtaccacaaaatcgaaccggttcagctatcagatcttgcgttctactactagcccttcagtaaaaatcggatcaatttacccctactgcaaattcaagccggttgcattgcattctctaaattaaaacatcgttaccgcccggtcttatcatattttcagagccgataatagggtaaaagtcagcaactagtgggcttcttagaatggtcctttcaagcagtctgctcttagtatagtaccaccatgcatgcaccattctctgctttctgcattctactacgtgccaagagacaacgttccacgtatcacataggagataaacgtaattttgtttttcgcgagtgttgtggagataaaatcttgtccacaatactcatgcatgatatgatcctaagaatctgtactagcatatatgggtttctcaaagaaaaactgtagcagatgtgtttttctgagaaaattaaggccctcatcgtttggccaattacatataattaatatgttatttggcgtattagcaaaattataacaaattatatataagactttcatatatgtgtttttagcaacttaaatactgataccaaaaataaattttgatgaaaaaacttcaaaatcaactttaaaattaaatttgaaaagtcaaattttggaagcggctgatgttgtacggagaaaaggaagggggcctaattctgttgtggatgtgtcatgaaaaactgtacatactgtcatcgtaaacatgactatcagctaggacgaatgacacatgccaatcaccctctatttgaaaatataagtatatctagtatataaaatttatctccatgtgatattttcatcgcacgtaaaacgaaaaaactcattagcataggattaattaagtattaactattataaaattggaaaatagattatttatttgattttttaaaataacttctacatataaatttttttgtcaaaaacatatcatttaatcccttatccttatgcctatcatccaaaatttaaattttcaaccttaaatttggagttgattttaaattttttttcatcgaagtttatttttcaacttttgcttttagatcgttaagagcacatatataaaaatttttattcataaactattttttgtttgtaaatatgttatttgacttattttctgaataagcgaaacgattggaacaaattgaagtttatagttgagaaaaggaaccgcacctaagcaatacctggcccacacctttaataccttttcagtgtatatgttatgttgtaaaccgttggatcacagccactcgatggatatcaggcattcccaagcattctactccctccgtccaaaaaaaaaaaggcaaaccctgagttttcgtgtccaactttgattgtccgtcttatatgaagtttttttataattcgtattttcattgttgttagatgataaaatatgattaatattttatacgtgacttgcttttttaatttttttcataattttttcaaataagacgaacggtaaaacattaggcacggaaactagggtttttcttttttttggacggagggagtaaacatcttaccggccggtcttatcagaataatagcagtgtttgtatgcacttgtactactcacatgacataggcgataaattaattttgtttttcgcgaatgtcgtgcagataaaatctagtccataatactcatgcatgatataatctaaaaatctctagcatatgtgtttctcgaagaaaactgtagcagatgtgtttctctaagaataatctgttgtggctgtgtctaagagatgcagacaagtcatcaagaaaggcaaattaacgtgcaacgtgctggctagaccgccagagtactagtactacctctgttctaaaataagtgtagccgtaggtatccatattcaatgtttggtcgttgtcttacttaaaaaaaatgaaatttcttttttaaaaaataattacagataaaaaactattcatattttaccatctaataataaaaaaaatactaatcataaaataattgttaataaaataatttttaataagacgaacggttaaatgttggaaatgaataatataaaattgaacttatctgaaggtggagggagtattatatagcacagagtaccccgcacggacaagtcagctagcccgacgtatcgttttaatttgcaccacaatggcattcttcctggtggcatgtctgccatgggtttgtttcatcctcctctccctgtacgtcttccagttgttcgccgatgcgcgccgccgccttccacccggcccatggccgccgaagcctctcatcggcgacctccttgcccttgggaagggcgaccagcagcaccgctccctcgcgcgcctcgctgaccgctacggccccgtcatgtcgctccgcctcggcacggtcctcaccgtcgtcgtctcgacgccggacgccatgcgcgagatcttccacaagaacaaggataacctcgcgggccggcccaccgccgacgcctttaacgccatggggcacagcgccaactccctcctcgggctggagcacccgggcgtcaggtggcgcgccatccggaggttctccaccgcggagctgctcgcgctcagtcggctcgccgagctgcagcccatgtaaggcacaaggtagagacctcgtcctgggcgtttcagagctcacgacgcgcgtctagccagtgcacgtcaggcgtgtcgcgctcagcatagcgttgaaattaaagtgtagcgccatctactcagtcgacttggcccgcgaatggacgaccgtgttcaggtcgagtggtgaaagaggccatgctactgatcggcgcggcaaaccttagggacctcttctcggcgatcgccgcccactacatacagggcgaccgtagcagggtaccggaactgttctccatcacgtaccgccaagacgaatagcaggttgcgcgtcccaggccagatcggatcgccggcaagactggcaagagcaacttgctaaacgtggtgctcgacatggagcgcgagtggcaacacaagggctccgtactaagccacgacgcaatgagagtattatttaccgtacgcacccgtcatttctatgatcacctttataatcgtacgtgggtagaagaaaggccgagtttacttccaactttttaactttttcatcacatcaaaacttttctacacacaaatttttaatttttctgttgcatcgttccattttcaaccaaaatctcaattttggcgtaaactaaacacacctaaagcctgcatgttttacatgttgatccttttataaaaaacttatatttcataaatatactttgagtaaaacttattttaatgatagacctaaaactagatgctagagccattgatatgatgatatcaagtatcaacatgtcgatgccaaggaggctatggtgtctatagcgtcgacacctggcactcattgcagccccaccgccatggctgctaaagtgtttggaggtcggctccatggctatgggcatcaggaaaagtgctacgcttaagtgctaaagtattatacataccactgttttttaatataggccacaattgattttttttaagttacttgacttctcatcatttatatagatatttatgaaaatagacaaaccatgctgctattgtaaaatactccctacgtcccaaaaaatacaacttcttcattttctttaaatataacaacctaggagatatgagttaacgtttatcactaaactagtctggtccgacactacacccatcccagacgacaaacaagtttttttttacaactctatctaatagctatgctaagagctaaaaaaaacagtactatattatggggaggatggggtaattttgatgataaatttagtgatacccttttcacttaactaagtaattgaataaatgttgtaggtcaaagtttgagaaaaaaaatcaaccatgtcatatattaaagcggaagtagtactccaaatttgatttcaggcacccatatgttatagaaagaggttagtgccaatattcctagcacctaacatctagacattcagcgtcgacaccactatggtaccataatgttatttggtactcctccgtttcaaaatttatcttaaaatatataagctttctcaaccaaataaatttctacatattttctaggaatccttatattttggatgacacgagtagtatttattatatgattggcatgttaatgattttctcgttttctcaattaaagtgagaatttatatggattcttttattactttggtgtatccaacggatacgctattaatagcgtaactagccaaatattcatacgttgcaagaaaatattgaaaatagcaaacaaaatctttgttgaaaaatatattattagttggttgaaataggatattttatttttaaaagacaaaaaaataccgtacttagaaaattaaagtgtcatggcctttccctcaaaaaaaagaaaagtgtcacggcctgcagcgagcaagcaaggcgagtattcaactatttatcacccgtatgtcaggatcctggtggtggcggacttgacaacatcactattcactactgccttttaccttttaatagtagtatataatactagttagtatagatatttctttactaattgaaagcgctcgtgtaagttttctcagtttttaatgggtgaatagctaatttagtccctcaagttttaccgaaggctcactttgatccttcaggttttattttattcacataggtcctttaagtatttgttttggccaaaaatcatcattgggcccacttaatatgccatatggctatttttagtcatcaattctattagaaaatatctcttttgcccttaacttgtatacaactatacactagaaaaaagaaaaccaaaatgaataaacaacattacatatgtacttcccattatttcaacatgtgcacatgaaaattgagcctaatggctatcgtatacacttgcaagtacataatttatttttgttttatctataaaaagaattcattacatgcaattttttctcttatatatatgtgaatgagggggtataagtgtcatttatcaaaagagttgttagttatgtgggttcaagtataaatttgaattaaaataaaaacttaaaggactaatatggacacattgaaacattaagtactaaactgatccttgcatgaaacttggaggaccactttaactattcacccgtttttaatcctagatgggtaaaagggctagaggtctccatcgttttctctatacagcatcagttgctgccaaaattaaattttcaaacccaattttgaagttgattttggagttttttttatcaaagtttatattttacattagcatttaagtcgctaagataaaagtcttacctataaattactattgttttgctaatacgttgaattgtttattatccgtatttggctaaacgatggggtataattagtgtatcgtatggttgctctaattaatatgtgagagttccatgcattcgaattttacataaatgtttggagtccatgacataaccaacaagagaataactaaaccaacgtgcgctatatattgagatagagtccggattggtcacataaagttattttaaaaatgtctacacatgtatatatactgcttcgtacgtactcccttcataaaaacaaactcaacttaaatggagatgtgactcattctagtaaaacaaatatggacaataggccgttttggtttgataccaaaacgttgccatactaattttttggtagtttaaatagtaaatgtgatgatttggtttgaagccaaatatttggtaatgcctatactcaatttggcacaattctagaatgttcttcaccacaatttgaaatttggctctcaattggcatcaatccaaagacatttatttataattctaccctaccaaaatattggtagtgccaaactaccaatatattggtaggtactaaaccaaacaagaccaatattctattcagatttattgtattaggattaatcacatatccacttatgttaaattcttttgggacgaaaggagaatctagcgagcatagttagaatgatatatggtttttaaatacatacacttaacaaacacaataacagagaaccttaaaatcccgtatattcctatattagaaattatttgaaaaattaaagcatgttatccaagcgaatacaaaggttgatgactagttccatctaatataaattgcatatctgaatttaaccaatataatctcaggatttatacggtgctggagccagtacgacctcggtattaatcgagtgggcaatagcagatctactgcaaaatccagagtcaatgcgaaagataaaggaggagatcacaaatgtcattggcacgaatgcacagatccaagaatttgacatcgcccggctcccatatcttcaggccgttgtgaaagaaacccttcgtcttcgtgctgttgcgccattggtgcctcgcagagccgaggcaacgatagaggtccagggcttcaccattcctaaaggcaccaacgtaattctgaacttatgggctatcaaccgagatgctagggcatggaatgacccggataaattcatgcccgagagattcatcggcaatgacatcaattatctgggacaaaattttcagtttgttccatttggtgttggacgacgcatttgccttggattgccactagcacaaaaagtgatgtaccttgttctggggacactggtgcatcagtttgaatggacccttcctgaagagctcaaggagactggtatagacatgacagaaaaatgtggaatggtgctatgtctcgcaaaccccctcaaagtcatggctaagaaaatgtagtgaaacacttcagtgaagtattcaagagtaagcacatttgccaaaattgatatgacaccatgtgatcgagcatatgtactgttattagctgtggaaagtaagtgtgtgtatgaataatgccgtaggtgtgtgtatatgttcagtacttgtgtaacacaggagtacaaattcagatatatatctgaagagttctgtgggtactgggtaagtaaattggctggacccttgtagagggctagctcccaatatctagttcagttgaacataataaactcaatgcttgtaaaatagaaggtaaagtgaatgtattacttacgaataaatatgttgcaaaactatgcattatttgaaactcgcaatcaaaaagcaaaaataaaaatgggaccggctaatgattaagtcattagttgaagtacatattcctctatgatgttgagcgactcatacgattcctatatgaaaataccctggagactaatccactgaaatatcggaaatgcatgttagtaaagagcataatgttggacaaatacgaaggcgagtaacggtaatcacacacaaccacttattcagaatatgacaattaagctggagggtccaaacagttcaatgattgttcatctaatctgaaggctaagtatctatcagaaattgagtgggacacagcacaaaattctcaagaaagacaaccgcaaattctttggcggagaaaacgattgttcagcttaattgtcatattctgaatagagatttgctccggtctaataaaaagtacctcgaggtactggtacctcgaggtaatttttgttggacggaacaaatctcatctgaaaaacaattttcttcggtaaacagacattcaagcctctcatgagccaattaaggtgatctgacgactgaagttaccacaaatctctttcacacttctgtagtccaatagtgatatgttggctttgtaatggccacatatttcagcaattttattcattcctgggacgtcattatgtacactctacgtggtaaaaactaagattaactgctacatcatgggcacttggaattgccctggctgctcttcaaattgttgtagcatgggcactcttccttgttcccggacgtgccggatggaacgcacaagcatttctggcagcagatattgcagtacttgaggcatggttcctggcgctttgttgccgagcaacggtagtcgcatttctgtgggcattctgctcatacatcgaaggagagaaaattcagaattaaaagtaaaaggtaactaacattcttgacattttatatgagatggtacaagaagatatgaagccttccaaagagtctgttagttgagggaacgggaaattgcaatatttcataccttctatggagacagaaccttctgcaccaacctacattacaaaaaccataaattaaatcatcagaaaactaccagaagtccagcactcagaaaatactgatgttaataacttactggtcggtaaaagcctccattcgtgctccctgaaacttcagcctgaaagatatgaacacatctatattgtcaatatatatcttgggattgggaaaaaaatggtttttcacttcaaagaagctaaaagagaggatgtaggttaccacaaaagctaacgcgagcaagaggaaaatggtggagaaaaaacgagccatttcttcttcttactacttactggcttactgcagaagtggagagtgattcttgtgagaaactctgtcttcttaccggcatatatatactgtctagctgagcgatctctggcatatggaacgtccatagaaggacctgctaacggatggataaagaaaccgaaaatttaaacgggggttttcaaaacaaatttaagatgatagtaattgtacaaataaattaattggcaccacctcagattatcaacagagtaattgtccaccttaaaggcctgctaaatgctaatggatatatacagaaactgaacaaacggtagatctgaacaacaaatttaaattatagtaattgtctaaataaaataattgatcatttccaaattaattgcccacagtgtgattagtgtgaactttttatgtctaatttacctgctgatgaagagatttacaaatcaatacttagcggcttaccaggcacttaatgctttggggcgctaaaaacagtcttctaaaatgcaaattctattggagagtttgggcgcttattctaaaattctactatgcacttatttggagagtttgggcgctggaaaaatgcaaattccacacatggctagtcatctaaaacagggtctggacctccgaccagctcacgactagagtatggcaaaataatggactttgcgccctctgccatagagaagtcgaaacggctctgcatcttgttgtcagctgcaggtacatgaaaaaaaatatgaagcctgatagctgtctaggtgtcttaccaacagcttgacactagacaatgggagacgactcagaccgtaaaagcctggtgggaggctctaacaaacatggtagaagttccaaaaaggaggatacgcactctcatcctacttgtcgtttgggagatctagaaggaaaggaaccaatgaatcttcaagcataacgatgctatgttgtcagtcctttttgccaaaatcaaggaagaggggcggacatgggcaatggcaggagcaaggcgcttacatgatatttgccctactctatatagtgtactccctccgtactcgtaaaggaagtcgtttaggataatatttaagtcaaaccttgtaaatataattcatgaataactctcaagtcgttgagtttgaaaatgtaaaaattatatgaatagatttgtcttgaaaaatacttttttaaaagtatacacatcacttttcaataaatatttttatagaaacaagaagtcaaagttgtgttttggagactgtgtcgctgtccaaaacgacttcctttacgagtacggagggagtatagagcttttccccttttcttaacctaagggttatatttttctcctgccatatttaatgaaaaggcacagtctcatgatgttttccctttaaaaaaaggagatttacaaatgcacaaagtaaaaaatatatatgaattcaggagtctcatgatgttttccctttaaaaaaaggagatttacaaatgcacaaagtaaaaaatatatatgaattcaggaaacaactttcatctctataactcaaactttttaatccccgttgaagtatttttcaggacattaaaatgaaacatactccctccgttttttaatagatgacgccgttgactttttctcacatgtttgaccattcgtcttattcaaaaaatttatgcaaatgtataagatataaatcacacttaaagtactatgagtaataaaacaactcataacaaaataaattataattacgtaaattttttgaataagacgaatggtcaaacatgtgagaaaaaatcaacggcgtcatctattaaaaaacggaggtagtattcacattcagcatgtactgaactaaaatttgagagctccaacaaaaacaataaatatatcaaatttcaacaagagctgaagcaacaatttactatctagatttcagcacatttaactcaaatttcaaaataatctcaagccagaatttgccaaattgcggatatatctttgacttcccccaaatccacccacctgctccccaattgttctacaagcaactgacatctataccatagactcatagtacatacatgccaatacacattgctgtgccctggataacattgcatatgttgatgatcgtatattgcagttctcccctactaactattaagttgtatgcgccatccaattcaatttaaaaggttaaaattgatgagagaaaaaaaaaggacaatgcacttattcaatattacataggcattgaaaattactgaaatatgggcctagtggtattggcattgctacatatcagtagttgtcattattctagcagtattgcacaggattccgactggttttctagataatctatagtgttattgttttctgtcatgctttgattctttctaaattgttctgtctgtgctggttttcagtactgctctaaaagattaacaacgtgatgataaacacacagcacattatcagacgttgggttattcagtatgttcagatcaatctaatttgcatgcttattagttattagtatcgattaactcctctctgtaccgatcgatgtttcgtgtttgcaatgagcagcgtactatggattgggacgtcatggctgaggtgtacaatccatgtggcatcagcgcgcacatgtcaatcacaaatcatataaagaacgatgcaaatgggcagagcaagcaagcgatttgataaatacaggtaagcagtctcttctcttggtggtcaattgttcaggatggaactactgtatatgtttggcacaatgtttagaactgatcacatgcagctgctatctatcacattctcacatgacctcattcctatcaaagcagcctgatacacacttggagctaatattactaacatagcatatcttaagatgttgggtaaatggacctgaaagacgatggaaactgtttaactgatggtcatcacaagttaaaaccttcaagacgacccaaagattcatgcctaaaattacagaggaatcgcagtagtgaaatcgtagggatatcagccaacatacaggcaacaatggggagaactacaccatgaaatgaagaacaaacagtttttgatttgagatcagaattgtgctttcacagagccttggaacaatgatcttcagcaatacggtttcttgcaaaatattggtacgggggacttcggcaacatagtacaggtaatctggaatacatgggctcattttgctgtagtccatgtaggaatcgaaaaaactgtagctcataagatcttgaactttgtacacttcaatagttcaaaacagagcccgacaagagacctatattggtattttaattacgcataacaatcacctcagttgccactggcacacagaccttccagctctgatttgtcatgaatgtaatttagaaaactctcgaactagtgcatacaagtgttcagccagtcaacactatcaaaagcagaaccatgcatttggcagatcgagaaacatgatctagagtcacttggttagaaagctagatcagataatattgattgaataattctaacccacttcacaaaagatagtcacgctagcaatgatagttatgaccagccaaagagaactacattatgatcaggttagtatggcctgataaactaatctattaaattcaataccatgatgtctgctacctcctccgtttcacaatgtaagtcattctagcatttctcacattcatattgatgtcaatgaatctagacatatatatctatatagattcattaacatcaatatgaatataggaaatgctagaatgacttacattatgaaacggagggagtaccacacagcatggaagtttagttcatcacatcagttatagccacaaatgaaacactagcttttgaaataaaacatacctaatatcagaacaacgtacaatatgcagtaaatacagaccgagcatctataaaagtaacatgacaatgcaaagtacagagagatagcaggttgatcagagctatttcaattgaacaaacgaaacagtcatggtgtacttccttctctcccgtggtacaaaatgtcactaaaagaatctattatagtctttgcaactcacagcctgccccagaacccaacccagttcttcctacaattgtcatcctaagaaccagctaatggaactaggatttgaacgctcagctatggggaagccaatagagtggaagggttttttcaatacaagctaattaatgatcgttttgtttcacttgaaggacgtgctgagcaaaacgagcctctcagacctgatgagttaagcactggatctagaacaatgatacacaccgtcagaagaaggccatgaagaaaatgaatatccaatcatcttgcactgcttgtgttgccactccgacctcgcgaagacttgctgttgctactgccatgctgcttctgcttaccagcaaacccaggcatgtagtactcgagataccaccgcacaaacttcttaacccctgtttgaagatcagttgacggtcggtacccaagctcccgctgagcaagactgatgttagcatgtgtatatggcacatcaccattccttggcatcttgacaatcttcctcaccgctttcaccttgagcaacttctccagtaaatccaccagctgtgtcaccggcacaggagatgtgttccccaaattgtatgtcctgaatggtgccggccctcgcttcttgcctccactgcctgtgctacgcccggctgtatccaatgccccaacacaccccttcacaatgtcatcaatataggtgaaatctcgggaaatggggggctggtgtgtgcctccacctgcactttcatacacggtgattggccgaccagcgggtacaagtcgaatctcaanttcaaaggggagcgt

SEQ ID NO: 79670 - DNA, 17006 bp, Oryza sativa
ggtctgaaaggagaacggtattaggactatggacatatgatggtgtcgatgtcgtctccagaaactccttgtccatgagagggcaacaatatttgaggaagccgggttcacagtttcgaagattgtctctcaggcggatagcatggcaaataggctaaagaaccctaagaaaataaacaagaagaaggataacaaagccaattcatctccctccacagatccagaatcttcaaatccagttgaggctgtagatgcttaaatgatttctattcctttctaggacaggagttcccgaaggtgaattaagttctatgatgttggcatttggtcagttgaggattgatatacagagccataggttgcacaatttatacttgttcagacttagatagcatgctgctctccgcacaagtctttttttttttccctgggatcatggattttatgtagtcttgttgtgggcttgtaacattaacctatggcttttatgtactcaatgaacttctaccactatggctttggagtttggaccataagtacaattttgatagtcaacttgatgaggagtcagtactgaagaatactcgttgtaatgctgttatggctgaacttctgaaaccggcatctcacagctttgttatgcctgctttgaacacaggaattttacattgattttataggaataccacaggaatcaattgaatcctcatggtaaattcctgcacttcaaaggaggccatatctgaccatctcctaagttatttctgcttgaaatgaacatgagcctccagaccgaaactttaaccttaccctgtttggatgtatgaagtaatcaatcactctgctctgcatgctgaagctaatattagactttatgatgtattgcacaaaagtaagtaaagatgatctcaaatgccagatttgtttggcacataaagatggtgtactcttttcaacccaaatcatgggatgccatctttgacataaagtacaacctttatggattaatttaacgaaagcatctatatgaccacttcatattaataaggtcggttgttaatggtgtgcttaaccagaattgggaaagaggaagcattttggtctaaatgtgttttgtttgctcatgcattttggtctatcagtgccaaaccatgtattactccatataactacctctatctacttcaatcgaaggccaaatccgactacctacaataaaatgtttactaacccctgaactttgataatggtacaaataattccatgatggttttaaagcaatttcgccaagctaactgcacgtgtgacttcacaatcaggcaagttaaagtggcacccaataagacatggttagaagagaaatgtagatgagctaaatatataacttattacaagagaagaaaaaatatatatttccattgatatatgctaactctaaatcaagagtagtacaatcatcattagacaatattgctgttgccccactacacgctgcatgcattgcactatatataccaaagtaccaaacaaaaccaattaccaagaaaatcaaaatcagaattgaacaagttgtgcataccgaatctagtttaagttattcaggttgtcaggaacattcaattacacataaaacaattcaattcatgttaaaaaaaaagcactactccctccatcctaaaatatgtgctccttctaacattcaaaagctaaattatgaggtgagaaaaatgaccctggatgtcacttattaaatccctagattattggaagtggaagggtcgttgggataagacggggagaaatttgaatagtgattgatgtgataaataatacaaagagcattctttccgaacaaattttgaatccgaaaggagcaattattttgggatggagaataattgaattaatagtaaatttcactttgaactatctttaataacaaagtttctccatgaattaaggttgctatttgttactgtttggacctgtctgtgtccaaaatgtcaccagactaccacaatagtaatgatttagcccaacaaatttgagacaattagtggccgtccattattgcgctaaaagtttgcttgccaataaatggaagttgtcacttccagtaaaaatatactccaatagaagttgcatcgactgtgtcattaagccgacaaagcagcctctgggtggaggtggatgctactcctacaaagatggatatgtggcacccccttttgttggtctttggaaggaggaacaagttcatgtctcactagctaactagctagaatgagttccaattattgatcatgcatattgtaatgtggtcacaacctatagcttagactctaccaactaaatgcaccatgcttgagcgtggccaaatatatttctcaccagtcaccccagagggccagagacccaaacgtgtgatcggaatgtctttaagttaaacttttaaaacttttaagtaccaatatatttttaagtacaaatttgtattaatttatctcaaaagatagatttcataatgtttattaggttttgcaaatgaattgcaatagaagctagccgcaaacgctaattagcgactagtcccactctctttccaatttttttctctttttattgaatttttcttttcttttgggctccccctaaatttatggctcaatccgagatagctgatttcttgtgtatgatttttttctatacaaagtttcaacaccagtagaaagtttctatatgctagtacaaagtttccatattgtattgaacacggcctgtttgcctttttcatgtgctgttcaattttttctagatgcttatgtatatatacaaactctgtatattatgcgtacaaactttttatgtctaaaatgtatacgtgtacacaaactttgtatattatgcgtgcaaactttttaggtttaaaatgtgtatgtacacgtataattttatttgatattatataaaaataccccccccccaaaaaaaaaaaccaagcacggggagaccataatggggtgcacatgaaaatctttttttacgtccatgagtaacatgcatggcgtggagaacaattaattccattgaagaagtgtatcgatttttcacttttgctataaagtagtatatgataaaatccttatttatcatgaaagttgacttcttattcttaacatgaatcatgttttggaaaataaaaaattgcgtgaaaaattctacaatgacaaataaggaacaaaatatattgagaagcgcagcatgatggtaccctgcaattaattaatgatgcaaaatttcatctcatagtcgtagtacgttctagtattaaaagataataaagatgaattttacatgattgtatataccttgccctattgaacaaatatttttcccacaataaaaaagagagataatttaaatatactttttttgtgtatttgaagcacgggagtaccaatctttttggaacttaattgtatatactccatccgttccattttaagtgcaaccataaattttcgtgcctaactttgatcgtccgtcttatttaaaatttttttataattagtatttttattgttatgagatgataaaacatgaatagtactttactcgtgacttatgtttttaaatttttcaaaaacttttgaaataagacggatagtaacgcgaaaaaatcatagttgcacttgaaatgggacggagggagtatattagaagtgctctcccatgccgtggtgctagctagaggtagatctctctttatcacacctacctagcttagctgccttttatgtcttctctgccctgtcattttactgtcaataatcgaaatcgaaaccaatcacactcgcgaccgaccgacgccctagcctagccactgcacgctgtttccaaaaagaacggatgaactttttgatagatcatatcgatcgatcattaattggtccatcttttacgatctcgattgattgattgattattgatgatctggttcgttgccagatgatcattcatgcattatgcacgtacgtacattggcggagccagaaattttctaagcctagggcttgagtaaggctcaactaataagatattggctttctcaaaaacaatacaaggtgatttaaaaggatttaggcatgtttatggaggcaagcctagggcacacctctgcgtacgtatgttctgaagttgaagacaacttatgtatgcaaatatttaatttatgtattcttaattcttgcgatgtttcatttgtcacttcttaaaaatacattttcacatgcgcatggctataaagccattatttctaccggcgtttaattaccaacccgctgatggctccgctattttctttgagggaaccgtctatggaaataaaattttcccatttcaaaatatcatatttcacgtaaaaaaaaaaaactcctaacaccccatatgggttattatatgcccacgcagttgcaagccacgagtcatgcttcctgtagtcttcaacaattgaacccacgacctcaagtctagcatgattctatattaccatcgctctcatactcacaaatgaatatcaaaacgaatatttggacccaaaataatttgaaataaaaaaaattcaacttcaaagttgtagtcttatccagggctataatttttatataaagtttgtccagccttacatttttagatgcggtttcttaagataactgtatgcaaaaaaaacattttttcatgtgattttagaccacaagactacttgtcattatcacaagagaatttttctattattcacttttagaaatgaaaccagcttctttggaaaaatcgttttctaatagtgtttgcaaataccaatgcaaacacatgtatacatcatgctctttattaaagcagcagatcgacttggacatccattaattaattatctatatatctattatgcatgctctattaattccttattgactaagttttcgatcgcagcacacgtagatgaaccagttgacaagcaataggaagggaagggagattcgattttaggcgtgtgaagcttcggaatgagggaatctagctcgagcaattgtttatatgcacgcataagtgtataaatgtaacttaaatatatacttttttgtgccaaaagtaattgttggttttgtcttcggattaccaagatttgatcaacaattttgttataaataaatttaccatcgaagttgtttcacaattagatttatataatcaaaagtaatttacaaatatctaacaatcaaactaattccctttgatgttagcacttatataaaaatatgaagtttatcttctttcagtcaaactgagagggagtatcaactagctgaggaccaattactgatgtttgatgccaaactcatgactaagtgatgccgagatgtcaatgtcccttgatttgatctgcctgcatacacactactggtacagcttttgagagtgccaaagctccccaaaaatgatttttgaagctgactggtagtagcaactactcgcgccgtgcatgaatatgctctagggattagaagaaatagaattttgtggtgctaggcttattctattttactactttataattaattgtaacctcaattttttgtgtggctggcatgatcttcgaaattcacaagcatcacactaatatgtttttcttttcttaaataatttctgattgtcgaaacatgatttcggcaataataaaagggggtagcgcaaccaatgataatgacaaagacgctcatcagcatttgcatagtaggtcaaccgtcaaggtgaaataataagtcggcgaaaacataatcatccattagcaacagcggagatgtcagggccgatgaagcagaggtgctggtgacgatgtcagtgacaataatccatcaaattaatgttatggctattgtagatgcttcacttggaggagagttgatgttgttgtctaactcgtccaaaccgaaatatttgaagttgttgaagtagaatgtctgctccgaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatccggtggtgaagacgcgcagttgtgaagataaaagcaccagtcggcggcggcataaccagtcggcgacggaagacgatgatgtccatcagtagtggtagctgtataaccagacgtagaggtaagggcactagtcagcagcagacgagacgaccggcgatgaagatgtaggtgcccaacaacagcggcataataggccagccgtgtaggcggtgacaccagtcggcggcggatgaggcggccggtcggtgaagacgcagacgcccatcaacggtggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaataacggcggcataaaggccagccgtgcaggcggaagcaccagtcggtggcggacgaggcggccggtcggtgaagacgtagatgcccaacaacagcggcataaaggccagccgtgcaggcgaaaacaccagtcggcggcggatgaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacgggaacgaacgtgagccaacggtgaggacgtagacgcccaacagcggcggcataataggccagccatgtagacggaggcaccaatcggcggcgacggaggcaggccggcggtgaagacgtagacgcccaacaacggtggtgtgaccaaccaaccatataggcgaagacaccagtcggcggcgacggaggcaagccggcggtgaagtcgtagacgcccaacagcggcggcataataggccagccgtgtagacggaggcaccaatcggcggcgacggaggcaggccggcggtgaagacgtagacgcccaacaacggtggtgtgaccaaccaaccatataggcgaagacaccagtcggtggcgacggaggcaggccggtcggtgaagacgtagacgcccaacaacggtggtgtgaccaaccaaccatataggcgaagacaccagtcggcggcggcggaggcaggccggcggtgaagtcgtagacgcccacagcggcggcataataggccagccgtgtagacggaggcaccaatcggcggcgacggaggcaggccggcggtgaagacgtagacgcccaacaacggtggtgtgaccaaccaaccatacaggcgaagacaccagtcggcggcgacggaggcaggccggcggtgaagtcgtagacgcccaacagcggcggcataataggccagccgtgtagacggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacgggaaggaagtgaaaactcccaaagcgaaaacgaagtcggcgactcatgaaattgattccatcgcgctcgttgataggaaactcgacgcaacccctacctggcgcgccaactatcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttgtgtcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatgactagtcggataaccatgccgtattttttccaatgttacaattctctattttatatttgtattattgtctaaatcttatatttttcttatttctctgttttctcaatctaatatttaggaaatcacaagtggatgtcttaagaaaagaaactagcggccactagttagcaatatcagcaggctatatacatgccatgtcagatctttggatgagttggaagataaagaagaggagagagaatcagagtgggcgactaaattagcgtcgacagcaggcccacagtacgatgcagggtggaccccacctgcattctctcccaatcaatacatgaaagaaggagatggtgggcccaatatggtaaataaaataaagttcatctctagtacatggctgtggattagagctaatctattgtacacgccgcgagcgaatctcgtgcaaccccatgctaagcctacgtaactagcaataatcctacttcttactgtttttactgattcttaatagtaaaataataataataatatacaaattgatttgaaaattctaaaatataggttgaaagtttttagtttggatttgaaagttttaaatttcaactgaaagatttacatgagttgaaagtttttaaaatggttgaaagtttttagtttggaataggatgtttcaaaatttgagttgagagttttcacatataagttgaaagttttaaatttgaaatagaaagttttaaaatttataagttgaatgttttaataaactagaaaaatgcccgtgcgctgcaatgggtgaatgctattttaatattattattgttattgggtttagttagggtaaaattcactgtgggaattcgcttggattttgtttttagaaaatcatgaggtggaattaggagtccgtcatctcaagttagcatgagagttttttaaaagtaatttcttatacgactcctttgtattttcaaaagcaaacgtgtttaaaatccaacttttatacgactcctgtatttccaaaagcaaaagagcttaaaatctaacttttatacgacttttttttatttccaaaagcaaacaagcttaaaatataactcaaacacggatatgtacttccaaaagcaatcaatcttaaaacctacttaaacacggacgacgtaccaaaataccggcaaaaacatatttaatatttataatagtagagaagagatgagttaaaagtttccaaaattatgataaagtgtaaaatttgaggggaaagttttaaattttgtgttaaaattttttaaatttgagttataaattttaaattaaaaatagaaacgtacacgtgcgccagcaacaagctagcgcatgcgcgaggtagcgatctcgaagaaacttgccgatgacatcatttcgtttgctgtgggcccaaggcgattgtgagccgaaagccaaaagcccaaaaacaaccgtgggcacaaaagccgagcccatataaatatggaaaaagtacaccggaggtccctcatcttgtcactgaattacaaaatcatccctcaacccaaaatccagatatataacatctcttaacttacaaaaccgagtcactttaggtctttaggtgattttgaacccggttttatcttacgtggcaactgagtcagcgtgggacccacatgggttccacatgtcaatgactactttctttcccctctctctacctctttcctctctctcttcttctctacctctcttcctctctctcttcttggcaaccggccatgcgggaggactgaggagcgcggctgacgacgggcggggagaggagcggaggtggagacggatgcggcggggcgccaccggcgatggcctcgccgtcgcctcgctctccgctctgcttgacgagaagcaactccagcgctcgcccaaacccaccctcccgagtacgctgtccggcttgaagttcctcgtcgccgccctgagctctgcgaacatgaagattcagaggttggggacctccaggatcctcccctccggctccgggtagagcgccccggcgacgccgatgactgcgccgcctgctgctcccagggcatattgttgctgctactgctgctgcttggtgatgcggctcatggacgagctcgaccttccgacggtgatgcccggtggcgctgcttatggaagcaaacacgttgtgtagtgccatgatgggactacgcctatttgctggagcggctgcttctgctgcgaggtttgaaatttgattaaaatatgttgtcaaagaaccaagggagaagaaatgccacaagcatttgaataccttgccagcgtccatggtggccttatgttggtgccctcacggtcgcagcagcttcagcctcctcggagccgaaacagtcccccatgggatcagctgggagcgaagctcgatcaaatcgagttgattattgttcgttacctcgctgcgtactgaaacttggcaagtaacacgcgagacgctagttgattctttcttgtcaatcagtagcagctctcgactcagcatcccgccaatgagagccgccgccgccgggttgggagcggtggagggcgcagcacccagggggacgcgtggccgagcgctggagtcgcctcccgtcaagcagagggagagcgaggcgacggcgagggcgaggccgtcgcctcgcccttgccggtggcaccgccgccgcgtccatctccccctccgctcctctccccgcccgtcgtcagccgcgctcctcagtccttccgcgcggccggttgccaagaagagagaggaagagaggtagagagagaaaaggaagtagtcattgacacgtgggtcccacgtgggccccacgctgactcatctgccacgtatgacaaaaccggggcaaaaaccgcctagggacctagagtgaccaggttttataagttaagggatgttatatatctggtttttaggttgagggatgattttataatttggtgataagatgagggacctctggtgtactttttcctataaatattgtgggtgcagacccaaacattaaagcccaaaactaaaagattgacggcccaagaactagcccagagaaaaattatggcccaaggcccacttctcatggccgctcatatctcctcgaccatcatctcccacctctctcatcggagctcctctcctcgcctccaatggcgctgctcttcccaccaccaccccacgcgctctcccccaaaccccccttcccctccactctccgctccacgaggtcactgcgtctccgccgcgccaccgccgccgccgccgccgccggggccggagtctcctcctcttccccctcgacctcctcgccggagaaggccccggcgctggacgtcgccagcgggaagaggggtggtaagaagaggaggtccctgaagccgagcttcgagaagcaggccatccgccgctggtccgcgagggcgccgtcccagcgcgcctccttcccctggcagcagcagcagcagcagcagcagccgggcggaggtgagggtgaggccgcgggcgatcaggaatccggttggagtgggagctccacgctgcagtccatcgtggattacttcgacttcgactacgattcctcggatggtgatggcgatggcgatggcgatggcgtcgtggtcggcggcgaagcggccgaggcccaggaggatgggccgcgtcccgagccgagcttccttctcgggagccggccggtgtcagcgccgtggatgcacggggaagaagagcccatgacgaaccaattggtttctgacgaggaagggttggatggggatggtgcttccgaggataagatgggtttagttgatggagacggagacgaagacgaagatttggggagtgaggaggagacgctaagtgagagctcagacggggaattctccgaggattatgcagcaccggccgcaaattcttcttctatgatggattcggtactggaccatgtttcttcaggtggtgggttttatagaggtactaggcggagtagcgtaaattcaattgttaacacaatgaggaattcgatggaggaaagtagtagaaatgctgcgattgagtgtcccgagaccgaggattttgtccagaagctcggtcctgtgctcctcccatgggagagggagggggatgtcgataggccgagaaagcgcagcaacacggagctggctgagaggactatcccagagcacgagctgcggaggcttagagatgtggcattgaggatgaaggagaggatgagggttggtccaggaggggtcactcagctcattgtggagagcattcatcagaaatggagggtggaagaggtggtcaagctgagatttgaaggacctccaagcctgaacatgaagagaactcatgatatactagaggtgcggttaccttttgctgtctcatgttttgttcattcacaattttttcgtggcgtgaaatctgatagttactttgttatcttgctcttatctatcaggagaggactggaggaattgtaatatggaggtcagggagatcagttgttttatataggggaatgaactacaaccttcgatgtgtgcagtcgtatacacaaactacagaggttaattttgataaaagagttagtagtaatagtgttgaacctatccatgttgaacataaatttcagaagtcaggtgcagatggactgaatcgctcagcatatattgtcaattcctctgaaaaacctacagagacatttgatatcgatagcttcttggatcagttgggaccgcggtataaagattggtctggtcgtggccctattcctgtggatgctgacttgcttcctggtgttgttcctggttacaagacaccatttagactacttccttacatggttaaaagtacccttcggaataaggaaatgacggctctgcgtagacttgcaaggcaaactgctcctcattttgctctaggtatttcagtgaacttatctgagtagcttttcatctaccgcatagtattcaatttgtcaattaatttccttcttttcacacttcatgcgtaccgtgtggtttagggagaaacagggaacaccaaggattagctactgctatcgttaaattgtgggagaaaagttctattgcaaagattgccatcaagaggggggttccaaatacatgcaatgacagaatggcagaagaaatcagggtaaaagatcatgataactattatcagtagtttgcctgtttgcattcctgtctccacagtgttatgtatgtgttgaatcaaataaacatggcattgcttgataagtagctattttgctgccttaattagttcttttgcttaattcacactttttgaatccttgaaatgtcaaatttctgagaaagctgagagtaacaatctgacaaagaacgcttaagaaatccactaatggactttgctttcttctcctctgcacttccatactaatttacctcttcgcctgcttgttcttgtgacgtattgaatgccttcttttcttgattcgatgcatgactgatggttaaccttgaaatatgatcattgtattagtttctcttgcacactgcagcctatgcatgttttgaatctgtgtaacggaacacttgcagaaattaacaggaggagtgcttctatcgaggaacaaggagtacattgtcttctacaggggcaatgatttcataacacctaaagtaaggcaagtcttggtggagaagcaagagcaagcaatcacttggcaggatgaggaagaattggctcggcttaaagcatcagcctcgatcagtgtcaaacccaaagtatttaaaaatcccccagttgctggcactctcgcggaaactagagaggcaaaatctcgatggggagattccattaatgctgagctcaggaaaaaggagaagaatcacatgattcttacaaaacatacctctcttttgaggaacttgaagagaaaattgattttggtatgctcttcaaaatgcatctctagaaacaaaagtttagtattttaatttcattactcatttgtaagtagcattttagctactttttcctccattgcacaaagatatctttgtgattatttgtgtaatatctactcctgtgcaggcaaaaacaaaggtcataaaagcagaaaaggccttggctaaagttcaagaatttctctctccagcagagcttccaactgatttggaaactgttacagatgaggaacgcttcttacttcgcagaattggcctgaaaatgaaggcctttctaatgcttggtacaactggcacttctcacttaacagttgtgatataaaatgcatgtggtgttttatgacttgtctatatgcattaaaattttctcaggaagacgagaagtttttgatggaacagtacagaacatgcacttgcattggaagcatcgagaattagtcaaggttcttgtaaaggggaagagctttccacaagtaaaacatattgcaatatctctggaagctgaaagtggaggagtgctcatttcagttgataagacgacaaaaggatatgcaatcattttgtaccggggtaagaactacaagacgccccaaattttgaagcctcgaaacctattgtcaaggagaaaagcattggcacggtctatagagctccaaaggcgggaggtaattcaagtgcaaaatctgattttctttttccattattttattttttgaactctatgtaagttgtatatgtatttaatcaattacatggtctaaaataatctagggattaaatcatcatatctcaaatctgcgagacaagatctggaagctgaagtctcaacttgtaagtcatttatacacgagttctctatgacagtatgacttatattttcttatagtagtaaacatttcttgatgatgttctcttcctatgtcatgaccatcaggtacgaatgcaagttgctggggaaaaaccagatgcggagttacttcaaacagttgaggctgatttgtctaaagatgacgataaaatagaggtaatcatgcatgaaaaatgctgagttcaaaagcactgctgcaaattacattttgttaatacacacttatagctcgcggtgtttggtggtgttgtgatcaccttcaaatgccggcacatcgctagtggttgacaggtagcttctgttgttgcaggatgaaggagaggaggcctacctgcaaacttacatcagtgaggatgaagaggaacctgaggatgatcagaatgaatatctctgaatcttaactggcgaaacttcggtgagtccgggagaaaagtcagtagtaaagcattgcatgttcatattgtgaaatttctgcagtgttactcaagaggcaggcagttttaagattcatctatggattattgccaacacaaattgacctgcaacagcattagtggcctttgtccattgcgagatcaacgacaaaggatgtagcttgagtgtgtgtggattgtggtgcatggtctgcagttgctgccattcctttttttttttttttttaccttggctacttccatagctccatccatgcctgatgccctgatggccttctacatcctgcagatttgaaaaggtttctgtcaacacacgatcaagttgtctgctgtgcagaagtttgcaaagtggcagtgtataaat

SEQ ID NO: 79671 - DNA, 5909 bp, Oryza sativa
ttggtttatttcaactcctagattcacctcaaatcaagctagagcccaccaaatagtctagctccaaaaaagaaaaatggaacggagcagactagatcgctccacaaaattgtactagcggcgtggagcagcattcccgtagctccacaactccaacttcaactcaatttcagaagtaacccgaaactggaaccaaaattacccgcaaatgcatgtaccgcttcccccacgaagaggagcgcacggtgcgggcgaaaaaagcggtacatcgcactactacaaaattgattttttatggcatcaccttattattttctctagcggttatatgtggaaaccgccagcgaaaatataacaagggatggggggttacaaaccgccagtgaaaataaatcttcactggtggcgagttaaaagagccgctagcaaaaacatagctattttcgctagcggactacttaaatagccgccagcaatttttgctagcaaatgtttaggaacgccgcctgagaaaataaattcaacatataaatacacccacctcagcctccctcctctctctctctctccgcctttctctggaaaacaagaattttcagaatataccaccgattacgcaccgttttcaggataggccactcaattcgcactacttttagaatatgccatttggatgcgaattttcttcgttccgtgacactcccgtccttccaccgtcacttcttaccggcgccagcaattccgtgacggagaaggaggagatgtcacctccggctcaccggccacctcctccgtagacacgcccgttcgccccaccggccattgccggtgagccccaccgtcgacggcggcggcttgtagccgagaggatctggtcgccgaggtcctacacgcgccgttccccgcacgcgcatctggagctcgctggcatgggggaggaggagcttgccgttgcatgaagaagctcgctggtgtgggggagggggagcttgccggtgtgtgggaggaggagctcgccggtgtgtgggagggggagctcgccggtgtgggggaggaggagctcgccggcgtgggtgggggagttcaccgctgtgggggaggaggagcttgcccgcgtggggaacaggagctcgccgatgtgggggaggaggagctcgccagcacgggtacaagagctcgccggcggtgcccagatgagcgcttgaaaatggcgcaagaggaggaactgacgccacgcggcttcgggagacggagtgtcacgaactgaagaaaatttgcgtccaaatgacatgttctgaaagtagtgcgaattgagtggcctatcctgaaaactatgcgtattcggtggcatattctgaaaattctcctctctccctactgctctctctgcggccttcctctaccactgccggctgccgtggcttccatcgccgccgccgcatccgtcctagggaaagcaagggcgagggggatggatccgctgccggcggcacgcggggagcgcggggcagccactgcccgccgcagggtctcgtcgtcacggtcgtcgccgcgggccgctgggaggacggatccgccgccgtcgagccgcggggagcgcggatccagcgctgccgggccgcggggtggatggatccgccaccgttgacgccgggcaacggggtggatggatccgccgccgtcgagccacggagagcgcgggatccaccgccgccagcacacggggagagcggagccaccaccggccgtggggcctcgtcgttggctgcgtcgcggatctcgttgtcaccgtcgggctgtggggagcgcggatccgccgcccgggctgcgagcggtggtgctcggtcgacgacggcgacaacaggtggtagcggcttaaaatttatgtggatttgtgtttggatttctgtgaatttctatggactcgtgcaacgatccgatccggttagtgtgtttggagatgggaacggaaatttgtgtgattgtgaatggaaatttgtgactgtaaattggtgatgtaaatttatgtggatttgtggatcgatgagtggatttgggattaatttgaactggcgttgacggaggcggacggagcggtgttgctccgtcattttttttagcctcggcaagtattaacattggcagctggtatagtctaccgcctgtgaaaattcattttcactggtggctagcttacaaaaacagctagagaaaatggattggtgctggcggttggctaccgccagcgaaaacactgtattatcactggcctttactcactggcggtggcgttggccgtcagcaaaaactcattttggccgccagcaaaaatagtttttctagtagtgtcggcagcacagcggctgtagtgcaggttccttcccctctctttccctcttctttctcttctcccctcatgtctcttccctctcctgtccatgagattttgaccaccggtggctcttgctacagacaagggtgacggtggaggcgtgaggaagcaagcccccatccctccccccctcccccaagccccaaacggtgtcccctcctcaaacacctagaaatcccccaattttttctttcaaaggtgcatgatttctgtgggatggatttatttttcggggtacattgaatcacagcaggtgttttgttctctatttctctttcaaggtgagatgataatgtctgtaggtgggttgggttgtatgcttgatttattacaagttgtttccacggttctatgacattatttcagattgatgcatatacttgtatttaaggaaaacatgatgtatccaaggatgtattttgtgatgacctagtcgttcgtattacaggataatgtattttgtggtcctgctacccgttattatttctaaacatttttattattacatatatgtcatgcaacaactaaaattttatcaattttactttaatagaaaaaatacccatgtgttgcaacgggtaaaaatattttttcagtgatacaacaactattaagaattgagcaataaattgcatgcctctctttgacttagcccacaagtgaagccacaggcccagctcgcacatacggtgcgtagctcgcacatatggcatcttcaacctacgagagacaatcacgtgcccgtatgccagagccgatcctccctatcaaattgggctgaatctttctcgatattccaaaattggctgagggtgtttgatccgctcgatccctttttatattttttttctcaaaatcggagtaaatccataacactcgggataaaaatggttaggggaagtcaccggtcggccatcattggcgaattgagattaaatctgaataatttaaagtccaattgaaagggaaaacgcgaggaaaataatgaaagataagtgtggaatcgattttttaattaattgaaggagaaaacatacggtgatacaaaccgacgggacagcgggacggaaaaaataatacggcggtaaaaaaacaacgaaaaaatggcgatgagaaaaaccggaggaaggctgatcgggaaaccagcgacaaaaaaataatacgagacagaaaaaaaaacaaaagttttatgtattttttaattagttatatatagatatgaattataaaaaaccaactaaaaatcgactcagaaacggatgacgtacgaagatcctgataaaaatattttcaatttttataatagtagagattaaattttaaccttccatacttatagcgttcaaatcattaataacaataacaactattaatcctacatcaaataaatagaaaaataacaagggtagcattttccatcaccctgggctagccaaacacttttagggctcctttggcagcccgggatcccaccgggatcccagcccattccctgggagaaaggcccgcgggggaaattgtcacgggttttattccatgtccatttggaagcccacgaggcagggatttcccggcccaatccgctaggaaaccctagggaaaggtccccgacctccggaggtcaggaatttttcctctctcgatccgccgctgcttctcgctcgcgcaaccggagtcgcttctctctcgcgcgaacaacagcgggcgccgccgcgcctccttctccggcgagacggccaccgccgggactcctcctccggcgagaagggtaagcccttctccttattcccctcctctcctcctcctgggtttccattctcctcctcctctagggtttccgcctcctctagttagctcccaatctcgctctccggtctcagcgcttgcatcgcaggcaccgacgcgtgggcgcggcgggtggcaccacggcagccggtgcaacgacgacgaagcggcgagccgacagcgcgggcacacggctccaagcaggcggggacaggggggatccaaggcagcgcgactcaccagcagaggaggcgctgaggcgcagatccgcctcctcctcctcgctgcgcgacgcccgccggtggttgcccggctaggtttgtgcgtgcccttgtagctgctgcttgattcttgggggttcgttcagtacttcagttttcttggtgtatgtatggcatgtttcttgatttggtttgggagagttataatctgttctcctattctttctaatacattgtagtattgtaccctgcagtagcatttcattttgttatggaagcgattcagaaggggatatgggtgggcgtgtggtgctcttgttttagatcatgaatgagttttggtaagatgatgttctaatttgatggagtaggttgtgctctggttttttctgcagtgtaattatcatgcttagtgcagtctaaatatgtgagatcaatgtgccagtcccaagaaatgaggaattatcacacatgcagtgaggatcattcaactagtgaggtatatgagaaattttagtctgcaaaccagtaacagtttttttctagttaattagagatgcagttcttttagttagatgctgtcagctctgttaacctagaggtagatctcagtactggttgagctgctagcatcaagttttttgttttttctggaggtattttttagtctgatccattcttgtagtctctgtcagggaactgtagaattagtggtcaatttagcatgcatgttgggactaaataaatggtaacaatcatatttttgataggaactcatacttactacaaaataaagtcttttatgctctatacttatacattagtccaaactttagtttcatgtcatgtatcaccagcagaaaatgagcaaggtggcattgtgcattcaaaaaacacaagctttggcagcaacctatatacaaagacacgcacacacagatgtttcaatctcctctctctcactcgctgcacaatacactggccaaacaaagtgacctagtagtactgattaattaaaacaacaactactactactactttttttccttatcatgtccataatgataattcataattgtgctcttgcattcttcctcttgccaggattcaatttgaattgcatgctcaacttactttcaaatatggacttgaaatagagtattgttggaaaactatcaatacaaaaacatggacttcaaatgcgtttgatttaaaaataatggtgtgtatctgcatgtagggtgtttgataccaagagtttgtttacgctgatgtagctgacaattgcaatatgttggttgatgtgcatgcatttttttacctaagctagtatcaatggccgtccttcaaatttgattgctgaagtatcactattttatatttattacttaaatttcagattatctttttcatcctggcagatttattagaatatatgaagatttgttgaagagatgatgaagaagatagaagagataaagatttaaatggacccatgtctcattcttgat

SEQ ID NO: 79672 - DNA, 9261 bp, Oryza sativa
cagggtggaagagtatgtttatggtatggaatctttacttgcacccatgtaccttgatttttacatgtagattgttctggtttgtttcattctttatctctgagtattgattatttgctacatatttttcaggtctttgcaacagcttcatatgatgaccataaaaatattgtactcctggcgtttgaaattatcgagaagattttgcgggagtactttccctacattactgagactgagtcgacaactttcctgattgtgtgaactgtcttattgcatttactaacagtaggtttaacaaggatataagcctcaatgcaattggttttcttcgattctgtgcggcaaagctagcggaaggtgacattggatcctcttcaaggttgaaggagaatcctccttctcctcgcttgaccaaggatggaaagcaggaaagtgcagttcttgttgataaggatgatactatacacttttggtttcctttattagcaggtaaccacatttcttgttctgcatgtaccttctgctgctttcagttgatttgtgtacagataatacaaataatgtgtccccaacttttcaaaaccttgcaggattatctgaacttaccttcgacctacgacctgaaatcaggaaaagtgccttgcaggtgttatttgacacattaagaaaccatggtcatctcttctccttgcctttgtgggagaaggtgtttgattcagtgcttttcccaatatttgattacgtacggcatgccattgatccatcaagtggttctccacaaggacagaatgtggaaagtgatccttcagaacttgatcaagatgcatggatgtacgagacatgcactttggccctgcagctagttgtggacctctttgttaagttctatgacacagtaaaccctcttcttagaaaaattctgttgctcttgacaagtttcataaagcgtccccaccagagccttgccggtataggtattgccgcatttgttcgtttgatgagcagtgccggatctgtcttcgttgatgaaaaatggttagaggtggttttatcgttgaaagaagctgccactgagacccttcctgatttttcttatattgcatccggagcttaccttgagaatgtaccaatagaaaatgggggctcttcagaaaagacagaagacgagtctcgaccattggaggatggcactggagaagcttctagatcaaggaacttgtattttgcaattggtgatgccaagtgccgggctgctgtccaactcctattgattcaggtatgcactattccttcagagaaccgttgtttgataaactagttcttaattgatctttttctggaagcatatttcttcatcaccctatgatttcctgatttttttttttcaaatctccctcctggtgatatggatgatttctctagtcactgtaggaacgaatttcttcattcagaaacaacagaactttgatggagaactatttatcaatcctatgaatatctatcaacttattttgttttcaagattgacatactggaactttcaagtgttattctagtttcacttgtttatagaatttattactacacctccactatagggtcttagtttcctagcattatcttttgcaatttgtacatgtggtcttcgttacattgttcttacattatccctgtttatatatattcatgctgttttgtaggctgtgatggagatatataacatgtacagagctcggttatcatcacagaacactgtgatcctctttgaggcattgcacactgttgctactcatgctcataaaataaacagtgataatgacctgcgatccaagttgcaggagttgggctcgatgacccaaatgcaggacccacctttgttacgcctggagaacgagtcgtatcagttgtgcttgactatcctgcagaacatttgcttggacagatctcccaatgagaggagtgtagaggtggaaagccaccttgttggcttatgtaaggaggtccttgaggtgtacctgagcactgcaaacccatctcagctttctggtgctccgcagccacttggtcattggcttattccggtcggttcttcaaagcggagagagcttgcagcccgggcacctcttgttgtctcaaccttgcaagctatcagtggccttggtgactcatctttcgagaagaaccttggccagttcttcccccttcttgctggtctgataagttgcgaacatggttcaagcgaagtgcaggtggcattgagtgatatgtttagcacttgggttggcccggttgttcttcaaacctgctgatgctgagccccatatctgttatatagtatatctccacatgtaagttattatttgctttattgccatttcttgatgttttgccattccccattttgttctgtttatcattctagttactgggggaggttgtctcttgcagagctgagcactgtagttctttttacattaatttcttttagctttggggagtgtatgttacaagatgactgaattctgtacggtagcttagttcaaaattgtgcccgttctgttggccaagttcaaagtagatatgttttgcattatgtaatttatattgttgaaataatggcagcttctgtgctgtttattcttaccctttaggatctttggcacaagttttgatcgactaaactagaaattctaaaaactatgttcaaacacacgaaacacgagtatagttcacttcagtttggacatatatccacacgttcctagcttcatcctaactagcgaaattccgtttgctacggataaaagaaaacaaatcataatatttcctaaaataaataaaagcgtgtttttcaacaatgttgcccaccttattgctacatgtgaatactcacttcaatttaatttaattttatatagagagaatatactctgtctttgagtttgtcatagttcaacgatttgttaggctgacaaactcaaagataagtatattctctatatgacattgtctctttctataatatactgatgaatttattaattgttttacgatatgctactggactaggctttttttaataaaaaaacaaaaaaaactcttaaagatatacaaggttaacaattgatttatctcattagaaataaaaaaataaattatgtggcctttttacacaacatgaaagttttttataagttacaagttatttttggtatttttaattttttttttaaaaaatctatttttgtgtgatatatgcaagagaaattgcttactcaaaagtcaaaagataatagccaaaaatatcttatgtagcatatgaaagttgatttacattaaaaataacaacaaaagcagtgtaagaatgccaattattttttttaaaaaaataatagccaaaacatatattttttaaaaaaataaatatgcaacttatttattaactttcatgttgtgtaagaaggccaaataaaaaatttcatattttttaaaacttttaatgagatagatcgattgttaaccttgaatgactacaaggatatttcagtttttttaagcctagtccaatgacgtgttgtaaaacaattgataaagtcgccggcatattatagaaagagacaatattagtggtaaattgttaaactagaataaactcattgatataaattagattctcttttatacatggtatccatttagatctagttatgtaatatattaaaagatcaagaggtaatgtgtagattcagtcgccataattgaagtttttttttaaaggagtataaataataataagcagttgcaatgtggttcaagtctgtactgtaaaggaatcttgcgttctgcgtgtttgtctagttcgtccagagttcgtccagattgcttcattctgtaattctctaattctgtatgccatgctcttcagacgctctgtaagagcgactgataatactagtgaagtttgaatatgtatgcttcggaatgatatacatttctgtttacgttggacgcaatgagttttgataatgcggatcatgcagaagataaccgttttccctgtacaggacgagaactttgcggagcagccgaatttctaatcagtacgttgcgtcgttgcattgtacagttttcagtttcgtatatgagagacttataaagcatttccctgtacaggacgagaattttgcggagcagccgaatttctaatcagtacgttgcattgtacacttcagtttcgtatatgagagacttataaaacatagcctaccccctttcgtttttacccaagtaaatactacaaaaggaagagccccaagccaggcagtgttggggcgccaactgaaaatagagcccatcgacacaatcgctacgaattgacaccaccaccgtctcacactcactgccgttgggagagatggaaaagagaggaaggagagagaggagagtccttaatatgtggagccaccatctcgttgctgttgggagagatggcgaggagcggaagagtccctaacaggtgggatccacctactgattcaacgagttaactgtggttaacctgccactttaccaggtaccgcttcccaaaccgaaaggaggaaaaaaaaggacatgtgcaagcacccaccgtgagttaccacgggatgacagctaggatgaaggccctctgttcacagtgcaagcatcgagtcggacccacagtgcacgactttaccaaatcaatccccaaactcctccctcatcacgcactctccggctccttcctccctccggtggcggcttctcccctctccccgtcggcagcttctcccctctccctctcctcgcggcggcggcggcggcggatcgagaaggccgaggcggtggcacgcgacgagctcggcgtcgtgcgagcggtggaggggaggcgacgacagatccacggtgttgtggaggctggggacgcggcggattgaggagaccgaggcgggagcggcggagctcggcgtcgaaaggctcgacgcgcgtggcggcggcggctcaagaacgggcatcgaggaggaagcgggcgaggtgagcgccgggcggttcttggcggcgggtgcgtccagcggttcttggcggcgggtgcgtccggcggttcttggcggcggcggctcaagaacgggcgttgaggaggaagcgggcgaggtgagcgccgggcgggtggccggcggttcttggcggcagaatgcgtccccggctgcctccttctcctctctcccacgccgccgcgcctcacctcccacgccgcggcggcatgccggggacgccgccgctgtgcgcctcgcctctccgtcgaccgtgccgcccgtgccactcgatttgttgatttgttgccgatttgctgccgtgtttgctgccgcgatttgtgtcgatttgttgccaagcatgggcggtgcgaggacacgagctccacagtgtagaaaagcagtcgtttcctcgcctcgcgagagaaggaaacgcgcgtctcaggttgggggcggggcgctctccacaggcgcgcgtcctcgctccacgcaagccagaatccaacgtggcccccatagcaccggtccaactgtgtgcaatgtgaagggcctaaggcctctcccactgcaagcacccatcctgagttaccacgagatgacacgtaggataaagagctttgaagaccctctctttacagtgcaagcaccactagtgggacccacaaatatctgctagtggggcccacggattcccacctccctcaaccggctcatcctcccccaaatccccaaatccactcctccccgctggcgccggctcttcttctccctccgccggcatggtggccttggtggcggaggcctccaagcggtggcggtggcggcggcctcgattgcagcggtggcgtcgtcctcgaagaagaagtggtggcggcggcgtccccaacgtcgacgagctcggcgtcgacctggccaaggcgccggccgggaggaggaggtgggggagtagatccggccggcggctcatcctcggcggccgcagagcccgctctccctctctccagcccctcacggcggcgggatgcatccccggcggctgtggctggcgcgccggcgggagacgtccccggctgctgcggcggcggcggccaccactgcccgcgccgccgctcctcctcccagtccgtcgcgcctcctcgcctcccacgccgcggggaggagggagcaagaaggcgccgcacccactgcacgcagcggcgaggaggaggaggaggaggagtagattcggcggttggccaccaccaccggcctcgccgtcgcgtcggctgccccgtgccgttactcctcgtcgcggtccacggcctgctgctgggacttctccggcgggacggcgatttcgcagattccatctcccacgcgtgcgctagggcatggcaactcggagacacgaccttcacagcgcaggcgtgggtcgattttcctccgccgcgcgtccttgaggtggttgaggaactcgtctcccaactaaggagcgagggactacgcagggacgcggtgctgcgcgacacgtcggcatttttcctagttggcaccagaaagcaacgctccacctcatcgcactgtaagaggcctaaatttattcctttcagcgtgactgacaaaactcacgcccaagtgcgcgtgtcattaggctgcgcgtgtgtccgccaataatttttggctgatctgggaggcacaggtctgatcggacggatgcagatcaccaaagggtgtcggagttttaaactccgacgttggtaacaagaacgcctttgcatgcgagaatgctaatgggcgatcaggcgcatcgtgcattcgtgcccgtgcctgatccctgctcctttgttcatggaggccttcctgcggcacggccacagcacaagacacatcctgcatcaatatgacactatcgctccttcaacgacgccatcagcgacgaggctgtactattgacagcaagaagaggccaccgcctcattcgtgcctcgcctgcgctggcgacgacgaggaattgctagaagtccgggacaccaacttcctacgaatggccggcagaaattaagtagggagtcggagccccgcaaaaaggggaaaaaaaacgctctttggaaagagcctatagctagcacctcggcagaagtagatgtttcagagtgattgtacacttaggccgtgtttagttcctcctaaatttctaactttccatcacatcacatcgaaaactttcctacacacataaactaccaactttttcttcaaactatcaactttctcctaacttcttaacttttccaccatctaaacacatccttaggttcaaagcaaaatagcccataatgcaagtcacctgaccaggccatggttcaaagcaaaatagcccataatgcaagtcacctgaccaggccattgatgaatgagtcaacacgatgttgtcagacgatgatctactaagggtgtgtttagttcacaccaaaattgaaagtttggttgaaattgaaataatgtgatggaaaagttaaaagtttgtgtgtgttggaaagttttgatattatggaaaagttgaaagtttgaagaaaaattttggaactaaactcggcctaaggccttgtttagatcccaaaaaattttggcaaaaaacgtcacattaaatgtttgaacacatgcgtggagcattaaatgtgggggaaaaaaccaattacacagtttgcttgtaaattgagattctaatcttttgagcctaattacatttgctaataacagattaattaggcttaataaattcgtttcgcagtttacaggcggaatctgtaatttgttttgttattagtctacgtttaatattttaaatgtgcgtccatatactttaaaaattttacacccaaagaactaaacacaccctaactaggtcacaaagtcgcaagttccctcagaacactggtgattcgaatttgtacaatggtcaacaagcacaacaaataaccttcggattaatccaggttaactgtacagcaagcttggtttgagcaaactacacaggttaattcacaagaggtgtgtgacactgacacacaaaccaacaacgattatcttcatgcaagtaagcacatgtacagtgaggtctcagtgaggtttcaaacacacggcaacccagaacactctagcgggacggaggtacggatggctaaacattctcacaaataaatctggccttaaccgctcgacttcgagcgaagaagaattattccagcaactgaaggcgtcacctcgaagaatacacaagtagctctacagaaaactcgtggcttgcatcatcccgtcattcacagtaaagaatcagcaggccaacgctagcatcttgcaagcagctttttttagatcttttccttggcgaagaaccgactgaaaccccggttttgtttctcgggcaattggttagaaattgaggaagatgatctcgatctatgctttgggcgcttggatccgtttggtgaaaggaaagggcttccgtccgcttcagagggggcattgtgtgtcttgtacccattcactggggattcatttcctgatgcatgcatttcctgatctgtatccagttgacctgttggcttctgtgagtattcaacaccttcggttgttccagccgcgtcctgcaggaaatcttccattcgctggtttggcgaggaacccattgattctgctggaggacgcatagattgtagttggcgaccaagaatcaatatcgtctcctggcattctgcaagtttctctgctgcagctgcgatctctttctcctgtcaacattttaaacgaatgtgctgtcagtgtcagtcaaatgcctggaatttccagaaaatatcagttttgcgcacagtacagttctaagtactcctgaaataagttagtatgaatctaaattcagcctattgatttgactagtaagtgatctaatagtatcatactttttcctgtatttacaaatgaaaatgtatagcgaaagcatttctacaagaataataataaacaacacatgaacaaaatgtatcagcagccctatctcgaagataatttctctatctaatatagcaacttgtattgttcaaaatcatagctacctcacatttaatttctctatctaattcctcatctcaacaaagcacaatcatcccccatttaatttcacatgtttccttgatcccgtgaaaaactccaaaagtgtttttttttagataat

SEQ ID NO: 79673 - DNA, 2217 bp, Oryza sativa
gtgggccccacccccgcggaggagaggggagaggggaggaaaaggagcacgtgggggtggggtttggcgcacgttgggtttgatttgtagggggtgggggtcgctgacgggtggggtccggtggtggcatgtgggggagggggtgtcctttctggcagtggcaggtattccgtgctggtagttgtgacttgtgaccagtagagtgaggtcgtactcgagttgaccgactgggaacctcctcttgccgacctcaatggtttttacagcaacagaaattttagaaaatcttacttccttcccctcataatataaataattttgtatttttttctttttgttttattaaaaaaaattgtgcaaatataaaaaacgaaaaattatgcttaaagtattttggataacaaagtaagtcacaaataaaataaataataattctaaaatttttttgaataagacgaatggttaaacagtgtaagaaaaagtcaatatcccttatgttatggggcggagggagtattatttgaagtcaaagttatacacaaccacgagtattacaacgcgtgacatataaacacggtttttcatggtctatgcgattcataaaattatgcatttattaaaatcttgaaagtagtgaagaggtaaactatcaacattagccaataacataataaattaaaaattttaaatacactcttatgttttagattttaaagtacaaacaaaggtgggattctgtgaaactttacaatcatggtattactatctaggattatatcctacaagccataacacttgtggttttctacagttttgacataaaacattaggttttctaaagcttactatatgattttttagagatgtatcggtgaaaagttggtttcaatctatcaaaaattagaatcctcttgctcttcttcttggtttctactggtggggttgagcactgccaactctcagtcgagagagatcccgcacgaaaggaggggataacgatggggtggtctacccttttttattttagggagtattatctcctgtataaaaagtacatcttttaatacttaaatcctcgataggggtttccaaaacaagatttacaatagagtttttggttggtgtgttttaaaggcattctcaatgtatgatgcttatatcacctttaagttgggcctctcgtaggtagttgctctgtccataaaaacaagttctaatgtttattaccagttgtcgacggggataaccgtagaccggatatagagggtattggggtacgctggtacgaggatctacgtaatacgacatcaagcaggcagaaaacaaagattatactggttcaggccccttgataggtaatagccctaatccagttgatatgggattatatgatgtaagccacagattacaaagggaaaagcggaactcgatgatatcgacgagatcgtagtcgagttgattcgactagatcacccggcgacttggctcctgtaggctccggcttcgtaggctgtggtggttgtcttggctatgagattcaatgccttaggtcctcccggggggtcccttttatatcgcaagtcgactggtctccaagtaggactcggagacatcggacccggcacggtacaatgatgacccagttctgtctaagtatgactccttccatccgtgaactccatgatgaattcctttaacgtatgccaaaaacgtccgtatacgcgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctattcctccactccatcagcctcattgtagaactcttcctctgatgaatgattgcaaggtgagtatatgacatactcagcaagccacgcagcaaatatgcaagtgcacaagataacaaaggatggcataatagggtttcatttgcaaaagcagcatttagcaaacatttgagaatttaataaaacagttaagtaattaaacaatattaatccaacgctatacaacataccctgttgtataggccc

SEQ ID NO: 79674 - DNA, 3626 bp, Oryza sativa
aggcggttatttggttctaagggtcatgtccgtctgcgaaaaaaagacccctatatttagaaaaatgctttttctagtagtgacttttcctctcgttgaaatcatcataggcgggagaggttcattagatcgatggatatattgtagctcaaaacgttattagcctcgatatatatctcgcatatcttagcattgacactactagaaaaaagaattttccaggcagcccaaaaccattttcgcagtcgggggagaggaccgccgctaccatatcgactgtgaaaatggaccattttcgcaagcgggcgcatggcccgcctgcgaaaatcatctcaggaaaataaaaaaaaaacacggggcgccgccggccagggctcccctccgtccgctgccgtcggcgccatcatcgtcgtcgtcgcggcggcggagggggcgaggagatgaagcggccagcggaggcggcgaggagagaagccggcggcgcgcgtcgtcgctcgtcgtggccagcagcagagggatgcggcagcgcgcggacgtcgtcgtggagggagccggcggcgcggacgtggcagatgagggagccggcggcgtgcggatctggagcggagggagccgttggcggcatcgcggtcatcgtcgtcgtcgaggagggaggtcgccggcggcgaggagggatgaggcggctcgcggacgtcatcgtggagggcgccggcggcgcggacgtgggagaggagggagctggcggcgcgcggatctagagtggagggagccatcggcggcgtcgcgggcgtcgtcgtcgtcgaggaggggggccgccggcggcgaggagggatgcggcggctcgcggacgtcgtcgtggagggcgccggcggcgcggacgtgggagacgagggagccgacggcgcgcggatctagagcggagggagccgtcagcggcgtcgaggaggggggccgccgacgccgccggcggcgaggagggatgcggcggcgcgtggacgtcgtcgtggagggcgctggcggcgcggacgtgggagaggagggagccggcggcgcgtggatctggagcggagggagccgtcggcggtgttgcggtcgtcgtcgtcgaggagggaggccgccggcggcgaggagggatgcggcggctcgcgggagtgggagaggagggagcagggcaacttttccaagtgtggggggagagagagaggagggggagggaaatgagtggtggagaggagaggataaagatggtggtggagaggataaggatgaggatgactagatttttttttggtaggtactatttttgcagacggaccacgtaaggtgcgcctacgaaaatctattttcgcaggcgtcgcttaagtggtccgcctgcgaaaacaggcggacagcgaacttcatgccgatttatattttttttaggcggtcatttggttcccagaatcatgtccgactacgaaaataaaacccccacgtcggggaaaatgccttttcttgtagtgtgatacccgttcaacacaaaacatatcaacattgtttcacaacaggtgtatatttgcgacatctctacctccacctctataactcctcatctctagagccattagcaaattaaacattgtatacacacgttctccaattatgggctcatggcagcatgccaccaatcaaagataaatgttgacaaatagctacgtggtttagaccggtacttagtatcaatactaatatatttaatacatctctacctactgaaatattggtaccaaaatatgccaaaaaattggtactactatagattatttggtaggataaagaaccaaacaaccccataatatttatatcttagaatggaggaaatataaaatattcttggtgaggttatatatttcatgattatctataaagttaaagactatatagatacactccctcgaaacacatgattaaaaaaagagaggaataaaaaagaatacataatgttaacaggaatgtaagtacaaaataaaagattataaaatatagaaataatcttttaaatatatagaccatagaaaaaacatggaaattggatgagagatatatagagtcaaaattttccaatcggttcaagctcttcctaacatgtctccgtaatctttataagtgtgtccatttcataagaattttaaagtaaagaatatgattcaaccctttatttcaaatactatagtaggatttttttttataagattaaaattatttttcttacaaatgaaagtgggcaaggatctcatactagctagtagttaagaagaacggagggcgcacatgttttttctgataataagggaaacacacgtccggcctctaaatcaaatatgcatgtattttttaccacaatttattacaagattacatcatcagttggtagattcctgtttttaagaataaacaactcattactcaataaaatccatagtaaatcaaccacgaggtcatgttactgaatctcaatccatagtaaatttttacgaggacggaggaccatttcaatggtgcgcaactaaaacgctggccgctgatataaaataatcgaatcctggccactggctgcacgtctttcgtggcgattggcgaacatatatatgtacagttctacttctacactccatctaattgaaaccaccggcagggagaagtcacttgatcaggtcaattaactgaatattagtactactagctggaattaatgttgactgcaaagtgattcgtccgaggatgagccagagcgacagccatccaccatccatgcatccatgatccatccatcgcttggtagtagttggtagtactttttttagaactagtagtagttgcctagttggtactccctccattctaaaatgaataaatgtagttttgcatgattcacatttaacgtttaagcgttcgtcttatttaaatttttttttatgattagtatttttattgctattagatgataaaacatgaatagtactttatgtgcgactaaatatttttatttttttcacaaatttttcaaataagatagacggtcaaacgttggacacggatatccacggctgcacttattttaggacggaggaagtacatggtagtactatcttcttcttcattgactctttttagtgagcatactcaccttttgtgatgtagatatttttttagtaataaactttattctaatatttgcttaaaatgcaattattacatatagaggttgcagtgtaaacaacaatgaaatataaaatcatggcttgattaaaaataagaagtctactttaaaataccacctaaagacagagatacacatggctaaactttcaaacaccggtggagaaacgatttttactcccggtttgcaacccccttagtcccggttttccaaccgggactacgaatccgggactaaagatcgctatctttagtcccggaaatcgatctttggtcccggttagtaacaccaaccgggattaaagatggagccatttttaaccccggttggtattactaaccggagtaaaaatgaagccagatccggttagtattttcttttttcttttattgttttttactttgaatattgatttccccacatcccc

SEQ ID NO: 79675 - DNA, 9173 bp, Oryza sativa
cttacattgtgaaacggatggagtatcttgtttgtcactttatcatgctataaacagaaaacaagaaaccattacaagcagtcttaattcttaaaccctcaatctccaaaatggaactgaaaacctcctgtttaaataatgaaaccgagcagaaagatgaatattccttgctcattagtcattattaaaagggcacctactcctcaatttctattctttgttatccatataaaacttatctgtaacaaacccgagaacgacaagggctgatgcatcgtcacgtacacaaattgggctctacaaatttcttggctccgtcaccgtgtccgtatcattagaaatcttacataaatactcgctccattttaaaaatatattacatcattgatttttttataacatatgattgttcatcttactaaaagaattatataaatattatttattttgttgtgacttgttttatcataaaataaaatataatcttaacttatacttgtacatatttataataaatttttgaataacacgaatgatacgaaaagtcaacgatgtacgagggaggtcctagtatgtgtgtgtatcattcttttaaaaaaaaactcactcatgtctgagagacgctcaatgattatgatcatccggatatatgatcgaaccttccgattactgcttgtttaggatatcatcatggactcgtcggatcaaacctcccctgaacaaattcggccggccggcggctaatgccggtcaaaaaattattatttcttcttaccactattcgactcgccgccggcaatcaccgtcatttttttttggttcttgcgacgtcagccattagctacttgggccttcgcaagttcataccgatccagatatatggctgcgtttagttcccttcgaacttccaaaaattccaccacatcaaatattttgacatatatatgaagcattaactgtggacgaaaaaaaattaattactcagtttgcatgtaaattgcgagacgaatcttttgagcctaattacgtcatgatttgacaatatggtgctacagtaaacatttgctaatgacagattaattaggcttaatagattcatctcacagtttattttgttattagtctacgtttaatatttcaaatgtgtgtacgtatatttaatttttatttttgaaaagtaactaaacaaggctataaataaacccacccctcgcggcttcgcttttaatttgctcgggttcttttcgcggctaaataatttgttcaaaccttttcgatcacgcgcgcgcgaatctcaaagcggcggaggcggaggcggtgatggcggcggcggcggcggagttccgcgggcaggcgcggctgccgcggttcgcggcgccgcggcggtacgagctccggctccggccggacctcgccgcctgcgtgttctccggcgaggcgtccgtggccgtcgacgtctccgcgcccacccgcttcctcgtcctcaacgccgccgacctcgccgtcgaccgcgcctccatccgcttccaggtaagtagaccgacctgaccttctcctcctcctcctcgctcgccgtcgatcgatcgatctcgccgtggttggttgcagggcttggcgccggcggaggtgtcggtgttcgaggaggacgagatcctggtgctggagttcgccggggagctgccgctcggcgagggcgtgctcgccatgaggttcaacggcacgctcaacgatcagatgaggggattctacagaaggtaaactttgcatttgaaaaaaaattcgtggtgatcgtagcctcgcagaggctaaatttgcgctttaatctcttgggaattctatattttcaaagataaattggtctaaacccctcaaggagatgtgccctcgtttgttcaaacttcatccaaatagttgttataaattctaaatttgttttgacaatgttcataccttatatatgaactaatcaagtcaaaactaagttcacatagtactagccaaatacctgtgctttgccacgaatcaaaacaaaccaatagtgaggtttttgggacaattttgtacctatagatgatatattgtacagatgaattatgatagaatcatatatttagagggattatcttataacattaaaatacatggttggtacaaaacatgatgacgtaggtagtaaataaaaaaaatactatacttggtaaggtggttgccttttttgagtataaattgctactattcgtatgtgacttgtttttttcgtttctcaacgtgtagatcgaatttgaatatgatttttggcggagtattagatgttactctatatttgctaatttgttttgcaaattttcacaaccacttgcattgaatttgagagaaaaaagttatgttaggggacatcccctcgagaactcatgatcatcgttacaaatttgaactgatcatcagttgattgatgtggttgggaagttcttatgaacctgtggactaggatttaccctctccagcaatgaatagttgtcgctggatattattcgcatccaaagtttgaccgctcacattttagcaacaaatttataaatattttcgaaatatactatattatgaaagctcgatgcatgctaaataagttcatacccttttttcatcaaaacattgaaatttaaaaattaaattattatggtcaaagttgaaacagcagcggtcaacagtgacacttaaatggaaacggagagagtattttgatgatttctgggtacgactcatgtgaccttttcatatgagaaactgccattttattgcagtaaatatgaatacaagggggagacaaaaaacatggcagtgacacagtttgagtccgtggatgctcgacggtgcttcccttgctgggatgagccttctttcaaggttaattaattattacggtagcaaaacctgttcaccaatcagaattttctcatccagaggtttgatgcactatgtgttagaacatcgccggatctatctctctaatgtttcccctcttcatatttaaaatttcaggcgaagttcaagttaacacttgaagttccatctgagctggtagctttgtcgaacatgcctatagttaatgagaaaattgctggtcctatcaagactgtcgagtatgaggaatcacccgttatgtcaacttatttagtggcaatagttgttggtttgtttgattatatagaaggtgtaacatcggaaggtacgtaccagtaatccagcatacttcatagtttctcacattgaagtagttctgtaggtgccattcttttccttttactttccattgttttttttattgtttttaattgtattcaggcaacaaagttcgtgtgtacactcaagttggtaagagtaatcaagggaagtttgcattagatgttggagtgaagtcattgaatctctataaagagtatgcgcgcgacctatcatttcttctaaattggtttctaaagaaaaaaaatgattcatgttaatatatatcctatttacccaaggttgttgcttgaaagagtcattgaccaaaatttcattctttgaatgctgtagattctttgataccccttatccactacctaagttggatatggttgctatccccgattttacaaatggagccatggagaactatggattggtcacttaccgggaaatatatttgctttttgatgagcagtcttcatcagcatccaccaaacagaatgtatatatcataacactgagaatattcagctacatgtttttttttcattatttacagttcagttcttaaacagtgatgcattacttatagttcagttcttaaacagttctcaaacataatgtatatatcataacactgagaatatattgtcactatgatccaccaattctataaagaaatttacattacagtttttaagaatgatttcatattgagatattttccttgggtgatcaagtagtttatatgtaaatctctgtccacatctgttctgtttaggtagcaattactgtcgcgcatgaattggctcatcaatggttcggcaatcttgtaaccatggaatggtggactcacttgtggctaaacgagggttttgctacatgggtaatcaattatacaacactgatttttagaaatttgatatcaaaatactaccaactgagtgcttggaccttttgtttgaacagatgagctatttggcagtagattcctttttccctgagtggaatatctggacccaatttcttgacagtaccacctctgctctaaaattggactctctagctgagtctcatcctattgaggtaataactgtttgatacatgccatggtctagtgcagtcgttcaaaaaattgatgcatttcatacggtgttcaccattttttttttctaaaaccataaatactacgcactttatcctgtataaaacagagagcgtattttgaactgcaaatttgacgatggtaagtaacggtgatgcataattttggttacattcttatcacatccgttggttgattcctcactgaatctggacaatgaatacgcgatatttaaattgatgatttaatctttttagtctcaaatgttaatttggatgtcaaattcacacgatgcaccacaccagcacaattacaaagcatcagctggtggcatcaaacattttcacttgtctaaatgctggttagcgattttcctcactatgtgttactgttttctacaggtcgaaatacaccatgccagtgagatagactcgatttttgattccataagctatgacaagggtgcttctgttattcgtatgctgcaaagttaccttggtgcagagcgttttcaggttttatacttgtcattcttttattcactctgggtatcatttgcataactttacggcttattcgaagttagaagtgtgtgaaattacctcgaaccatttccttccttccttgctgttggagggagaaatgacacttcattttattcccctatttagttattttatgaacaaacagttgtgtctcttgacttgctactcttccactctatcgcaatctcccatggcttcactagcgcaatcaaccagctcctttacccgtacatccccatctcatccttgactaaaactacactacacgttgtcatgtccctaatctccttggtatgcgctgttaccatgatcctgggcccatgactgccctatgtggagataagatgggaatttcctgaaaaactgagtagaagtgcattgggagaagcaaagaagggggaaaagttgggaatgataacaataagagaggtagtttcatgagggtaaataaaggacacactcaacttctatgagcaaatacattattatccctttgagtgtaaggtgtcaatatccttgggccctattaattggtagagtacttttacaatgttctctaatggttgtagtctactacaagtgttatcatcttagaaataatcttaactgttgacatttatgagttctactaccagtagaaaaaaatattctactaccattagttgatgtggtagtataaatggatatgatccattgaattagaaaaaaaaataaatggtccagattagttctattactagtagagagcattgttaaaacacctcaatttgtatccaattttcagcataatgatcttttttagtagtcatgatcaaacatcacaacataaaccaccacgtacaagtgagagagaatggagggataaatttttaccacatcgtaaacctagcaaatcgcacactcaataattaaaggttcaattagctagttacatacttatttaaggccaactcttgcctcttttgtccactactctacttttcttcaactaatgtatggctccgtcatcttgtactaaacttgtggaactgttgctctttcagaaagcattagcttcatatataaaaaaatatgcctactcgaatgctaaaaccgaggacctgtgggctgttcttgaagaggtatctggtgaacctgttaagaatttgatgactacatggacgaagaaacaaggttatcctgttattggtgtgaagcttaaagggcatgacgtggaacttgaacaggtaatgaattatcgaaaagaatatgatcattcaatggattacattcatttacatgcaaaccacccaatacgtaaattcattatgcacatatagtttgctctgcctttatatttttgttagtgtggttaggtagtcagaattccatacttaaaatcctctgcttattatttatgacaaaaccccatgttgaaaatttttgacaactttatctgggtttaatatttgttacctgctagttaagaagatataataagctggttggaaaattttcctagtcctcaaagagggcatgctgcacaagatccgcaatgtagcagttcttataatcttatctgaagttttgggaatttttctctagaagcttcactacttttttcatttctctaactctgctatatacatgtacatatgagtagtatatgggcctcatgggccaacacatacataactcaacactccccctcaagatgggcgatagatatctatcatgcccatcttgttacacgatgaagtacactccccaacacttaaagcttttgttaaacagtcagctacttgttcccccgacataacaaaacctagcttcaaaatcccttcatctagtttttccttgataaaaaaacgatctatctccacatgttttgttcgatcatgctgaactggattgttagcgatgctaatagccgacttattgtcacaccacaacttcatgggaatattcattagcaactttaactcagaaagaagatttctcaaccataacagctcacttaaactcactgacattgccctgtattctgcctcagcagttgagcgagacactaccggttgtttcttgctcctccaagagaccaaattgccaccaacaaatacgcagtaaccagaggttgacctcctatcatcaaggctgctagcccagtccgcatcacagtagccctccacacctagatgtccatttttcttgaaccataagccttttcctgggctcccttttaaatatctcaggattctatatactgcgtccatgtgaccacttcgagggtcatgcatgtatcgactaacaacagtcacagcataagttatgtcaggtctggtatgacacaaatatatcagtcgtcccacaagtctttgatatctttctttattcactggatctcctaattcagcacataacttatgattttgctcaattggtgtagaggcaggtcggcaaccgagcatacctgtgtcacaaagtagatccaatacatactttcgttgtgaaagaactatccctctaggagatcttgcaatctcaatgcccaaaaaatatttgagctgaccaagatctttgacttcaaattctttgcttatattctcttttaactgagctatttcttgagtgtcatctcctgtaataattatgtcatccacatatacagccaggatggcaatcttctttccacggtgacgataaaacaatgtatggtctccattgcactgtttgtagcccatgccacacattgcacgtctaaatctatcaaaccaagcccttggtgactgcttaaggccatacaaggatttcttcaatctcaatacctttcctttagtttgagaggtggaaaaacccggtggaatctccatataaacttcctcttgaagatctccatgcaaaaatgcattcttaacatctagttggtatagtggccaatcaaagttagctgcacatgatatcaaggttctcactgtgctcatctttgcaacaggtgcaaaggtttcatcataatcgattccatatgtttgactgtacccttttgccacaagccttgccttgtacctttctactttcccaagtggatcttgttttacagcatacacccacttgcaactaaccaccttcttacctgttggaaaaggtacaagctcccaggtcttgttcttctcaagtgctgacatctcctccatcattgcctcatgccactttggatcattcttcgcttctctccaatcctttgggatcactatggattgtaatgatgcaataaaagccctataggcaggagataaagatgaatatgacacataattagctatgtcattcccattttcctcctcaacctcctcaaagccatatcttatagggggctttcctgccgtgcttcttatccctttcctattagcaataggcaagttagattcctctcctgatatttcactctcctctccccctgtctcggtattctcttgtataggatctgactgataagaagattgatcatttatttcatcaatgactagaggttgttgatgttgttccaccatctcattcctatcaattgttagaggttgttgttctacctgttgtgtctccaaggaccttggctttctccttgtgtaaacctgtagattttcttcttcatgtggtttcctccaattctgctcatgtgggagtttgcccatagggcatgggattgacccaataacaaccttcgtcctctttgattcatccccttcttccattcctagtgattcattcaccccttcatacctaacttcactcatgattggattgtcaagatcagaaaacaaataactcaaatctgtcatttctccatagaaaggaatagactctctaaaggtgacatccatacttacaaatgtttgcctctcagatggactccaacatttgtatcctttctgaccagatgagtaacctataaatatgcacttgatagctctgggatccaattttcccacagaaggtctatgatctcgaacaaagcatacgcatccaaacacctttggtggaacaataaattcattacatccaaataccatctcatatggagccttcatcccaagtattcttgatggtgtacgattgataagatatgtagctgtcatgaccgcctcactccagaggaactttggtacattcatagtatacatgagtgaacgtgccacctccaagatatggcgattctttctctcagccaccccattctgcggtggtgtgtcaggacaagaagtttgatgtagtatcccttctatcgaaagaaaactaccaaattcgttgttcacatactctttccc

SEQ ID NO: 79676 - DNA, 15235 bp, Oryza sativa
tcttcagacatggaggtcatactaggtgggttgcttccattttgactcagtgcaccatcaaagtggatatccatgttgggattcgaagtactcttacgttggctaccagtcaacattgaacttccaagccacggagtttgcctgctgtcttagcatacatgtttcttgatgtttgcagctcactattccttttggccaaggcctcttttagcattttggtttcatcttccatggataacaaacgtgcagtcagaaactcattctctttctgcatgtgctgtaagttttcaaatgcataatcaggaacaggggacataggggacataggacgatggaagctggaattctttgcaggcgatcgtcgcaacctgctttctccataatctctgcccaagctctccacttccattttcatttgagctaatgcagcaggccctggtaacttctttcgaacaagaccccgtaatctttggcattcagcttccagttttgatattttctttacatcctccatgtgctgtttagttgcaacatcagctgagcgcacactcatgttcttttcctcattgcggatttcaagctctttggaaacaacatgaatttcatatttcagtgaattaatttccctttcacctgactgaattgtgtttttcaagacttcgatttcagcctctgctcgagccttttcctcatcaatcttcatcaaaaggtctccccgttcctcgagtgaccttgagagtgcatcattctcagcaccagccctaatgagctcctgttcaaactcaagtaactttgcttcaaactcggcctttatcttctcccactgtttggtttttgcaaagactacatcatgtagcttctgctcaccttcttctttcacagtccttacttgcttcatgcattctttcagagcaccatccagatgggcagctctttcctcagccgctagcttagccaatgtaacagtttctagctgaagcttcagtgctgaggcctccgcttcagctttctcccaacctaaacatgacaaagcatatagcccatcaaaaatacatctactgtagcagttttataaatcattcaacctttaagaaaacatatgaatggccgaattctgtttccactttaaagagagcagtaccacctataccaacatccactagcacaaggtttatgaaaataaaagtagtagttagtaagttattctactcaaataggaagagtaaaagaacatagtgatcctctgtgcacctgatacagcttcttcagcaactttagcatgctgtttcactagggcatctttagtagtgatctcagactgtgccgcagagaggtcctcattcaaggccttcaccttttcatttaaggttttcacttgttcttctgattcagtaaggtgtgcatatgtttctggtgaaatctgcacatattttggagctttgtcatcctgaaaagtggaaacatggcattagaagaaataaacatgtaaaggtaaggtaaaattggaaaactttcaggatgcaccagtagacaattccatttataatgtcagctttagagataagaataaatgcaaacaaatatcaaatgaactggtaataccgatgtcccctatgggtattctactgactccacacagcagtatgtactttagcagttagcaaaatatgtcataatctaaattttccctaataaattttgtgtgccacaaacaaaaatgcaatgagttgctctttgacaaaattatatgtagaaaaaaaaattatgtctttctgcggtacagtgggtgaaagaaaatgaaacaaaatactatgtgagtgatatagtgtagtccttaattgagcatcagagagggcctatataaaactaaatcagcaaatacaaaatcaatcatgaacgaatctaccacaaacatgaatagttattttcattttaaatataaatggacaaaatgcaaataaaccagtccaatagctaataaatggcctcgttttagtcaaaaaaaaaatggcctcgttgcaacccagtactttccataacttcaaattttgcagcacccacaggtacaagcagggttgcttaataaaatggcattaataagtcacagtttgtgattgggacttcctccaagtaaaatggcatttctcaaggattctaactacaggtgaacaccgaaagcaacacaaacctgctcagcttgattggaattttgagaagcatctgcgctagatgatttgtcagatgatttcttcttccatggccagctgcgacgatccatcaggcacaatgtatctaacgataaggtaaatatcaagataagccaattgtgacgagtaagtatctatatccagcataaaggtggacaaattatctgaagctaattatattgtcaccaactctgacaacaatacaaaggtaaaacagtagatagacatgtcatcagatgtaatgttttagaaaaatgaagtaacccacatcaaaataaacgtttttcttgtacaccaatgaaaagtttcaggattaacagttctgaaaagaagacacgaggcgatgtgtgttttgaaaataaaagaaagatatatcatgcaaccaacatatagctccagacaaaagaactaaccaccaaaataagtaaacattttcctgcgcaccccatacaacttctataattgatactgctggaaagaacccaaattgcatatagtaaaaagtcataggaacagtgaaagacgagtggttgggcaagtataatacacacttcagtgcacaataattccaccatatatggtgagtagtacaataatataatcaaccacccctttatcactcatcaaagtgcaaggtacataaaccacgcgtacctcacggctccatagtcatacattccatccactggcgacgtgtacacacacccgatgatccagaagcagaggtttctgttacaatagacctagaacagtagtataggataggacaagcccaggccactactaattccgtcataagaaatccaacctttgaagcaagaacaaagggtactaatactacagtcagcacacgcggcggcggcggcccccacgagcgaccaagttggcggcgcacagcgcagaccaccggaccggatccgatcaccgtcatgccagaacgtcgaacgcgggaagtaatcgccgtgccatgtacttctcgcactcatgacacacacacgcacagagcggcttaattaaggcggccagtatctctctatccacgccgtggaccatcaccgcgcgcatggccgcagcatgcagcatcaccaggctgtagagcttgacgcgatacggcaatcgcgcgccactgtcgctcggcgaagagagagtcagttaaggctgccacctaagacgcccgcgagagtaaatcgccggcgtgggacagcgaatgtttatttaagcccatccggagggttaggccggacggaacggaagcctccgccgagatgaccggacacctactgctgctcgccttgccccgtgtcaaggaagaaggatccattggtttcttactgtgctgcactgctgctcctcatcatcagtcattccgtcccatctgctagcagtaggagtcgtcgtatcgaggacgcgcgcgtgagccggagtaaaagcggagagctactactagtaccagtaccactctctaagcatcatgatacgcccattaatggcggtatttgctgggcagatttgggcttgagccaccagatgcgctatacttcagcctactcactactactaataaatccctcgtccttgcgggctcaagtggggttgtcctttttctaccatctccttttactaatctcgcagtggcagcgctgtactactactccccggccgctacttctatcaatcattccacccccaccggatgaagtgaagctggccgtacttgccggattctttcacgggttaaatctgtaccatgtgttccatcggatgggattgaatgttcggggggaagaagaactcgtcgaggagggggtaaagacggagcgcgagaacggcaaggacaagggaagcgcccgaacagggcgagcacgacgcggtgattccaccctcgcaagcgcgacagtgcgttgccgaaccgacaccgcgcgatttgatttcactgcccattgatcataatagtactagtagtttctttggcccaaacaagacaaggaaacacgaagcgcaaagtccgggagggcaaaaaaagaagaagaccggtgaacgggaaaaaaaaagtcagaaactggaaataagaataaacagtgaaattttcagatggagcggattgaacagggagctcgcagcgcacttctcactagtactactgttcaaagttcaaaaataaaaccgacgtaaaagcctcaaacaaagcataatttcctggaaacaatccagaccaaaaaacaaaaatcgcaagcattgcaggaacacagacgcgcaatcacagggctgcaaattagcaacaacgaaggaaaaacacgggaaaaaattaagcaggcacgcagcaaagggattcggagccttacgggaggcgagggcgcggctcggggaggctccacgcggaatgcagatccggcggggtcacggtcgccggaatccgccgcaattccggcgtgaactggatctgacccgcggctccgatcgacccggccggcgtgtcggtggcttcggcggcggcggagacgacgacggccacgcgtaccttgccgctcacacctcctcaaccgatcagcgccgcactgcacaccaggagctggactgtggattggatgattcacccccactcctctccctttttcccctcggccctcgcctccctcctccccttttgctcccgcaaccttttcttcttccctctggaatcccaccaccaccacctcctcctgctgctgcaacgagcactagctcgaggcggcgtctcccggtttggtaatgcggctgcccacctctcgcccctgctccctatctagcatcaatggagtggcggtggcggtggtggtgggggaaggaggagagacgcgagagaggtgcggagatggaggtccgggtgctttttgttacgggggggtgcgcggctgcgctgctggtaggtgggcaaaaaagcggggagggagggaagaaagtggcgaggtggggaaaagcgggaggagagtgtgtgtgtgctgtgcgcttgctgtgaggagggagggagggagggagtgatacgcagcagagatacacatccaacatttcatcacagtaggatggatggagatggtgacagggatgatataacaataaaatacaggtcttgcattacaataatagcatcatttctttttttagttactgctgagtttttctcttaaaatagttgcacaggcatggcacaaataacctgtttagttggtgaaatgaaaatttttaggtatcatatcagacgtttgacttgatgtcggaaggggtttttggactcgaatgaaaaaactaatttcataactcgtttgaaaaacgcgagacgaatctttttattctaattaagccgtcattagcacatgtgggttactgtagcattttatagctaattatggattaattagactcaaaagattcgtctcgcgatttacatgcaaactgtgcaattagtttttctttttatccatatctaatactctatacatatgtccaaagatttaatgtgatgtttttgtgaaaagtttttggaaaactaaacagggccaaaggcaagccttctctcttagcaattttccattacagtttacacatttattacagagcacaccaggtaaggtgagtcctgtatatgcagctacgctcaacaagtcaacatctcatcaattctatagttaaacaatgtgattcctccgaaaaattgttatatacttcctctgtttcacaatataagttattctagcatttctcacatccatatcaatatgttaatgaatctagatagatatatatatgtctagattcattaacatcactatgaatatgaaaaatgctagaatgacttacattgtgaaacggagggagtataagttattttaaaatattatataaattcattctttaagtttgtacttcctcctttctaaattgatcatcatataatataattcaaaatttctcaaattgatcatcatataaccgtatagacacgagtttcatcataatacaattaatgcagcatgggagaatgtgtagatggcatggtgttttaatcgatacatgcattgtgggagaatgtgtacatggtatcttgattgatgaaatttaaattattattagtcttgatgtataaacatactccctccatactaaaaaaaagtcgtttaggacatcgatacggtctccaaaatacaactttgacttcttgtttctataaaaatattcattaaaaagtgatatatgtatacttttatgaaagtatttttcaagacaaatctattcatataatttttacattttcaaactcaacaacttgatagttattcatgatttatattcccaaggtttgacttaaacattgtcctaaacgacttcctttataaatatggagggagtatatgatgatcaatttgagaaggatgaaataataattaaaatttaataacttacgtattaatagtattttcgttttgtgggtcatcatgtaaagttaaacatgacaactgtggtacaggatagagggttggaaattataaatagtgttatcaccgtttccttgatgcaccgatgaagttgtattgtactactctatcaatgattttgatgaatgtcggtgtctcaaaactactactccagtatgtatctaccggtgtctcaacgtgattttgatgggtttcgggtaagcagggggcacagtgctggagcccaataccaacgtccttcgccgcgtccgcaacaaccaaaatagaaccacgcattttacatgtcaatcatgccaacaggctgcctcccggaaggccataatacacgccacttgttttggctcttcctaatccttatctcacatcgatctctaccatctactactagctatctattgtgaagtctactagtttaattatcatatcgattgaagagttccaaggaacaaaaacactgacaatattaagcatcggacaaacggttgggatcggtaggtacaatatttttccgtttaatcgtgacacatgtccttgatcttgttatgcctatcaactaagtactcctagctaacagctctacatatcatcttttaaagaacttcacacagacacggattgatcgaggttattgtccacgaacagaagtcagttggagcatcactagcctccaatggttcatttcactttccgaagtgccttggatgatgcacggaacctaatctgaattctgaaagatatagtaaaacacttgctgttgcgacttgcatttgttattctttcttgatagcagtatttactactgtttgtcgtaacaccgatgtacagtggcggatccagaaaattaattcaatggtgtcatatcatatctactggtgtcatagtatgctaaggcttcgtttgttcccgggtgttctgggagattgagagagaaaacatctcgttttccgcgcgcacgcttcccaaactactaaacggtgtattttttgcaaaaaaattctataggaaagttgctttaaaaaatcatattaatccatttttaaaatttaaaatagttaatactcaactaatcatacgctaatggctcacctcgttttgcgtatcttcccaatctcctcaatccccttctcctcaaacacaccctaattatatttaaaacatagtgttataatatatgaatatgcagtttaactataggttttaccgaaagtcgtcggtgtcaccgttacacggtagatccgcccctgccgatgtagggtggccttgctttctccttggagcaaaatgcccctgtgccagttgctacccctacaaataaaaaagcaaatctgatcgatggaactcgcaacagctcaccacctaatacctatggtcataaaacggaaagttgcctacgatttatagatcgaaaaggatatgagaaaaaagggggctttagaaaagaaattactctagctaagctcactcatccatccgtttcctcaagtacaatgccgagcaaaacccagccgtaacactccctcatttctctatctgaccaaaaccatgacaagcaaataagttgtcattaagcaaagctaacagctaagcaacagctcaatcaaaaacatgtcactggtttccttgagaaaccaactaaagattagtttttttttggtttcttagccaaagattattcattccaacgtgacactggcgcactgcccgtctgcaggactgcaaaaatggcattgagctttcccacattgactgactggcaatcctcgcaataaacaagcgccacacatgtgtgtgaaagtaacaaaaggcgcctcccagtaggtaggtggggacgcggtggaaaggcaggctggttcacctccaggctatcgctcctcctggctctccaaaagagaaaagagagggatccaaagatgccaaacagtgcctcacttctgtactcctactactactacttcactccataatctagcctgtgcatgtggctgcaacatttcacctcgccatggctacgtaagcagcgaagctttcatctgtgtgcctgagtgtcagtgaagccagtggcatgtcaatgtgtcatcaccacgcagtactagtagtagtagtaccagaaatacggggcgtatctcacgtctaatcggacggactactagcggttaaaaacaggcgagacgactgcgactacggttagttggctaacgtccaaggagcaagtgcacaaaagaaaatgtcgcagtaggtggcacgtattaccggctacaacgccacttcatctaccgtgtgagtgtgagtgagcgaggcacaaactatgagaccggaggtttttttacaatagacccacttgtgtgtggcacgcggggggaagagctagatcctgagccgtccgttggacgggtggtggatcggacggctctggtcgacctgactgcgctgatgcaggggtggttatcttatcccaaactggagtaatttatactagtaatagcgcattagtgctcggtataatcagctggctggctggtcaaatgtggtgctcaactgctgcggtgaatgacagaatgtggtaacatgttcttctgagaataatactactgcagccagggtgtaatcatgggctggttgggcatgtgcggggttacgtctaaaaagatttgatgctgattggcttaaagcgcggggattgaagcaggtgtttatgctttttagagtttggtcagatctactggagtgtcatgagaatgagatattatcctctctgacacgtgtatcgctacattatttagctgggaatgttattttctttgctatttttcttcagatttgttatcgagttgttgacagttttttcccaaatgaaactttcattttgtagaccgttgaatccctgttaagattcatgtacctagagaggaaaaataatcgatttgtgcgcatgaggaaggattcgaacccataacctcacacatagtcacactcacacggtgctagccacctattgtaattacactctagttatattttttaaaaaaatactccgaaaactatcaaatattctttagttattattttctttgttgagtacattggagaattctatctctatacgtgtgatcgatcttgaaagaagaagaccaggtcgtctgaaactggtctttcacctctcgactgcagccagccagctgctagtaggtgcttcgagctgcaccagctgtaaagacccccaaagtcagcttaaactaactatagtacactaagcatcatgcacggagatgcagattgcaggcttggactgcaggggcaagagttatacagctctgtttttaatggaaagagaatgtgcatagcactgttcattgcagctccactgctcgattagctgcgtgcctgcgtcactgtaaaatgtgaattgtgtaacgcaggacttccatttgatcgacaggaattcccggtgataccgtgagcctgtgacctgtgtcactgtgtgatgataaaactgatatttctggggaaaatagagcggatatgatttcgtgaatacataatggccaattgtgtgtgtggtagcagaaagttccatgaggataaatagatagcagtactgctaatctgctataatacagatgagacaatgcacaatgtatgttttagtgattgtctcaataaagaagagggaattggaaagcgaaagcttaatcagtgcgaattgatggacagaatcggaagaagtggctctgggtgggtggctcgctactgaaaataacaaaagtatagttagcagctgagcatcctatcaactgtcgagtgcagggcatcctaagaatgtcacgggagagaaaaaaaaagggtaaagatcactcgttctcttttttttttctccctttaagttccaccgtttttgtttttcataagttgggcgtccactttaattcagctccaaatgctccattataattaatgcaaagtgtagtgtaccgtgtctatatagctgcttcttttaaattagataggttaattatatcatccagcatgcgcttgtcaaagactgaaacagttagccactttgttgtgctgcagcctgcaggtaggctgtaccagtacaacgcattcggttagagtacgaagcttgctctttgcaggcgtcgtttactcgtcttggatgagtaataaatcgatcggaatccaacatggagctgccatgacaagggacaagactaaagaggatataaaaagcaataggagtgtaatacatccgtgagcatgctaatgaacctaccttatttagtctgttaaccagaaatgttacgtgtagatagacacatagtgaaggcacaagtatgtcagtatgtgtgctggtgcaacgcgaaggtaaattagcggagacgctgaaactggaagcaaatgattaattgaagtgcagcctttttcccaattactcagatcatttaagatgtaggacaccgggtgaattgccccaagattgacattttgtagacatttttttagccatctaatgcgatcgaatactgaaaacgtgatcaattatagtctcggcttctctgaacagaccatctcaatactgagatgagaaaactatacaactctctccgttttttaatagatgacgccgttgacttttaaacatatgtttgaccattcgtcatattcaaaaaattttatgtaaatgtatatatataaatcatgcttaaagtactttgagtgataaaacaactcacaacaaaaaaaattataattacgtaaattttttgaataagacgaatgatcaaacatgtgataaaaagtcaacggcattatctattaaaaaacggaggtagtactagctagtactgtagctaaatatcgatcatctcctctggaacatcttgagtccatgcatgagatgatctaatctagctagaacttggttaacctacccggctagctagctaaaccccttttccctgtcacgccgattgctcaaagccgggagcagcgcgtcttggcgtgcgagagtcggaggccgatcgaagattagcgggacccatgcggcgtcctttcttattaatagaagtccccaaaaaagaagcttgcatgcgacgaagcatatatcccccgcgtcttcacaagaaagcgggcgagaaaaaaagaaggaattccaaagcttgtagtacgtacatcgccgccggccgtcgagtacgtcgagtcggttgccgcgtcgctctccccgcttttctccccccctgcttttgttagcttgtcacaccacaccgctctccatctcatggtgcgcccccgtgcgcgcgagccacccagccaaagccgcgtaagtccgcgcagcggcgcagcccgccaccgttaggtggcacgtacttctcccgcgcgacgacgatcgcgcgcggcgctggcgacatgcatcaccgagaccgagcgcgcgcgcggggggcgtggcgtggcgtggcgtcacgttcgttgggcgcgcgcgcggatagcgtgcgtactgcgagagatacgccgcgcgcgttaaccgccgcggaccacgcgcgcgcgcgcatcgatcacatcacatccacaggtgcgccgaatcgaccgggggcgagccgccagccagacgacacacacatatacgcgcccgatggcaacgtgacacggatggttggtgacccatccggccgccgtagttgcacttgcttcaattcttggagacttaaattactgttcgatcgatccgtgccatggcatggagtgggggatcggaattgattgtgctgctggttagttgcactgtcgttggatcaatcgatcgcgagcagagggccggggaacagctggtatatctgggccggggcgtgtagataggtaactagtgcgtcgcaaccggcgtgatgaatagtgtgcggatatacgcgagatgatcgggctggatgtgtttgggtgcacggttgtatgtgtggtccgaggaaaagtacctgcgtactgatacgagccattcgtgaacgcttacacgtacagctcgctgagatgtgattgtagacgtatattgttcgcacgtgcgtgtcgattcctgccctttcgtagtattacatccttctggctatatggatcatgtacgtacagatgatgcatatatcgtgatggactaatgactggttgaacgaccaaagcgccagggtattgcttgttcatgtagctatatgcacatatggcaaaatttgccacatgacattcaaattttgtgtaattagttggaggacaccgtaaaattgtgtcactgctgagggacaccataaaatggtgtaattggctgtaacacactagaagtattattttatgatatttgagaaaaatgtggagagagaaatttaacaaaagacaagtttgcccctacctgctccttctccacctgaccacggcgcagcggtgtgctatgcagggaggacggtgcatgcgcgggtgcacaccgagatggggaggaggcggcggtgagtggcgacgaggaggaaaaggtggccggctcaggatgggggcagagatggagctcccatgctcaccgggcacaatggaggcacggatggggacaatgaagctggcggtggcctcgtcagtgctttgggaggtcccagccgacacctagcggcgtgacgctagtggggagggcatggtttcccggcggcgagggaaagggggagatagggagaggagccatggacaggagctcggccggggccgtcaatggcgtcggttcgctggtggccaaactacgaccaattaattcgcacaacggccatgattcgtgggggatttatggggaaaactgagagaacaggttggggagcaacccccccccccaattaatttggcgaaacggccggcggcgggggtgaagcaggataaagaatagtgtgcatgggcatatttgtactttccacgatttttctctctccatttatatcaaatatagtaaaataatatctctggtgtccagcaaccaattacaccatttttatatagtgttccttagtagtaacatgattttgcagtatccttcggccaattacataaattttagacgtcctttagtaatttttgacgcatatatgcacacacatcaataggtccggccagttttgtgacgcgtaagatccacctatctatcgtactcatcagtttgcgtgacggattaaagtaaaaaaatttcagtgcttgtagaataaaaaaagaaatcaaaaggacacgaaagggagaaggtcgattttcacgcaaactgaaaaaaaaaattcagtttgcgtgacggtgtaaaatcaaaaaaatcaaaagcacaccagggtcacaattggtaacaaattgcccatgctgagtatgaggtacgagcagggtttgacttaccgtcggtaaccgcggcgcggttaccgggtttaccgcggggtacggtaatataaataccacggtaacccccttaaattcaaataaatttaaaatataatttaaatttttgataaattttgcacggtttatacggtttttcacggttaccgcggttaccacgtggtaaccgtgcttaccgccggggcgcggtaaccccggccccggcggtttggaaaaccctgggtacgagtcacaagagctcaattactaaggtataatatcacaagaactctctccttttcatattataaaacacttttatcattttttatcaaatttatagaaaaatataaatatttttaacaccaaataaacataatattaaaatatatttaataaaactattttggtattacaaagtttgctagaattttttttataaatttaattaaactatagacgtttgacttaaaaaagaaaaaatcaaaatgccttataatatgtaatgaaggattactaaattaagcatcactatatctacgtatagagaaatctcctttacaaaatcaggaatgcctattcatttcgtatataaaaaatcttataacaacaatctttttcttgaatagcccagattgctctaagatttatatagactctataacctaacccaccttttgtctttgccttcttcttcttaccatggatccactgtcactactcgccaccatcttctccaaacacaagtctgggcctggcgctaattcctcagtgcttatcttctagtctccgagttgcccaattcttgatcgaccatgggtagattctactgacatttttcttttcagacaaataagaagtactccatccatcgtaaaatataagcattttttggactggacacaatcttcgaaatactactttggccaataatatctatataaaagtaagatgctttaaagaaaaatatttgcatattatgatagtttgttttatgataaatctagtaacatcaattttacatgattgattctctcttttttctattatagtcaaagttaaaaatgttggatctggccatattctaaagggaaattttgctacgggacactgtgacttcgcagtcttagctgtaggacattgtacgaagtgacttttgaggaaaaacagtttcaaaggttggatatttgccagtggacaccg

SEQ ID NO: 79677 - DNA, 19964 bp, Oryza sativa
ggttctgagggttgataggggaagcgataagtcgatgcggcgaagacaagggaagaggaatgtgagtatagcttcgttgcaacttgcaaaacagcaagcggcacaatcagcaagttcacaaccggtctggtgcattgaagttacaacaaaattcatggttccacttccatcctccgaatatcgatggctcgattttttgctgtttatgccaaaaaaaaaaagtaacacatgcatgtaaatactttttttttggaacatgtaaatactattgaaataatattaaaattttctactacgtacttcctccgtttcatattataaaactttctagcattgtccatattcatatatatgctaataaatttagacatatatatgtacctagattcattaacatctatatgaatatggccaatggccaatactaaaaagttttatgatttgaaacggaggtagtaagatatttgatcttatactgataacttattgaattatagacatatataaaaaaaatgtattcttgtatggttacaaattatgcaacttctttaaatataattgattaaactatacttcatgagaataatttgcatgtacattggaatagaacagagcaaatatgtagagaagttaattcttattgtagactaactattaaaattgttcaaaagctcactctttatgaacacattgggatcacttcaaacaccaccatgaccatgaggcaacatgatgctacaacagtagaaaattaacttaaataaagagataaacaacatgcggattgttttgcgttagtgttttcttactgagaatattatatagggacaaatgattacgagtacataatgagaaacgcccaggggtcttcgggctagctccacaaggtggtgggctagataacctgggttcgaagcctcatccattataattatttgatattaggtcattttctaatagtcgtgtttttgtagttacaaaatgggtaatcggcacatattggctttcttcaattgatctagttgcattaattctacttgtaagttatggttgatcgtactttgagcggaatatggttttactctatttttttagaacaagttttactctagctcaagtcgaaaaaaataaacaatgctccgctttaacggactaattggcatgtagctacgattatgtactccatactagtctactagctatattttgagacgaaggaaatagataatagtgaacccgcaacacgacaatgtatttgttagctatgcatggttctaagtagacagatacaaccacaaccttctatattagctttatatggaactagggatgttatatccaaccttgtcgacgagggcacgtaatctgctcgatcacgacacacaaagatcttagaaatttggagcacttgctagtgaaaagctcactaggcacaattgttatagtgttgtgtcgctttggtcgttgccttcaaagtctagccctgcctattcgacttcgtctagtcgttcgggcttggctagcccttgcgtcaagaggctgcgacctacaagagtgagcgagacatttgacattgtagtccgctgttcatcttgccacgacaacacatcggcacccaaaatcccagactttcgagtccccattgttgctggcttgctgcatgttcatcttgttgtctcgctaacgcctatagtccatgacgttgtcagccgtccatgttagacacccatgcaatgtcgcaatctcagttttaaattggacatatgtttttttaaatattttataatcttaatttacattttgtcccgggtctttaaattcctaaatacctaggcctaaagtgtgttggttgagtttctgtgtttttggtgagggttgggagcccactcacctcccagacgaaagacatagcagtcgattagtgcacgattaattaactattagctacaaaacataaaaaataagttagtatgatttttaaagcaactttcatatatttattttttttttaaaaaatacaccgttaaacaatttaggaagcatgcgcgtgaaaaacgagtgatgagatttcacgtgcatgctttccaactgctaaaaaatgtattttctgtaaaaaaaatttattgaaaagttgctctaaattttctatagcaaagggttagcttaaagttgagagctcccgtcttggaacaacgcacgtgcccttatgtacccctgacaacgggtcccccacagagtgtttacaccagtagagtccccgccggtcagtgtcagctgtggtcacggcagtccccgtcgtcctcttcttctaccagcgggccgcaggcggagaacatcgggagcgagcagcgcacagcgcagcgaggagcccagaaggcgacaagacagatagacagaagccattcatatcgaaccaaaaaatcaacccacctaaccaactgacatcccgggtccaccgcaccccatctggcgggtcccacacgcagtgaaacgtgggtggtgcaacccgccgcggcattctgttgcggaaaagagagagagaccccgaggatgacgaccggagataggagtgaaattggaagaggagaattcctctttttttttttctctccctcccccaaaaatccccgagatgccgaagaggacctcctcgcattcccccaccgtctccgccatgaatcccctcctcccttcctcctccttccccaaattcccccacccggacccaaacctcagctccccaaaccctagcccgtgtagctacctcctccacgccgacgccgacgacgaggcgctgatccaaatcccgtgcccgaaccctagctccggcgcggcctcctcctcctccgtcgtcctgccgcccatcgacccggcgccgcacatctcatcgcagttctacaccttcaccgccgagtcgcacgcgctcatgctgcgatgcgtcctcgccggccgccccgcggccgccgacgaggtccgctccgcgacgcccccctccgtgctcgcctcgtggcgggcggtgtggaaggaccggaacgaggacacggcctacctcaccgcttggaagcgcatccaggacaagctcggcgcgtcggccgacgggcggtccctccacttcaagtccaaccctgggcagcgcgtctcgcacgtcggccagtggcgggacatagtctcggaggcgcacgccgaccccgacctgctccgccatctcgggctcaaggacaccgtcgaccgaatcaagcagtcatggaccgtgggtgccaaattctacggcattccggagtcattcgtccgtgtttgtgtctctgcatgtgctgtatgtaaggccgcacctgcgggacagcctgattttgctatgtcatcgccagggcgggggaaacggcgccgcaggtttgaatatacggagacactagatgtgcccgcgcgagatgttccacgccgactgcaacagttggctgctaagcataaggtggttctctgtatcaggcagaagtatataaggcataaaccattcatggccgaggtgaaagattatgcatgccaccgtgctggggtgccaacttcaagtggtgtgaatgctacgtcttcttcaggaagtgtccctgatgggaagaagacacgagtattgaagcgggaaccatatcaatcaaagaggtgtggttgtgggtttcgtattcgggcaattgtgccaatagctaattacaatgagaaagacaagagttttgtatacgaggaggagggtactgcagtgttcaagctttatgcagtgcattcagggcatgagccagggccacttgatggcaatgcccgaattgttcataggttagttgggcataagggagctcttgagttcgatccagacatttatggtgtcagtgaggaaggagatcctaactttacgattaagggagattttgatgttgaaactgatgattcacatcttgcagttttgcagcaaattcgggatctcaaaacagaggttggcttgttagaagggaaggtgggtaagatgcacccagagcttttgggttcactatccaatgagctatctgagtgtttgcacaggatcaggaagtttaattttgatggcaatgtctgccagccagaagatacactgatgataggcaacgaggaggttcctggatgggggccagctgacgtttctcaccatttagatcagcatgacggtgcattctgcagggatgatgagatgcttgatgatgacgatactgattttggttcaagtcttgggcctattgtctcgtgggatggaatgacggcagaatgtgaggataggaagatgctcatgagtgatagtccaaagtgtgacaaatggatgctcaaggaagacgtgggcgactttgttgagaagagtattcttaactgtggtgatgacgatggtgtggaggattcaaaaattatcaagccattgatgcatgatgagaccatggtagctgacccaggtttggtaggtattcatgtagaaggattctactctggagccaaatggtatgattcaccggtaggtttggattccagtggtgatgcagatgtcagttttagacatggtggacttgtgtgagatgtgattgtccctgataccaggaacatcatgtaaattctgtatacaggaggacatcagcttgtaccaatttaatgtagtatctataggtagagcttgaaccaaagtgacctgcctgccctgatatatacatgctgcatttatcgactcaacctttgtttaacttatgtatagtccccgtgtgggtttccatcttgttacaagacaatataactttggttctgttcttgattagctatttagtcataacttaatgttttgtagaactctcaccctccctctctctctctcacgtgcgtgtgggcacgaatgtgcatgtgcattttgtaaatttaatgcaaggttttgcacacaataacatgctgtctctttactttgcaagaggaatctttgtcatctttcctgttcaattgcatctagtgtattagttattattaccattaactgtgaaaaacattatccctgttcatacctaaaaattgttcacttccctcttgtttattctagtacatatcatttgtgcaagaaaactgcaactgttctttgcgagcctattgaacatcactttttaatgacatggtattgactatgcatgatgtatattctcaaatttcatggtgttatatgtggtttactggtttaattttggtgctacaagtgtatgtgtgaaagatgaacgttgttttgttttgtattaggtacccttctgcattagactgattgactgggtggatgtttactatgacagtataaatccttcattgtgatgccacatgaaatacataattatttattattcaaacattaaatagatcttagtgtttttatcttcttttgccaagtcccttttttcatgttataaattctactatctacaatattcattgagcgttaagatgttaaatattatttgtcaaagctcaaggaatggttgagtgtccatgtcaaatgcttcaggaacattttcttctgtttgttttatatattcaattctgtatggtcaggcaaggttcttttcatatttcatttaatcttttcaaatgctgatatatatatatatatatatatatatatatatatatatatatatatatatatatatatattaacgtctgaagcataatggttttggaggactactgttatgcaaattattgcaaataacttttatgttctaaatctacaagttcactatagttcttcatggaatgcattctgtgtaattttatcaaaaggctattctggtaagcattcgtgattcccccctttgataagctagatttctgtttgcattaagcatataaatttgatagattttgaaggggttgccttaagtttttctcactttttttttctgtatttgcaggattgcaatgagttatgtgtcatcatttcctctgctatacacgtgtttattgttgatgaaattaccatcctatgagcaatgcccttatggccttaaactatcttaaccgtttaatcatgaattttctctcatgcagatctgtcagttaacttcgtcatgccgccttttctgcttattggcgtgatctggcgtcacatgatgcatcatcaggttgaggtctggacacaagaacccacatacattatttgtctgtttccattttgcgccacttgttacatctataatacaatttgatgcaccactttcaaatttgggtttaccccttgttttgccgccaaacatcatgctagacaatctccgttgttggctagacacataaaaggtaacatctgtccttcgtcagttgatccagtcaaaattgcagggattagccattcatgcaacgcatacctatcctggctcctgcatcgtcctattctgaacgtatgaattcttcatccaaacattacagttactttcctatcatggttgtgggagccaaaatggacccgtggccaaggaggctggagcaactgatgtgattagcagccattaactaagattttttttcctatggcaaaattagcaaggcaggatttgattagattagcttcgctgtttccttttgtcttttagaaaatatgtttgttagatcctggttatagacaccaagccatacactctatggatttaatgaagaagtaaccaatctaattccttccaatgtaaatcttcccagtctaacttcacttctcccaccaatctaattcctcccaatgtaaatctccccagtctaacttcacttctcccactaagggccaatcgtccttgtggtgtttccctgtttgatctatgctcctaacatttccagaatcttttaggcttattgatgtattgtgcaagtaacccataaaacctgatgtcaacaaaatacattccctggcaagaaaaggtcaaagacttgagcaacaaaagacaagaaggcactggttgtgctcgatttctttgattcttaagagaaataaataatgctctattgtgaggtgccttaagtaaaacatgtttcatatgatcatattgtacttggtaagtaccataatggaatatctaatattgtgacatgcaatgcacgtactgcttgctagataggattatatgttcaagtcagcatgtccaaacgctgttcaccttttgcccaaatgtcagccaggacatgggtccacattatgagctttcttcttatcagatatgcatgcaaacccaatgcttgaaagaaagctagtgtgttggggcataaatatgaaattgttaattcatgcttgtttttcttaactgttcatggagttggactgaagtaaaacttcttttcttcaggtaattgaattactatgttgagcaaactttggcatggcagtgctcaactaaacatctcgaaatagctttatgtgatatgctatattctttgcttgcagtcacagtgtgcttttacagcttgcttgtagagcgatggaataatccacctaacatgctcaaatattaaaaatctttctttagcagttactctctttcctagaatgtggcactcaaatattcatgattataatttctttatgaatatctagattggccggatgtgatgagatttattagtttctacagatatataaaagtggctaaagttgtgtcttggataccatttaaatgttcaacacacaattcattcaactatttgtggcaggaagagtactacagacggagtcattatttacacacagatgaaatatttagtgccaagtctgcagggtgatgagttagtatctattaaacatgcgagttttaaatccatttggctgacttttgcaagaattggtaagtgcattctccattatttgttggtaactgcaagaagtgtacactaccagatatagacagtggtggggctttctagtgatgtttcttttggcattttgctaaaggcaggcctttctggacaggcacaagttgcatgccgttgctgattttagtgtgatgcatgtagttgattgaaaaatgaaaacagtaccattttatgtgcaaccaagtgcattttattagctaacttagactgggggctgttttggtttataatagaaaatggaatctatgcatgcaacaaaaaaaatgttctgaacgttaacatgcttctccaaggcattgcatgttggagtagccagtaattaccactgagagatactcgctccttgcgattagaacatagttttaattatataccatatcaatttcttctactcgtgtgcagtgggataatattgtttttggtcattgatcatcactctggttaactggtcacatttggttgaggatttaacatcatttattggcaggttgtttgtgcagttgcttgttttggggagctggagcaatcgtggaccttgttaatcttccagaataactagttagtccgccaaccagttttctaagtctctgaagccagaggtacaagtggtgcctgatgatatatacttgttaaactgcagcactcgaatcaatgacattattttactgtccgtaaggcaacaactgagccatagtatatctcatgtaatcacagggaagcggaaatttcaacattttcttatgataatgtaagtttctctatgctatgtaggatcccgcagcttatctatatatggcgcagatctcctgaagatagctctgcagactgcagttagagctgagtcagagtaagaagacgtgataagggtgactcgaatcaatgacattatccaactgtccacagtccaacaactttgctatagaatatttcatggatcagagggacatgaaaatctgaactcaaactctttcataaggccatatccaagctggtgttgcaatggtggattcccctgctcctctattatataaggcatagatcctctcaagttatatctgcagtaagagtcagaggtccaagacgtccaagtgagagcgaaaggtgtcttttccagaagacactaaccgaatgactagcatggccacaatcacagccaaatctggggtcatcgccgtatcgatggtcttggtcatgtgcgctgcctctgcagctgctggcgacaacgacatgctgccggcggcgttcgacatcctgcagcagccggcgaaggaagccgccaacctcggccacggctgctacactcggtgcttcgccggctgctttgcagctgggttcgatggagattactgctcggacttctgctccaaggaatgtggcgatgatgtccggaagttcctcagccggctgtcgccggagaactccgctatcgtcggtgacatttgcaacatcccaaggtgcatcagttcctgcgtcgaagcgaagattgatccaccgtactgcaagatttggtgtgaggatatgtgcggtgatgatgtccggaagaaccaaatcgggctctcgccgtaagattccaccagatgcgtttctttcggtccgcgcatcaatagtgcctgcgcttgcgttcagttagcgctgtgatctttcagtagcaaactactagcaagtagcagtagcttgtgtcgtcgctctctgcataagtgtgcttgcttttgttcttctatgttcccgtgttcttccacggttccactgttcttgttgttgaaggcgtcaaggtgtgtagccgactcgtgcaattacattatcttcatttcgaccctgttatcagaagtacgtactgttttagttccttgaatgcagtgatgggcgtaccagtttccgtttcataatcatgacttggtgttctgggacctgatgtccattttttgaaaggtcacccgggtgattcagtagagctggctgttggctggatcctcatgatgttttgattcagtagagctgctcaattgaagatagacgagtaatagcaccatgtgttggtaaccttatatgccgatggacttaaaaagcgaaaaattggatagatctctaaacttgtatataatttttcaaagataatagtcgtgcatcgcgttaaatcttgtccgagtaccaagtacacatgatcaatgacgcatgcgaaaaaaaagagagagaagaatcaatgtgcgcctgaatgcacactctttgttcttatcatctgatgaagttccaatccgcaattctcttttctaggaaaacaactccagtaagaactccaaatatttcgagatccgcatccccgcacgctgcgtctctcactctctcctcctcagtccgtttcgctatccttttgtcttgctcgatcgtttcgcggactccagctgccggtcgatgatgacgggagcgaagcttgcggagaaccgatcgacggcccggcaatagccgccggcatgcgcatagtgaagcctttctccctgctgatgccatggcgggcgtcgggcgatcaatgaagtgcgccaccaagagtacgtacctcctcgtcgtctacaccggcgagtactaccaaatcatcctacttgatcaacgacgccattgacgactccctcactcccgtgcctgacatcccccgccctgagcccctgacagcctcctcgccatcgggagcggaacatccatcttttcacttggcggtggcgcctacgtcgtcctcgccgagctcctcatgaccaacgtccacaaatggcgccatcaggttcgttgacatgaagaggacacacggtcgctgaggatttgaagctggccatctggatcctgtcgctggactccggcggcgagtggaggaaaggcccggagtgtcgtgtcggagacatttgggcaagcgaaaagtacgttgtcatgggagtgccgcggattagtccgcctccggtgtgccctgtcttgcgcacggtcaacgataatgtcgtctgcgttatcgtgaacgatgccgacgagactgtgtacgggagtgtggatgtcatagcccagcattttcttgccatcgacgtggaacgtaaggatcgaggtgggtgctctgctgtccgtcgttaccaagcttcacgccttcaccctgatggtggggtagaacctgtacggctgtaccctaaccacatggcttgcgaattcagtgagtacatggaacactgacaggtatagaggtacaaataatagcctctagtactgctaggaccatccaaaatacttgtcattgtcaattgttgagtaaattttattttagggaacttttattatcaatgtttcattttgtaccatcctttaaccaatgattttactttaaatcgggtattttttttacctttgttttacattggttcaccctaactctcttctcaagtataagtatataaatgatcttaagtgcgttggctcctactcatcaataaactcacatagcaatatgcaagataatttctttggcatataacaagtttgatgtagatggataaaatagttgaggggttcaaaatatcacaaaagtaaaaatacccgatccaaagtaacaacattgtttaaagggtgatctaagatgaaatatcggtaataaaagatgacaaaaagtaaaatttactcttaatttttcatgcatatttagttctaaagtaaaaatctgtatattatgtggtgtaattaggatttatatgaaaggtgatttatctacatgtaataggtcaaatcaatggtggtccactatacaatttttatcatgttatgtattatatttagaaataagactacttcacccctaaagtattgatgctgatctacataacccctggagtatgaaactgggtattttattccgtaaagtatcaaaatcagttcaaataacacctagagtggttattgaaacgggctcttgaactaaagaggagactttgaaatgggctaagtattttattcacaagtgaaacgcccgagactaatgtaaattagtgttagtatagtaactttaggcttgtcgattagtgcgtgaaaagcaatagttagataaatttgggtttactagactaatctttgcgccacacaatcatttgcatgtcaaaactacctataaaaccactgtaggggttatttgaaccgattttcatacttcaaaggtagaaatctagtttcgtactttataagtggttaaatagaccaaccccaacacttcagggtattccttatatctactatagttttaactttgagttaaatcttaaggtggtccatgccctacggcagtagcggagccagaaatttaaatctgtggggtcaattactagtggtttgtatttaagtgggatcatttctctttattgttttggatttatacataaaaattgaggtttataggacgttttttaaaaagctggggtcggccgaccccacagaaatggcctaaatccaccactgccccaggtgccacctagttaactctgcatatgggcctatgatcccttcgatcacttttcattactacaatggtgtttgaaactgatggatattaagctggtgcatgtagaatgaagaaaataattaacacattattgattaaaatttaattattaaaaacttgacaaattaatttatttgataattttaatgtaacttttatatagaaagtttgaaaagtgtaataacggaaactgagttaaaatctgtacgtgttaaatatattattcccctttttaaatttatagaagaagttaaatatgaacgttggaaaacgctgaacaagtgaacatatcccgcgatccgcatttgttgcgactcgtttcgatcaactgattctccttcccggccggacatccacatcatcctgcgatcgttcgtttccctagtcgttccaggctttttcagctctactcccctccacccaggcgcaaatcatccgccatggctcccgcctgggtcttgctcgatcgcgtcgtcaagcccgccgtcttcgacgaagaagagagcaaaggtaagggagaatcgaccggcgccccagtgaagtacctgccagccagattaaggcaggaagtccccgccggcatgcgggacgtgaagccctacccagaggttgcggatcctcccattatatctcgcttctccatgctgatttcgcggaaggcgatcagggtagtgaaatccgtccgtgtccggtgcgccgacaagagccttgtcttgttctacgccggcaccggcttccccggcttctcgtcccacggctgccacctgatctacgacgccatcgacggctctctcactgcggtgcacacattcccctttcctgtgtccggagtcgtctgggtcggcagagccgctgtcctgcgccatgccggcggcggaggaggaggaggagacggtactaccgcctcctatgtcatcgccgagctgctcaggccgtttcatggctcccttcccgatgccacgctcgtgatgtggttgtcgaattcccccgcgtcgacctccggcagcaacggccaatgggtgaaggaggacgttcgccttcccggcgaggtgtgcacgggcaccgaccccttcaccaccgacttggtgttctcgttcggtgaatcgtgcctgtgctgggccgatctgttcatgggcatcctgttctgcgaccttgcgacgctgcgtgcacctcggttccgtttcatcccattgcccaaggcttgctccttcgaccccgtcggcaagtatggccggcctcacatgcccgagttccgttccatgggccgcgtcaacggtgtcatcaggttgatcgacatggagggttttaccaacgagtacctggccgtggatgaggtgaagctgaccatctggaccctgtcagccgacctcagcgagtgggagaaaggcccggtgtgtactgtaggagacatttgggccagtgaggaattcgtcgccatggggttgccgcagcttagaccgatgtgccctgtcctgagcatggttgacgaagatgtcgtctgtgtagtcatgactgaagtcgagattgaggagagcgatgtcacagatttcgacgatgagggcaacaagctcaagttcaaggcccagtacgttcttgacatcgacgtgcggcgtaagcgggtgttatccatcacccagcaccacattgaaagtatgggtgatcttataccagatctcatcgcctgtgagttcactgcatactcggagctctcaaaaggcatgcaggtattactactacgacacccaacatacttagttatttactcacttgaagtatattgttctgttaacacaataacactttccacagttctaatgcttggttatcatgtccagtcagttacatcttagtatctcacgagtaacggagtaagtatattaggctagttatcctactgaactgaactctagatagcatatgtgtgtgctaatcagccatcatgattgtctaatgccaaatgacttagctcttttgccatgctacagccctcctcgtccaaaccaggaacgccattttttcattctgttggtacttctaggaactggagaacgctgtcatagttactttcacttcactacaaagttgtgatggcttgtccagtagatgtatccaattgaattcttgattcagaattgatatagacctattttatttaaagatgttacatgtggtaaattcaaactgagcaccaagtcaccagcaaggttctgtaatgaaatttgtgaaaagtgcaatctatccataacgtgtgggcttggttggttttagctattttacttaaatgcctcttagaattgaccttatcagcatgcccttgtgtgagtattgctcattattattttagagagtacagacaaatggggccaatgataggtatgttgcggcgaggcaactacatcatctgaccaaacctgaccataattcttgtcgcagttgtacgaaaatctcttttcttttttacttctgaagtttttttagcgttgtgtgttggaaaagagatttgtctaactaaaattctctatgtaataagtatagaatcgtatcctctataccatagtatatggaaatatcatgtgtaccagtgtaaggccctaactgagttatgttactttccctagctggtactccctccatttcacattataagactttctagtattgcacacattcatatatatgttaatgaatctaaacatatactccctccgttttgaaatgtttgacaccgttgactttttagcacatgtttgaccattcgtcttattcaaaaacttttgtgaaatatgtaaaattatatgcctacataaaaatatatttaacaatgaatcaaatgataggaaaataattaataattacttaaattttttgaataagacgaacggtcaaacatgtgctaaaaagtcaacggcgtcaaatatgtgtagtagatgtcctaagactatctaggtttctcaatgatgaattttcatttatatatatttggccacatattaatttcctgtctagctctgttaattgtaactttggtatgcactgagggaattattgaagtggattaagaaccattaggccattttaaatttgtctagtttgacatacattaatttgtttctgctaggcaatggtggaaggaaatgagggtgaggaaagcacaaagcggatgaaggttaaatgatctctgcatcatgtggaacttcgatggtttttgcaacatatcaagtaggattaacattgaagattggtgtttgattagcacccatctatgtggaaggatgaatgtgatgtaatcattctctagaagttatgatgttattatcagatggtagtaaaactgaattgctagtgtgttttgttaacgctgatggttttaacattacttcatagctacctttgaattgtctggtcatgccgggctggttgatggctgactccgataagtgatacaagtggtacctgatgatatcttttgtcaaactctagcactccagtcattaactagttgtaaatggaatagtattagtacttatcttaaggcaaaatctcaaaatcgtacagtcttgttcttttatttaaaagaaagaatattctgtgcacaatcttggaactctgtgcggcacaatcttaaaactgtgtgctgtagttttttttttttaaaaaaaagaaaactatgtgctgtaggacgttttgtgtttatatcagactaccaagaaaaagagaagtgaaattttacgcatttccgtgccaatatacccaagttgctacagagtacagaggatactctgactcatactctctacgtccatttgatattttacttagtcaatttttttaacatgtaatcaaatttatagaaaaatatattaatattttcaatataaaacaaacatattatcaaattatatttaatgttaaatttaatgaaactaatttagtgttgtagatgttactaattttttctataaatttagttaaactaaaaaaattttaattaagaaaaaagttagacgttatacagtatgaaatggagagtatctcccaaagttagcacgggaggaagtcaactccaactctccagtgagagccaaaggaggcattttttgaaggcacgatcgactgactggttcgaaacaatgacactactttaggatatttttgttggatcagaggaagtgaaagtttataaaaaaatttcatttgaccatttccaagttgctattgtttggagtgcaccagtttctctataaaatgggctgatcgatctcccaaggttagctttgcaggaagagcttggtcctaccacagagctcgaaaaaaaaagtgctttcgagtagacacgagtcacacgatcgagtgactagcatggccacaatcagaggcaaatttgggatcatcatggttgcgatgatcttggtcgtgcgcatcatcgccttcgcatctgccagtgacaacgacgagctgccggcgttgttcaacatcctgcaacagaagcccgggaaggctgcacaggtcggctccgactgcttcgacgaatgctggagagactgcatcctagggacaccgtttacgagtttgtgcgaccagctatgctatcaaaaatgccttgttggttcccggaagatctgaagcaggcgcttgcattaaggttggtcagatgcatcagtagtgtctgcgctgcgcatctgcgttcagataacagcattgcgatcatttgtttcgtcagtaaattgagtataataatttggcattagcatgcgtcgtctctacgtatacatgagtttgctttagttcgagcattcacaatgtataattccgtatgggtattaaggtggggtccacaatatggataaagcaatgaaaagatctgtgcaatgtatggagcccttccaactctaaaaatgggatccacaaccatataattatttcgtttttttctcttccctatcagtgctctcgttactttgcctgcaacattgtaaaaaagaattgttattttatttggagtgtccgtcctcacgtgaagggccgatttattagggctagggtatgataccgccgcctgcaatgtatagagcgtgtgctacagtgaaaagattctcttagtacccttgttaattcacacattgcaggtgctcttagtaccgcttttttcttcgaggctccaataaatgtttcggctgttcaagccgtcatggtactacctctactatgctgatatcgagcctgttcactttgatatcattttcaaccatactatttttggtaaagttgctaaaaagtgtcttcgtttaatttgttgctaaatttgataaatacataagaaatcttgctaaaattttggtattgccaaaatttggtaaggtttattttggctacaatctgaacaggtccatcgttttgccttcatggatcaataattccctgtgttggacagatatgccttccttttccttgtttatgtcattaattatataataatgtcctgatgtgtgtttgcatttaaccatttaacatgaaagaacacaccgacccgttcatccgcagcaactcctggttggcctttagataacgtatttagagattagtaatgatttaggctccatttaaaagctatgcgacaaacgagagaacgtattttttaagataaaaaaaatactttcccttgattctagacttacaacttgcaaccattatctagctcctttgtgcttctgggcctcgccaaaccagcttatgcctcccgatggtcacggtgaagctatggaatgccaaccacaaaagtagatcaccatcaacttctaactctggcttaatcctcagccaggcgaataggatcgaagttagagtaggtgttgtttgcttcgagagggtggttatggccactctggacgttttggtgtagccgcgggcggagagccctagcttccggcgtcccgcgcgctccccatggatctgaacaaagcgacactctactttcatgaggccactggcccttccgccatggcagaatcatcggagctccgatgataacttgttttgtaaaactacggtcgttattaacgggagagtgaatatggactagatcctgattaatatagggttttttttgagatattatgtatcaggattattaggggcgatcagaaattttgcaaattgctcaaactaaaatcctagctattggtttttagaatacgtaaaagctctgcgtatcttttgtgtcaaggagagaggagttttaaacctttacaaagtattggttgagaaaacaaaggaacacaaaaggaaaggaaaaaaaaagagaagcgtgagccgatatgcgacaagtttggcgatcgataagcgggaggctcctcagatgggcaggccgaccgttgcttcttccgtggccgcacttgctacctctttccacgatttcctctcattattaaacaccatattgttttgttttgttcctttcaaatgtccaggctaccaagatgacaatggtgtcaaagcatctcctatttgctttgtcaaccttcttcctagcgtcgcaccaccactcaatgaagcaagcattgttggaggggaagtaaaggggctgtcaaatggtgtggagcttggatttggggcagtcgagaaggatgtggtcgatggtttctttttgttagtcacagaagacgtaggaggtagggtgtgacagccctcttgtgctcagcatgttcgccatccagcagcgtcggtatgccacaagctaggtgaagtatttgcactttgattgtgccgagctcttaatactagctattagtagctgtagaagattttcaaaatgtcttctacctactattccatctatccaaaccattattatttggattaagatagcaagtaaaattaaatggagggttgaagaagtttgaagttgtcatattttctatcacaaattttaaacgctgtaagtaataaaattattggtagctatcccatttctttcaaaatgcccccggcaaccggcgcttatgcctgtcgccgtctactccgacggccgcctcgtcgccgccatggtccgatccctagcaggcaccgcctctcccctccctcgagctacatgttgccaccacctcacaagaaaaaggacaatatataccactccattcgttgggtttcgataaaatgccatccactacgatgcaaaagataaaatgccactcagtaggttatcttcggtatatttttgccgctttgagaaggcttaagactaaaatacccctgttgtggagagagaggaagtgagatagaagccggacggcggccgtggtcgccggtggcgagcacgcgtggggcgggcggtggaagcctgacggcagtggagaaagaggaagagagaagggagccggacgacggcagtggtcgctagcggcgagtgcgcggggagggggagggacggtggagagagaggaaaggagaggggagccggacggcggccgtagttgccggcggcgagtacacgggaaggtgggggaggggcagtggagagagagagagaggaagggagggggtgccgtacggcggctgtggtcgccggcggtgg

SEQ ID NO: 79678 - DNA, 2160 bp, Oryza sativa
tccgtggccgcgcccgacacgccacccgcgcagcggccggagacgaaggaggaggaggaggaggacgcgaactacatgagcatggatgaggcgtacgcgctggtgatggcggcgcggcagcggccgccgccgacggaggaggaggtgaggaggtcggaggtggacgccaaggcggaggagctcgtcgccgagttccaggacgacgagcagaggcggcagcgtctcgactccatcttcaactacacgcagatgctcaagcggccatcgccgacggaggagggggcgaggaggtcggaggtggacgcggaggcggaggagctcgtcgccgagctcccggacgagcagaggcggcgccgcctcgactccatcttcaactacacgcagatgctcaagcagcgcgcggcggccggccgccggccgcaaccagcaccggcggcggctcagctttgactcacgtggttcatatggtttaacttcatttgattctttgatcaaatcaggaattcaggattcatttgcaggagaagaattcggatcagatttgagtttgctcttgtgttttgtatatagtatttggtttacatgtgtgcttggcttgtcaagttttgtgcagattacttgcagtgttgttgctgcaggaaaatttccctttttcagttttgggcttgtgtgtatatacggtactgttctgttgtataattttgtacacacattttacatgtgattttggacatatataaattctttgatttatttatgaattcattcatgttttacgtaaattgatcaatattgtgtagcatcatatatgtattattttacggatggggattctctgttacatcctctggtcactaagactgtgttctctctccggcacacaaaacgatgttcgtattaatacgtaattaattaagaattagctatttttttaaaaaatagatcaatatgattttttaagcaactttcgtatataattttttttaaaaaaatacaccgtttagtagtttgaaaaacgtgcacgcagaaaatgagagtagggagttcggaactcccagcaaagaacgcagcctaagtgaagattgtggtatataggacaccaacgcagtgtccctaatgtaatttttttttgccaattgttgaatatttacagaacaaaacaaaaattcgagaaaaatctacatgttctgtattttctatgtatccaatctaattagttaagaagacattggtattcaaagtttaaaggtttgaccacatgtttacaaactacttcaaacgcattgcctttggtcggcaactaaaaaacaacacggcaaattctcaatacatattatagcatactctacaatttttttttgaatctctatattagtctattggtcaaaccaaaagctagtatttcattgttgcaccaaagcatgtgactaaatgaaattcatatgttcttttttatttgatggcttttaaattcgtactaggcattacggacagggcctcctctaattcaaagcccaacacttgtaatccgctcaagcccaaagggcccccagaagatttgccccctctagttgtctgctctatcgcgggctcggcctttcgtcgaacagctggtgcgcgtcctctcatgtcgagcacctgaccgccggtcacgtagcggcggcggcggcggcggcgcggcaagatgctctcccgcgcccggcgcctccaccccacccttcagcgaatcctccggccagtccccccttccgcccatcctcctcctccttcttccccacctcaccgccccgtcttctcccaaacccctaaacccttcttccccttcctccgccgccacctctcgaccaaaccgccgccgccgcaggcgccgccagagaagtcgctggctccggcgaaggtgagctccgatccacctgccgtcagcgcgaatggcctctgcccgggatgcggcatcgcgatgcagtcctcggacccgtcccttccgggcttcttctccctcccttcgccaaaatcccccgactaccgcgcgcgcctcgcccccgtcaccgccgacgacacccgcatctcggcctccctgaagtccggccacctccgggagggcgaggcggcggcggcggcgtcgtcgtcgtcggcggcggtgggggtgggggtggaggtgga

SEQ ID NO: 79679 - DNA, 9797 bp, Oryza sativa
ctgcgcctctccggggtgcacctagtcagcgcggcgcgcgggtggggcgtgctcgacttgctcgaccacgttcgccagctcgctgggtcgcgtggcaatgtgtgggcagtgggtgcgaggaatgttggcaagtatacactgctcaatgccattgcccggtgctccgggattgaaggcggaccgaccttgacggaggcgccggtgccaggaacgacccttgatgtgatccaggttgatggcgttcttggatcgcaggcgaagctgttcgacacaccgggcttgcttcatggtcaccagctgacatcgaggctgactcgcgaggagcagaagctggttcgagtgagcaaggagatgcggcccaggacatacagattaaaggtgatatatatttgcacatcacccactcaaccccagtcgtgtttgtgataatgcgcaattgacatagttgctgctcattttctaaatttcagcacaaatttcttgttaacgagtctagattttctgtagttctctgcaacagaattgaagatactttgcttaagctaaacttttgttcccgcattgaaagtagttcggtaaatcaattattgaggaaatgctgtggaattgaaacaagcgaacagacattgcatttacaatgttcttgtgacatactagtcacatagggaaaactattatcaactccatcaagttccacaaattgttgtgaacaattctagcttgttctagtcctttataacaaaattgaatctgcttttggttaaaagctattatcgattcgaccaagttccacaaattgttgctttccccctaaagacagtgcagtaattttgtaactgaacctgacaagcacatgatactggattggacagaaaatttgcaccttttgcacttatgaaattctaagtcttaaacttgtgacagtttcagttcttagacttatgactgggaatcatggctgactcaatctagatgtgatcctttggtttccaaacactcttctattgccacaggattcttcactcttattatgtgtcatatgagatgatgcatgcttatctaaaacttgttggtaacctatgcagccagggcagtctgtacatattggagggctggtgcgcctggacatcgaagagttaactgtaggatcagtttatgtaacggtatgggcatcaccacttgtcccacttcacatggggaagacggaaaatgctgccgctatggtaaaagaccactttggtttgcaactacaggtatatttattacctgaatgaactttattttctcctaattcatgtagtattgcttaagattataacacaaagttctacatggtgtctttcctgcagcctcctattggccaacaacgggtaaacgaactaggtaaatgggtgaggaagcagttcaaagtttctgggaacagttgggatgtgaattccaaggatattgcaattgctggtcttggctggtttggaataggtctgaaaggagaagcggtattaggactatggacatatgatggtgtcgatgtcgtctccagaaactcccttgtccatgagagggcaacaatatttgaggaagccgggttcacagtttcgaagattgtctctcaggcggatagcatggcaaataggctaaagaaccctaagaaaataaacaagaagaaggataacaaagccaattcatctccctccacagatccagaatcttcaaatccagttgaggctgtagatgcttaaatgatttctattcctttctaggacaggagttcccgaaggtgaattaagttctatgatgttggcatttggtcagttgaggattgatatacagagccataggttgcacaatttatacttgttcagacttagatagcatgctgctctccgcacaagtctttttttttttccctgggatcatggattttatgtagtcttgttgtgggcttgtaacattaacctatggcttttatgtactcaatgaacttctaccactatggctttggagtttggaccataagtacaattttgatagtcaacttgatgaggagtcagtactgaagaatactcgttgtaatgctgttatggctgaacttctgaaaccggcatctcacagctttgttatgcctgctttgaacacaggaattttacattgattttataggaataccacaggaatcaattgaatcctcatggtaaattcctgcacttcaaaggaggccatatctgaccatctcctaagttatttctgcttgaaatgaacatgagcctccagaccgaaactttaaccttaccctgtttggatgtatgaagtaatcaatcactctgctctgcatgctgaagctaatattagactttatgatgtattgcacaaaagtaagtaaagatgatctcaaatgccagatttgtttggcacataaagatggtgtactcttttcaacccaaatcatgggatgccatctttgacataaagtacaacctttatggattaatttaacgaaagcatctatatgaccacttcatattaataaggtcggttgttaatggtgtgcttaaccagaattgggaaagaggaagcattttggtctaaatgtgttttgtttgctcatgcattttggtctatcagtgccaaaccatgtattactccatataactacctctatctacttcaatcgaaggccaaatccgactacctacaataaaatgtttactaacccctgaactttgataatggtacaaataattccatgatggttttaaagcaatttcgccaagctaactgcacgtgtgacttcacaatcaggcaagttaaagtggcacccaataagacatggttagaagagaaatgtagatgagctaaatatataacttattacaagagaagaaaaaatatatatttccattgatatatgctaactctaaatcaagagtagtacaatcatcattagacaatattgctgttgccccactacacgctgcatgcattgcactatatataccaaagtaccaaacaaaaccaattaccaagaaaatcaaaatcagaattgaacaagttgtgcataccgaatctagtttaagttattcaggttgtcaggaacattcaattacacataaaacaattcaattcatgttaaaaaaaaagcactactccctccatcctaaaatatgtgctccttctaacattcaaaagctaaattatgaggtgagaaaaatgaccctggatgtcacttattaaatccctagattattggaagtggaagggtcgttgggataagacggggagaaatttgaatagtgattgatgtgataaataatacaaagagcattctttccgaacaaattttgaatccgaaaggagcaattattttgggatggagaataattgaattaatagtaaatttcactttgaactatctttaataacaaagtttctccatgaattaaggttgctatttgttactgtttggacctgtctgtgtccaaaatgtcaccagactaccacaatagtaatgatttagcccaacaaatttgagacaattagtggccgtccattattgcgctaaaagtttgcttgccaataaatggaagttgtcacttccagtaaaaatatactccaatagaagttgcatcgactgtgtcattaagccgacaaagcagcctctgggtggaggtggatgctactcctacaaagatggatatgtggcacccccttttgttggtctttggaaggaggaacaagttcatgtctcactagctaactagctagaatgagttccaattattgatcatgcatattgtaatgtggtcacaacctatagcttagactctaccaactaaatgcaccatgcttgagcgtggccaaatatatttctcaccagtcaccccagagggccagagacccaaacgtgtgatcggaatgtctttaagttaaacttttaaaacttttaagtaccaatatatttttaagtacaaatttgtattaatttatctcaaaagatagatttcataatgtttattaggttttgcaaatgaattgcaatagaagctagccgcaaacgctaattagcgactagtcccactctctttccaatttttttctctttttattgaatttttcttttcttttgggctccccctaaatttatggctcaatccgagatagctgatttcttgtgtatgattttttttctatacaaagtttcaacaccagtagaaagtttctatatgctagtacaaagtttccatattgtattgaacacggcctgtttgcctttttcatgtgctgttcaattttttctagatgcttatgtatatatacaaactctgtatattatgcgtacaaactttttatgtctaaaatgtatacgtgtacacaaactttgtatattatgcgtgcaaactttttaggtttaaaatgtgtatgtacacgtataattttatttgatattatataaaaataccccccccccaaaaaaaaaaaccaagcacggggagaccataatggggtgcacatgaaaatctttttttacgtccatgagtaacatgcatggcgtggagaacaattaattccattgaagaagtgtatcgatttttcacttttgctataaagtagtatatgataaaatccttatttatcatgaaagttgacttcttattcttaacatgaatcatgttttggaaaataaaaaattgcgtgaaaaattctacaatgacaaataaggaacaaaatatattgagaagcgcagcatgatggtaccctgcaattaattaatgatgcaaaatttcatctcatagtcgtagtacgttctagtattaaaagataataaagatgaattttacatgattgtatataccttgccctattgaacaaatatttttcccacaataaaaaagagagataatttaaatatactttttttgtgtatttgaagcacgggagtaccaatctttttggaacttaattgtatatactccatccgttccattttaagtgcaaccataaattttcgtgcctaactttgatcgtccgtcttatttaaaatttttttataattagtatttttattgttatgagatgataaaacatgaatagtactttactcgtgacttatgtttttaaatttttcaaaaacttttgaaataagacggatagtaacgcgaaaaaatcatagttgcacttgaaatgggacggagggagtatattagaagtgctctcccatgccgtggtgctagctagaggtagatctctctttatcacacctacctagcttagctgccttttatgtcttctctgccctgtcattttactgtcaataatcgaaatcgaaaccaatcacactcgcgaccgaccgacgccctagcctagccactgcacgctgtttccaaaaagaacggatgaactttttgatagatcatatcgatcgatcattaattggtccatcttttacgatctcgattgattgattgattattgatgatctggttcgttgccagatgatcattcatgcattatgcacgtacgtacattggcggagccagaaattttctaagcctagggcttgagtaaggctcaactaataagatattggctttctcaaaaacaatacaaggtgatttaaaaggatttaggcatgtttatggaggcaagcctagggcacacctctgcgtacgtatgttctgaagttgaagacaacttatgtatgcaaatatttaatttatgtattcttaattcttgcgatgtttcatttgtcacttcttaaaaatacattttcacatgcgcatggctataaagccattatttctaccggcgtttaattaccaacccgctgatggctccgctattttctttgagggaaccgtctatggaaataaaattttcccatttcaaaatatcatatttcacgtaaaaaaaaaaaactcctaacaccccatatgggttattatatgcccacgcagttgcaagccacgagtcatgcttcctgtagtcttcaacaattgaacccacgacctcaagtctagcatgattctatattaccatcgctctcatactcacaaatgaatatcaaaacgaatatttggacccaaaataatttgaaataaaaaaaattcaacttcaaagttgtagtcttatccagggctataatttttatataaagtttgtccagccttacatttttagatgcggtttcttaagataactgtatgcaaaaaaaacattttttcatgtgattttagaccacaagactacttgtcattatcacaagagaatttttctattattcacttttagaaatgaaaccagcttctttggaaaaatcgttttctaatagtgtttgcaaataccaatgcaaacacatgtatacatcatgctctttattaaagcagcagatcgacttggacatccattaattaattatctatatatctattatgcatgctctattaattccttattgactaagttttcgatcgcagcacacgtagatgaaccagttgacaagcaataggaagggaagggagattcgattttaggcgtgtgaagcttcggaatgagggaatctagctcgagcaattgtttatatgcacgcataagtgtataaatgtaacttaaatatatacttttttgtgccaaaagtaattgttggttttgtcttcggattaccaagatttgatcaacaattttgttataaataaatttaccatcgaagttgtttcacaattagatttatataatcaaaagtaatttacaaatatctaacaatcaaactaattccctttgatgttagcacttatataaaaatatgaagtttatcttctttcagtcaaactgagagggagtatcaactagctgaggaccaattactgatgtttgatgccaaactcatgactaagtgatgccgagatgtcaatgtcccttgatttgatctgcctgcatacacactactggtacagcttttgagagtgccaaagctccccaaaaatgatttttgaagctgactggtagtagcaactactcgcgccgtgcatgaatatgctctagggattagaagaaatagaattttgtggtgctaggcttattctattttactactttataattaattgtaacctcaattttttgtgtggctggcatgatcttcgaaattcacaagcatcacactaatatgtttttcttttcttaaataatttctgattgtcgaaacatgatttcggcaataataaaagggggtagcgcaaccaatgataatgacaaagacgctcatcagcatttgcatagtaggtcaaccgtcaaggtgaaataataagtcggcgaaaacataatcatccattagcaacagcggagatgtcagggccgatgaagcagaggtgctggtgacgatgtcagtgacaataatccatcaaattaatgttatggctattgtagatgcttcacttggaggagagttgatgttgttgtctaactcgtccaaaccgaaatatttgaagttgttgaagtagaatgtctgctccgaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatccggtggtgaagacgcgcagttgtgaagataaaagcaccagtcggcggcggcataaccagtcggcgacggaagacgatgatgtccatcagtagtggtagctgtataaccagacgtagaggtaagggcactagtcagcagcagacgagacgaccggcgatgaagatgtaggtgcccaacaacagcggcataataggccagccgtgtaggcggtgacaccagtcggcggcggatgaggcggccggtcggtgaagacgcagacgcccatcaacggtggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggccggtcggtgaagacgtagatgcccaacaacagcggcataaaggccagccgtgcaggcgaaaacaccagtcggcggcggatgaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacatccaacaacggcggcataataggccagccgtgtaggcggaggcaccactcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaagtcg

SEQ ID NO: 79680 - DNA, 16533 bp, Oryza sativa
ctattgcccatacctgtaaaagcagtgcaatgtattttcaaaatgagcatttctgttgcttgctcagctggattggtgcaattctattaaaagatccttttgaaagataaagattttgaacgggttcagagctaatgtttactagcattccatggaaagtatctggtacgtttttcattagtgttgaaagtaggcagtggactttggactgttcaatggagccatgtgagtatgtgacacgccatcttcagatttccattttttaaatatagaaattatattttgatatctgtcccaacatgtacccctaaatacgtagcacagttttttttttagttggaggagatttgccttcttacgccaaatgtgcaacacgagtttggtattgacactatactttgattccaaggacatctacctttaaatcttacgttttgtattatgttccaccttgccttgtgctataaatttctgcttattggcgcataatcactctgacagagtctgtatgatcaggtggacgtcatacattatattcgtcgatactgaagtgtcatgacttgacgagaagtatgtacatactgaaagctgacgccatgttggtatgatcaggtgacctgccgccttcgtaggtttcagctgtgaagtcttcatcaggtatcaattctactcctatctgccacggaaagggcacttcctattggatcagaactcgaggatgaatggaatggtacgtgatccatgaccgttctcttgctgtgatgctgtctgctactgtatgtaggatatgaaggaaagcaatggaattaattagaattcttgcgtgtcagcaactgcataaactctggaatcaagtttatggttcactgtttacactgttcccccattttagcatgatctttccgattacatgaatctattattccctctattacaaaatataacaatttctagttataaatctgaacatgtattttggaacagagtgagtaccattcattcacttcgctgacattgcatgcatacttaaaagaggtaactgggtattataaaaacttgcttgtactcctccgcattcactttaatttgctggcattacatgtttataagagaggtaaatgagcattataaaaacttgcttgtacttctctgggagaatgtaaacgtcaaccctcatgcctacggaagtaactagctatgattatactaagccctcaagctaatcaatgaacaagcaaaaatctgtgtgcaactccgtgttgaccctttccctgtcaaattcaagcgtgtaccatcataatgacagactgtaaacaataggtagaatttcacttctccaacgcacttcatcgatcattttactcttttatatatccttccttcagttccttagaatgtttgcatcaaaaagcatgtgcccctgcttgtttatttctggattggagttcccttaggtcctaatccagatctctttgggagctgtgaccagtgagctctgagcagggcacccctcaatgcaagtctcctccactctaaaacaaatcactgtcataatctctactagttctctgcgagtctatgagtcagagcatgcatccatgagtctgtagtcctatagatatcatagctcatgcctaaataatactattctttttccaagatgttttgaccatattaacaatgcacgggatggtagtattagcatatggtttctcacatcacatgccatcgagcactggacaacaggacaagtagccaagtagtactgtagtgctgaaactttaggaagcaggttcttccttccccacactgaagtcacttcgggtggaatagaatggacacttctggctttggttcggcatggatgtatgcccaggtgcctgtcacgctttgggtccaatcattcagttgtactggcatgggcggtggtcgttgtcgtagtgctctcaacttagctagggtgatgaaaaattttctttgctcatttcctttggccataatacaataatttggctaacatgattatcaaaactagcgacaatcacatgaaaacatggaaaagattggaaacatatatatgcatgatattaacgatcggacaatttcaatctaacattagcatactacagtatagcaaattttcccttatttttgtactagctgtggcaaaacagatgtctccctgttgtattctgagctgacatcttgtcactgaaacccattacctcccgcaggatttctgcgaggaggtagtactccccagctcactgaaaccaatagagaaatggaagaggtgggccgacgcctcagacctcagcttttgtgatttctatgcgctgaccacacgagtggaaagaaagaactcaaagtagcatgtgtgcatactcctatgttgcataggcaacctgcataggtactataattaattaatttacatcatgcatagttgctctattctaattaaggcttttcttttggataaatggtctttaaaggaaattcatatgattttccccatattttttattttatggaacaaaggagtaggggttctagaatcatgtgaaattccttaggaatggcttaacacatggtgattttggaggaaaattaatctgatgtccaatctcattcgtttttcctgtcgtctatcaagttggtgattatttccgtatgtttttttcaatgttttctgatcttctattttgcacatcagcacatgcgttggtataaaaaaaaagtcctacataattgtttcttattcctgtattctaccgttcttgctttcggaaaaactctataaatagtcgaagaaaattcgacgtcaatgtattttcttcagctattataacatggaagtgtttctaataaaaatggatcggagaagttcgtcttaatgattgttcatgcttgcggcactagctaagccatggagaaattgttggacagtttatgaatcatctgtgcgtgctagctagctatacatatgtaacggcaaaatagttactccttttttcatcctaaaatatcataaattttaatcgaatgtgacacatcttaatactatgaatcttaatagggagtctgtctagatttatagtactagatgtatcatacacatcggatcaaaatctatattttaggatggatgaagtaactaagataaatagcattctcagaaggcatgaacaaaccatgaatatcttgccttttctttatccctagaggttgtatttttttccttctatatttaatgaaaaagcacactctcgtgctggttccattcaaaaaaaaaacatgaatgaatagtttgcatccgatccgttacactttttttttcaagtacctgcagtagacgactagacattcatgtcaagatatatatttttttcgtgcaagtttatatagagcttgattataggctggcttaaccggtcgatagtcacgcgtcattttgatgccggctgcagcctgcaaacgaacgaaagcaaagttacaaagacatgcgcagctttcctgaagattgcatccaacggtttccccgaaatctacgacttaaagtttagtaactgcaatatcattgtgagggtaattatgaacttctgtaaggccctgcttaatttgagatttcttctaaaaatctaaagcccgaccaggacaatgatcttacactaaaacaagattactattaggaaaaaagttgtcatgcatgtataaacagctagctagcagcacaacatgtatatatgtacaaaggaaaatgcatgctttagtgtgtgagctcgcaaaccttacagtatgagtttagtgtttctttcagataacttcacacgtagttaattatcgatacccgcccacccctaatttattgacaatatattgcatgctagcgcatcgcataaatatccttatcaatgtactgctaatggctggacttgtacgttaatccaacccttcccatcggcatcatcaacgcagaaactactgttaagtaacttaagtttgccaagctcaagcttaaaaatcctggtgcatgcatgtagctaggagtatagcccttttctgactttctgtgtgcgggaagcaaaaatacacctgcgtgtccatgtaggcatgtagctctccctgtatagtacatctctctctgtctgtctctgtctctgtatgtggacttgtggagcgaccaagatcatatgcaccatgcgtaggagtatggctgcatgcacagtgcgcgctagctgcagcacactgccgcattctgatcgatcagggtgctagtatatagctagtcttttgagctttgaccaagacgtcaagctgtgcgtgtgtccggccgggcgaccgaccagcggcatgcagatgcagtgcagcaaagctaagctaggatcgatcgatgccaagtgaagtccatagacttcacgtggggggggggggggggggatcggatcatgcaagaccgtggccacgggagactacacacgcagtcacacggccacccaggccagctgccgcctgccggccggccatgccagccgcgcgatcgacgtgccactgaacgcggcagcggaatgtgtgcgagatcgacacagtagtggtacagtgtgcgtgtgcgtgtgtgatggatgtgtcgacgcgaaatgggatggctagctcgacctcgcatgcatgcttgcttcacgcaatcttctagtagccctttttaagagagcgaaagagctagcagaaagatcacaaggggaagagaaaggaagggccagcgagggccgggtgtggttgtacaaccagcaagctaggctcttcttccatgccgtggctttaaagtctcatcaataccacgagaacaaaacaacacatagtagtagcagtacgacaagcatgttgcagtagtatagtgtagccaaagtacaggtgcaagagaagaggagaatactgtcaggaggggagaaaaaaaggttcaaggagaaggaaacagggaaaaaaaagagagcaaaaaatccagagatggaatggaactgaaacttaacccctgtgcctatgaccttccaccaataggacaagcaccaaaaggagagagatcggggaggcgacttcagtttccatattacgcatatgcccttccctcctccacttctaccactgccataataataccatcaccattcctcctcctcttcttctcttgctctcctctctcgtgctccatcgatcgatcgatctctaccaacacaactacacacttgtttacctagctagatcatctcatcaggtataagagctctcgagatcgatcgagcaatgagctcgggaggcggagccagcagcgcgctcggcggcggcggcggcggcggcggaagcggaggaggaggaggagggccgagcggcggcggcggtggaggaggcgggccgtgcggggcgtgcaagttcctgcggcgcaagtgcgtgagcgggtgcatcttcgcgccctacttcgactcggagcagggcgcggcgcacttcgcggcggtgcacaaggtgttcggcgccagcaacgtgtccaagctgctcctccagatcccggcgcacaagcgccccgacgccgtcgtcaccatctgctacgaggcccaggcccgcctccgcgaccccgtctacggctgcgtcgcccacatcttcgccctccagcagcaggtactactaccacttgcttaactccatgatttgatttccaacgagtttgatatcgactgatcgatccatcggcttgattgattgattgatagtattgtttgatttgcttggaaaatccttggtctacttctgctgcgtgcatgcatgcatggaccgatcgatgcgtatggatctggatcgtcgtcttgtcctcaagctagctcatcagcagttggggggacaagacgattttctggagtaggcgtgtttctttctcgagaaaggcaaggtctctttccatggaggaaaccaacacggccaagccaagcaacgagcagtgcgaaaaagaggctaacacgccaagcgtgtaaccaggagactgtttccctgcatctggtagtacctgccatgaatgatatgcaagtctcatccgtcgccgtccgcgtcgtccgatctcgatcgatctctatcgacgggatcgatatatgatcgtacgttcaccgtctggccgcgtgtgaaatcttgggctctgaacaatccacgaagtggtgggagtacttgtgcttggttttcgatctgacctctcgaaagaacagccctagcgccaatctctagtcctagaaatccaaactttgagttctttttctaccaatcatttgatgatctgtttgcacaattcaactcgttaatttcatctcgttattattattacatgcatgtgatctactatatgtgattgcgtgatttgaaccttgcacgtactaacagttttttctgtactgatgcatgtacgtttctgccacgtacgatcttgtgatcatgtactcccacaggtggtgaatctccaggccgagctgacctacttgcaagcccacctcgccacgctggagctgccgtccccgccgccgctgatgccggcgccgccgcagatgccgatgccggcgccgttctccatctcggacctcccgtcgtcgacgagcgtcccgaccaccgtcgacctctcagctctcttcgacccgccgccgcagccgcaatgggcatcgccgctccagcagcagcagcaccaccaccaccagcaccatcatcaccaacagcagcagcaccagctccggcagccctcatatgccacgctggccagggcgccgtccggcatgacggcggcggcggagagctcgggaggaggaggaggaggcggcggtggagaccttcaggcgctcgcaagggagctcctggatcgccacaggtccgcagtgaagctcgagcagccgccgccgccgcactctagatcatgaacgacgatcgatataatcaatcgatggagagcgaggcgcaagatttggtgcggcatggacagagttcgcgacgacgaggaggagagcaagcaacgggattggaacgggccggtgatggcgagcaggtcagcaaggagtaggtaagcagcaatggccggttttcgcgtatccgccttgttgttagccgagggtgcaagaagatgccccacttgctgcttggttacaatgcggctttgcttcaattctgcaggctgcaggagaggaaggtggtacgggggagcttcagtagtagtatagctttgacatgtaggagtaacatttgtcactggtagcatttgtcaccgttccattaattgaaagattttaagaagcttctgttcctagtaaccgctgataaatgaaagagaaaaaaaaactgatttcatttttttgttgcgactaataactgtgagttgtgatggtcgtggatgaatttttgggcgtgctcatcttgtagttatgaatggttgcattttatgtggaaaggctataattaaaatcagctaccgtggaaaaattatactgctccatcgatgtattatttaataaaatatagtctgtaagtattaattaggtgtgcatgatgtaaaaagtaaccccctctgacttcatcataggttgagaacattgttaactttaaccattcttatccactctaaagatccaagtccatcttggtacagctgaaaataaaaagctgaggccatcttcctagggaaactattctaatccctcgagggaatgttccctcgtttactcaaaaaccatttaaatggttatgaaaaattctggaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggaatagtaggtatcattatattctacattattaattttttttagattttttcacaactatttgcatcgaatttgaaagaaaaaggtatacgagaggatatcccctcgaggaattagaatccactcccatcttcctatagttggaaagaagctttaggcatggttgctagtactactctccaatatcggtctctgatagccagctagctgatctaacaagtctactctctctatctctcaggtctcacattaggaggtataaaagcatttgaattttccatcattattaccaacattttaagtagtacattatatagatattttgagggtcgatatatatggatcagttttaaaagtggttgatttgaatataccttcgtatgcatgaataatagttaaaggcaaaatgcaattaagaccatgttaagctagccaatttatacaaggagttaccggtggagaaaccatctttactcccggttgggaaccccctttaatcccggttttccaaccaggagtaaggatccgggactaaagatgtccatctttaccaaccgggactaaggagacaatagcggcagtgcagatggtttctttttctttttcttttttcatttttattttctcccgaatcaagtaggcaaatccctaaatctaactaacatcccaaattcacatcaccaaatccacatcacaatcataaagttacttatacacacaaatcaaatacatcacaatatcctaagaaattactcaaatacatcacagatccaaacaatgaatcacaaatttctaacttctcagtcaaatacatcacagtgaatcatcacaaattaaaaaaaaaagaagccgctgccgccgccggtcgccacgaacgacgggcgcggccccgccggccgtcggccgccgcggccgcggccccaccacccgccacgggcgccgccgcccgaagccccgccgcccgccgttgcagcgcgcggcccagccgccggccggcccgccggatgggaaggggaagccggccaggaaggggagagaaggggaggagaggaggaaggggaggagttggagaagagagttagagaggatagatttgaggagaggtgtgagattcgatctgtctaagttgtaactgtggaggagagaataaggtatagggattatatactacgtgtttaattttagtcccgattggtagttggtgatctttagtcccggttattgacatcaaccgggactaaagatcctcggccctctgacatacatctgacagtggatgaaccggaactaaagatcatcttttgtccctaaagatcaaaatttttataaccgggactaaaaataatctttagtcccggttcttcttggatgtggaactatcgtggattttgccggaccgaccaaagatgatttctctaccagtgagtagctcagaattactatatataccttaatttatatgatgttcacaccttttcttttacaaaataggataattaaacctaacctctacgtccaaccgatgtacacagccaatgcgatgttcacataactactagtagtaattatttatgctggcgtgcagttgtcttcttctgttctttggtcatatagtagtttatgctgtgtattccatagttaattactgtacgtatatatatatctgaccagcaacctcctgccgcaagccctggcctgtcaattgacgcaacgacatgtatcattctccacgtacgcatgcctctcttgcgtgttatcgaaaaaggctaggttagtgaagaaacattgcgtgctttcgcgcacctggtgttatttattcatatcactgtagatcattccatgggtcttaaacatatgatgctacacatggcgaatactaattttccgtggccacgaagcgctcaatattcgccatgtgagccatccatgtcaaccattgcaaaagtttgcagctgaactggacctggttctactggtcccaatttatgatggcccattagtcacccaacttaggtacagcccaaagaccatagcccatgaaagcctccgcattgactcctcggcccctattgcgtcactgggcgtcgcctcccctttctcgatcacccgcgtattattatccccttattaatagccgcaacccccagtaatctcccactgacattacgggcccacaagtacgcgtccccaccagccatagactgctcctagacccgtcgcaccgaagctcccctgccaaatctacgcacgcgacgcggccatctctctcccttctcccccaacctccattagccgatccaaaccacctcaaagccccggaccgcatcactctccttctccccccccacgcccagatccagatccacccggcgcggcggcggatccgtcgaggaataatggcttccccggcggcggcgccgccgcctaccccgccggagtccgacccgcggctcgtggaggccttcgtgcccttcctcgagaagctcatcaaaaacgcctcgtggcgcaacaaggcgcactccaagctctcccacactgccaagtccatcctcgaccgcctccagaacccgccgccgccggcggctgcggcgcaggcaccgtccacgcccacctcccccacgacgcccacctcgtcgtcctcgcagccgggcccgctccgcagcctctcgctcgcggactcggagctgctgctcggcccgatcaactccgcgctcggctccggcagcgccaagctcgccgaggccgggctcgagctgctccacaggctgatcgcgcactcctacatccatggcgaggccgacccgtccgccgacccctcggcccagctcgtcgcgtccctcctcgatgccgcctgcaacgcgcttcacctcgacgacgagcacatcgagctcctcctactcaagacgctcctctcggcggtcacctccacgtcggtgcgcctccatggagattgcctgcttcgcgccgtgcgcgcttgctatgatatgtacctgggaagccgcagcgtggtgaaccaggccactgccaaggcgtcactcgtgcaaatgttggtgatcgttttccgccgcatggaggcagactcctccacagtgcccgtgcaacccatcgttgtggctgatgtgatcgagctgcctgaagctgcttctggtgcttcgcctgccgctgatgccaactttgtacagggattcatctcgaagatcattggagacattgatggtgcaatcacacctctggcacggacaacttcttcagcagctgcaggcgcaggtggagcagcggctcatgatggtgcatttgagacaagagcagcagaggaaggggcacatccagcagatttgcttgattcaacagacaaggacatgctagacgccaagtactgggagatcaacatgtacaaatctgctcttgagggtcgtaaggatgagattggtgtggagggggcagtggtgggcgctttggatgatgatgctgatgtgaggattgggaataaactgcgaagagacgctttcttggttttccgggcattgtgcaagctctccatgaagacaccacccaaggatgctccagctgatcccattgtgatgcgtgggaagatccttgctcttgaacttctcaagatattgcttgaaaatgctggggctgttttccggaccagcgagaggtacagctgctctttcctcgaattcagtttgtgtttttgtttcacgctgtttgcatcctgaatttattgttatattaaccagcaacatcaaccaaaatttggttcatcactttattgtttattccatgaaaagtggtgtagtaacatccagctgtccaagtaggaaaaagctcataacttatcatcctgaaaagatcaggcattggtttgctaatggtagtgcagttgtggataatgttgctatgtaaaattttgttaccagaagtcagttctgattgcaattttatggaagttagagttgcgtgatttctatttatttcataaatatcgaggctggaacacattgaacttaaaccactgccacttttctttgctgatgttgattccaatagtgacaactgttggcactgatataagcgtataggctgcacctagtaaggcatagcactgtttgaccgttaattttaatggactatgcaattggtcaattatcctaacggtagtatgcacttgtatgctgctggcattctgagctttttgaatcagaattttggcaaaatggcaactagtaagctaccaaaatgaagcccaagtggatggattgaaagtcctgctctatagaatccatgtataaattttttattggaaagatccatggcctgatggccccatattccttgcactgttctatttgattatagcaagtttctgcaagatgatgactgcgatgtgttatgaggaaaaggcgagctttgcactgtcattttgttttgtgcaacctgttttctagtatttaaattggtgcattagatctgctgtactttatgcttggaaaatagctgaaaatattgagagatgggtttgtcatgaagccataaaaaatggacgtataaaacactaaaatcttggactgaaagttcactaagcccacccctggaacagtaagtttccgtaacaacttgcttgtttcatcaccacttagcacacaaagggttatctggaaatatatatttgtattctcaagcattatttgttagcattacacttcatctgagatcagtcctactcccatgacaactactccacatggactagcactaattcagttaggttgttgccctcaacttttcttctgaagctacactcatgacaggaaaccatattcactgcaaatggccatataatcaccactcagattaattttaaggtcaggaaacttgatgcccaaaatttgttgaaataaaaatgatgaacatagcttatgaatgattattaccattcacctgtccacttcgagcatcttcttttcaaatatgtgatgaacgcagtatgtttggtttgtataggtgatgcaattgtattttgatattgcacgtgccattgtcatattactctatatcagctaatgtagagctgttacccatcttcttggtgcttttgttttcttgaatatttctagttctaactactttgtctcaatttatacagatttctaggggctatcaagcagtatctatgcctctcgcttttgaagaactgtgcctcggcacatatgatagtctttcagctatcttgttcaatttttattagcttggtttcaagattcagaccaggattgaaggcagaaattggagtattctttcccatgattattctgagagttttggaaaatattgctcaaccaaattatcaagcaaagttgattgttcttcgtttcctggaaaaactctgtgctgattctcaaatcttggtagacatttttctcaattatgattgtgatgtacactcatcaaacatatttgagaggtaatttataatactgtaattgagctatagtgagcttctttttaaaggtccccccgaaggacctataacactcattaggatgctaaccagatattgtgttatcttaattttggactacaggatggttaatggtctactaaaaacagcacaagggcctccagcaggcgtgtctaccacattggttccgcctcaggacaccacaatgaaaagtgaagccatgaaatgcttggttgctattctgagatccatgggagattggatgaataagcagctacgcattccagatcctgactctcctaaagtagagtcggagcaaaatgataatgatggaggacacgagatttcccacacagaggataatggagacgaatgtagtgaagcatctgattctcattcagaaatgtcaaatggggtttcagaggctgcatctttggagcagcgccgagcttacaagatggaacttcaggtggatgttattccatagttatttctatatgtgtagttgttggtgggaatttgctggatgctgtcctttgccgtatgactcgctgctgttctgttgcatatttgattttatccatttacttatctgtattggtcgattgatttatatgaatggcaggagggtatctctctatttaatcgaaagcccaggaagggaattgagttcctaataaatgccaacaaggtgggggaatcacctgaggaaattgctgctttcttaaaaagttcttctggtttgaacaagactatgattggagattatttaggggagagggaagatttatccctcaaagtcatgcattcatatgtggattcatttgattttcaaggcatggagtttgatgaagccattagagcctttcttcaaggtttcagattgcctggagaagctcaaaagattgatcggattatggaaaaatttgctgagcgttactgcaaatgcaacccaaaggccttttccagtgcagatacagcttatgtccttgcttattcagtcataatgctcaacaccgatgcacataatccaatggtaaaaaataaggtatgtatcttattggctaagtttttgtgtaatataccatagacagcctttggttctgttgtgatgtattaattaatgcagatgtcaccagaagatttcattagaaacaatcgaggtattgacgatgggaaagacctgcctgaagaatttatgaggtccttatatgaaaggatttggaaaaaagagattaagatgaaagaagaagaatttgttccccagcagcaaaaatcaacaagctcgaacaaaattcttggattggataacattcttaatattgtcgtacgcaaacgagattcacgtatggaaacaagcgatgatctcattaagcatatgcaggagcaattcaaagaaaaggctcgtatgtccgagtaagtcatgctagatgtctagatggatagctcaatacctgtatacactaaatgcatgttttccttggtcatttttctttgctgcccatttgatttctgcaactacattattttactgatttgtctcatgtcaattatttatctagaatattttatgaatgaatcaggtcagtattctatccagcaacagatgtagtagttttgaaattcatggtcgaggtttgctgggctcctatgcttgctgccttcagtgttccacttgaccagagtgatgatgagattgtcatatcccagtgccttgaaggatttcgcagtgcaatccatgttactgcagctatgtcgatgaagactcaaagggatgcatttgtcacttcacttgctaagtttacatcacttcactcggctgcggatattaagcagaaaaatattgaagccattaaggtttgttctacttactgtgatgcaaatattagtagcgatcagctgctatcactggcaggaaattactacttttgttgttaccattattttgaaaaatatatggctgaaaattattggaatgaaactgacacattgatgttttgtttcacttttactggcttcaggagtatagttgtatctttctccctttgactgtttcatattattggattgtctagcgcatgttgaatgctcgtgaaagtgtaatatctgaatttagtgatgactggaagcggctggtcttgtacttgttagaactgctataaactaactttccattaaagtttaacgttagttccttttggttggcattttgaatatttgtattatgcttttcgttctaatcatattccatggtgcttattgcatggttttatatattagttttagcataatcataaattcagccttttctgttctcatgctaatttgttgtggctacgaattgcttcacaggcaattctattaattgcagatgaagatggaaattacttgcaagaagcatgggagcatatattgacctgtgtttctcgttttgaaaatctacatctcgtaggagaaggtgctcctccagatgctactttctttgcactgcaacagccggacctcgataaatcaaaacaggctaagtcatccattcttcctgttttgaaaaagaagtctccaaatactgttccagcttctaaacgaggttcctatgatagtgctggtgtgggtggcaaagcttctggggttgatcaaatgaacaatgtggtgacaagcctcttagaacaagttgacatggctgaaatgaatcgtgtatttgtaagaagtcaaaaactcaacagtgagggcataattgattttgtaaaggctctctgtaaagtttccatggaggaattgcgatctgcttctgatccacgggtttttagtctgacaaagattgttgagattgcgtaagtacagggcttcctatattcagattgcaatgtatttccccatacttttctttgatgtatttatagtatataggcagtatatgattgtgtttccctttctcttgtaggcactacaatatgaatcgcatcaggcttgtctggtcaagcatatggcatgtcttgtctgatttttttgttacaattggctgctcagagaatctctcaattgcaatatttgctatggattcattgaggcagctggcaatgaagttcctggaacgagaagagctggctacctacaattt

SEQ ID NO: 79681 - DNA, 7405 bp, Oryza sativa
gaagaagcggaaggcggaggcggcgcggctggaggagacggacagggcgctgtacggggcgttccggggcgcggccaactcgctgtcccagctctacacgctcgccatgggcggccagaagctctccttccaggccggcgagcgccacgccatggtacggccctccccgaccctcccgtcttcccttcttcctgtgatgggttgtgggtgtttgggggttcggtctgatgtgatgtgatgtggtgtgggcgtgttgttctggggatgtttggggatttctcggttttgcagcgggaggattcggtttccccggtgaatttggcctttctgtggtgtttgtgttgtggggaaaggcttgtttttcggctcgatttgatgagggatttttgttccgatgcgccttcttgttagtgaaattcagattccctaagaaatttgtgtgttcgattgacccctctagtgatgtggaaattttctgaaattttggtgaaattttgattatgctttctgaaatttaggtgaaattttgattcctgtatgttttctgcctgaatctggtacctaccatgcacatataaatttcgaatagtgggtaaagaccaactaattctgtatgcaattttagttcgtagtgcgtcccttgacctcaccgaatattatattcttcgtgatgcgatgcgccaatacaattgatagcttcacaagtgctctcgcactagtagtgcgattctcgtagttgttatatcatcagttgccttttaacggcgatgcagccaaactcatttgcttcaattgtcggtgatctttttctccaataggttctgtgccaatatggctttttccacctctgggttgaaatggttgtagacatcccacccttgtgctttacaagactcaggattaggttgctctcagagggggaggggaatggaaagcagatgagaggaggcttagcttgtggaacaggttacttctgcactagtactatggatgcatccttttcagctttgcttcaacttgtgtactgttaaatgtaaagtatcgccagttggtgtgggatgcttctttcagacttggatggcattgttagcttatgcagttgcggtttacgaggatgttgatacttagttatgtttgctgattttggttttgctgtggctctgtggatccagtcctggcctattctggtgctgtttgacttcgtcaagcatcaaaactgtctgttttcgtttcctcttaaagacttaatgtgatgtgcaagacttttgcatgttcttgcaaaagctttggacggcatatcttggtattaatgcttggaaacatcctgaagctatggtttgatcagaactcaagatgtggctcagctgtgttcctggtctttgttttcacaggacagggaaacactctagctaactaccattgagcattgtctgctttactcatcagatgacaatattactagactctcatcaaacaatacactagccaatgcattggatattggcattgtttgtacatcacagagtaatgctttgtgttggcatttagagaggtttatgttttctagtagcccaatgcaatgtcaactaggatcaaagaagttcctgctcatttgacatatgccttacaaacagagttagcatatagaacagttacttcaatggattcttgaattttgtactttgaagacagatggtcgttgcagggtgtacacatttagttctttgcaaagctttctgtttcattgttaagtatcccaaataaaagatgggttccatccctacttctagagaaactccaaccttcttaatggctggagaactgttcatgccaaactgtcttgttttcctccacaaaatgagttttttgttcttccatgtggacaattcttgctgtttaaagccaggagcctattttctgggttctatacaaacattcattaatcacatagttttctgactctgttgcttgtggtgaagtactggacgattccctccggtcatggaaacatgttgttttggacatggacatgatctacaagatacagttttggtcactaatttctattgtgaaatatttggaaaccccaaaaaagattactatgcttgttttttgagacaagacaatccacagatatgattttcatgcggccaatctaaaaatttaaaaatataccttgtgcaaagtttataaagtttgagttgaaagttgaagcacttcacatgttatcgtgactggagggagtattggctgccatcgagagtaatgacggttgggtcacgcatacctaaaacctagacatattttgtacagaaaaacacatttctcttctttttcaacatttttttctttgactactcgacatctgtttcattgttttgtatttccccctttcactagtgtttctcaatctttttctaactgatgcaggaaaagctctatgaatggatcttgaggcagcatgaaaatggcttgaggctgacagttgctgatatagcctcgcacatccaggtttgcagttatcatcctccaagaactatttaattatcctctaaatttataacatggccttgaagaacttgtttagattttcctttcatgctcattgtttttttttgtgaatacacctgactgcaaaaccctaatgaactagataaaactccttatttgccatttaatgctaactcaatggaaacgcggcattcccttactgccactagttcactattgcctttcattatttgccacgtccgtcaactctgttaggatgaaacaccattaaccgtggatccaccttttttttttttggaaatattccatttgtaccctcacaaaatgggtgccatctttttcttctggccatacccacagcacctaagtccatccgttgccatctagaattctagatggacctgaactggtgccactgtttgttggcagaagctttggctagtcagcctctgtggctccaccaaatgctcagcaccatgatctggcttgagaatccggtgagcttgcatttgtacgctgctgttcttttggggaatggatgcagggatagatatggcttggaaatccggtgagcttggatcggtgtcgtatgattgaccatgtttttcaggttatatgggaatagcaattttatgctacaagacatggtttgattgggcattaggtgagtataatacttctagtgccactccccagcaagcttgaatcctctagacctagtgccatgctagacacaagtattaagtgtctggtcttattgttttggaatgggactataggattgtgcagattgttattttttttgttgcatagcatgacttcattttcttataagtttgtaaaatttgcgaaagtacttcctggatttggtggataccaccaatgtggcggcacatctcttacatgccaccaaggatgaccatgctagatgcccatgaatctgcctcattggaatggatgcaggcattaggcacacaacccatattcactagccattgctggtaaggatgcctacctttggtagagggtgagtgctctgtcatgtgttcaggaagaacgaagccgctgggttggatgagtttactgttctgttgctggcattttttttaaatttaccatggataaggaagagaaggagaaacgaggaattaggaagaatgaggaagggcaaattatcttttcttgtttagtttaacagcaagatgacagaaggggcaaatgggaagacaaaatgaactagttgcaaataagggaacatcatttttttatcctgtaagggataaggtttatatttgatggcaaataaggaaatgaataagatgaatcctatgctttgattgttttctttgccaattcatgcctccaggctccagctacaacttttcaaaatatagtttgtacttatgccgtatcttctccttaagcaccatcctagacctagcacaactacatgtgcctaataatcatctgtgtttgtagcacgagatccagtatggaggtgacaatgcatcagcctctccaagatcacagcatgcaagccaaagcactcaagctacagtgcctattcccaacacaatgagccagcagccatcaccaaacttatttgcgctaggaaatacaggattggtgcagtccaagaactcagcggtcttttcaaatgcactatctagccccgttcgccggagcctgcaaccattccacctggagcagggtggcgatgcggggtacttcgcaaacggcgttaaccgcgatcaaaactcgacggcttcgaacgattcatccatggacatgcattcagacagcccagctcatgactcttactgagttgtttgccccctctgtggagctggaagagcaacacttccagtggaacagaatgtgtgcctttgctaccacagctcatgtaggactattcaatttaacccccctcccctagcctccaatgatgctaagcttgtattctgttgctgccaatcaccagttactagtaccgattacattgctaagatattgtaacttgcatgtatttatgtccagagtaaaactgtactcggtttacctgtgcatactactacagttggtatgtggtgaaaatgtaggtggcaaagcaaaattgagaagaataaacagtattgtactgttgttccctctcctagactcctacgctaaccatttctgaagttgttatcaagctgtcgttttgttctgtcattcttatagatatactaacgttgactatttgttttatttgaaaaaatagtgtaaatataaaaaagataaatcacacttaaagtacttttgaagtgtacttttgttgataaagaaagtcacgaacaaaataaataataattttaatttttttaataagacgaatgatcaaatattataaataaaaaattaaagtgacaagtaatatgttataaataaaaacttaaagtgacaagtaatataggatggaggcagtatattttaaatttattcccaagaccaaaaacagtgcgagtgtgatcacatcatcacatgtctgctgtgtatgctgctgctccacagtaatttttggtgcgtatacggtcataaaagcgttggcataaaagcgttgaattgagctatagtattctcttttggcttgatgtgaagtgtttttttttgtttacgtgattagcgggattgtgtactgatgtttgaattttttttttcctgtaaaattttaaaactttgataaacaatatgtttcaacacaccttgagctagcatttttatatttgatatctatcttaaagagtattttcatgaacatactatttaattatttattctaagaaataattagtcaagccttacttcaaaaacacagaaagttatgtcagtaattctttttgactgttgggagtggctcatggctcctgcttgcgtactttgggcagtttaggggcactgtatcagtgcattactgaatcagactggttcaactgttctcttctttattttttggattggctagttcaactgttcttgataggccttggggtaggcagggcagtttatactccttcagaaatgagtcaggactctggatgttaaatcccacttcaccagtacagtacatttcagctgaaataggccctcaaaaaatcaaaatgcagagaaacagaggattcagactttcagattcacagccgccattacttctgactgctgattcttcagtccatatcaccaacagtgtgcatctgtataccgtgggtaggtggtgtgaaattaagcactagtagacaacaagtccataccctggatagacaaggatatttggaatgcaggattttcacataaaaatcaacagtaaactttattttatccaagtagtatactaaaccgaagaaaatcctcacatcataatggcaagtcttaggagggttgtagagggcacacatcactataaacaactattaaagggattatcacactcatattcagtgttctttgaagtagaaattttacaggatttcacaggttttagtatgttcccctaaaatctttaaaattttccattccaagaattgagtcaagaatactttagactatgacatgattaatttatagcaacaactcctacccctacattctagtgcatcttgtgtgcactattatataggagatatttaaccatttgccacatttagatgtgacaattaactttttgtcattggacccatatgtcatagacatatgtggacccacatgtcattgagataggggtggcaaatagttatttgccaaaactaaccgtggcaaatagttaaaagccccattatatagggtatctttaaatcatttcggaatgaagcgacataggaagcatgtttatacattcataccaactcctaccacttctaccgcatccaaagcaggtttcccttaccttctgatgagcggccgtaagttgattcccatggtaaaatgtaaaggattgaacaaaaatttaccaaaaaaatttttttttggtagtagggacgtagggttaccatttagaaagccttattgttctcgtatccctgtgataaacctatttaccatggtagctgaaatcgtgacccgaaactcaacctttcgaatatagaatatgcctatcgattacagccacgctaatgatttattttgggacggcgctaataatttattttgggatgaatagaataacacgtaacatggcctaacgcatatgggtattgccctggaaaaaaccctgcgcgtctacagcgacttgctacttgaaaattttcagttgctaggctatctggcagggcctcattgaagacagggagtgtttgaggagaaggggattgaggagattgggaagatacgcaaaacgaggtgagccattagctcatgattaattgagtattaactattttaaattttaaaaatggattaatatgattttttaaagcaactttcctatagaaattttttgcaaaaaaacgcaccgtttagtagtttgaaaagcgtgcgcgcggaaaacgagagccaatctcccctatcacccctaaacgaacgatgcctaagtgtcttggcatgtatagtagtaactgtgttggctgttgtagaacactgaagataacgctggaaggcgtcaatgaatgctggccggccattgctgcgtttgccatgatcatcatcaatggtgatatggcatcgacatgcatggtcagaattgagtgttcatgccgacagcgatgcactgctccctctgtcgctgagagttgcactttgctctggtagatattttttgaccgattgtcgacggctttttataacttatcgtaaaaacggcttaaaaactacttcatatatattggccatattcgacagctattgctactgcagctgtggctgc

SEQ ID NO: 79682 - DNA, 51107 bp, Oryza sativa
  unsure (1)..(51107): unsure at all n locations
cctcagatgccttgtgaggcttgcaaggttgtttcgattgaacacaagtatggcatttggaacctttgaccaaagtgaattttggaattaaactcatgttagctaagcgcgtcatacaaccgaaattcacatgacagagtcatgaatgccacacattagactcatctttctcgctaatatggttcacaacattatgattattacacatgtcattcaaagaaaagtggaacaagcctccgctgtcataaccttttccaacaaaagtcccatatttagatacgacacatttattggactcaaacacaagtctaaaaccttctctacataatagagagccgctaacaagattcttctttattgaagggacatgctgcacgttcttcagctgcacggtatttcccgaagtaaacttcagatcgaccgtaccaacaccatgaacagccgcaagcgacccgtttcccatcaacaaggaggaacctctcccaacctgataagaagaaaacagagaaatgtcagcatatacatgaatattagcaccagtgtccacccaccaatcaggtgagtgaaaaacagagagaactgtaggtaatattttaccgtaccccgatgttcctccgccctcgctaatgaccatgttggcagacttcctgtctttgcgctcaggacagtccttggcccaatgcccagacttgccacacacaaagcagtctccctttgcctttcccttgcctttcttcttaaagttggttgcagccttaggtttgacatcaggcttgactttcttgttgttgcgggatgcatgagggttcttcttctgtaccatattggcactagaacctccctcaacctttttgccccggacgtcctttgccctcgccttctcctaaacacccaaagagtcaatgagatcagaaacactgaactcttgtctcttgtgctttagaaaagtggcaaagtccgaccaagaaggtggcagtttggcaataatgccacctgccacaaacttgtccggcaactcacagttgttgttctcaagttccttagccagcatctgaatctcatgagtttgttctactacagaacggtcatcgaccatcttgtagtcatagaactgctctatgacatacagctcactgccggcgtcagaaactccgaacttggcctcaagtgcatcccacatgtccttcccagaaggcatgtgcatatacacgtccactatgttgtcagtaagtacactgatcaatgctccacggaacagataatccgaagcctcgaacttagcctcttcctcaggagaaagaggtggttcacttcgtttgccccgtgaaacatagaagcattgcatcgctgtcaaccacaatagtgcacgtgctttccatctcttataattagaaccatcaaaagcatgtggtttcagtgcagcagcaaagccaactaccgaaaatgacctatcaggtttttggattgttggaaatatggtcataaatcggcatattttaatccaaaatgttaagacaataatcatggcataaacagtgtagggtgatctagtgacagcatgtaacattaccagtagcatactaaaggcatcatgaacaacattatgaatatcaggaagaagaacatagcagtaacgcggtagcatgctagaggcatcatgaatatcaggaacaggaacatagcaataaagcgctaacaacaagaacaggaataggagaaggatataccctgagaatggccctccgctggattgtgaggcagaactgcctccgttggtgttgttgttcgcggcaccggctccagctcctggtgcaccacctccagcagcagctccaggtggcgcaccatctccgccatctcctccagcagcagcagcggcaccggctccaggcgcagacatggtgggcgaggacgaggacgagcagtcgtgcgggaagcactccccaaaaacctgatcacccgcctacccggtgcgcagatctcaggagaaggtgtggttccggaggccctgctccttccgatctctcgtacgcacaagcgatcagaagcgaagaggcgagagcagcacaagcgcggaggaggaggaactaacacccgggaaagaagcaagcggatcgttctgatcggactcacggcctccttatctatcggatcgttttgatcggactcacggcctccttatctattaggagagaggcagtcatgggaacgtgggatcgtggacgcgtccttatgaagcaagcggatcgttctgatcggactcacggcctccttatctatcggatcgttctgatcggactcacggcctccttatctattaggagagaggcagtcgtgggaacgtgggaggcagtcgtgggaacgtgagatcgtgggcggtgcgcagatctcaggagaaggtgtggttccggaggccctgctccttccgatctctcgtgcgcgcaagcgatcagaagcgaagaggcgagagcagcacaagcgcggaggaggaggaactaacacccgggaaagaagcaagcggatcgttctgatcggactcacggcctccttatctattaggagagaggcagtcgtgggaacgtgggatcgtggacgcgtccttatctatcagtcgtaggaacgttctgatcggactcacggcctccttatctatcggatcgttctgatcggactcacggcgcgtccttatctatcggcctccttatctattaggagagaggcagtcgtggaaacgtgggatcgtggacgcgtccttatctatcagtcgtaggaacgtgggatcgtggacgcgctgttgcggaggaacgtgggttagtggttgcaaaagagtagcgacgtgatgtgacgcacgccacgcctctccctcggcccggcgcgcgcgcgtgtggctttccaacccccacctcaaccagtcaacagggagcctccaataactccctatttaggttgagatattcctcgcttaaatcctgaggtggtattattattcttaacacttattatgggcatctgagattcaataggataaattgggcatagcccatttattctaacaacatataggagagagtttggtgaacagcaatcaccaactgcatccggtgactcacacatgacttccctttgattacttggctacgagaacgtcctttggttaaactaaaagtctggtaaagctggtcaagtagcgttgttcgtccagcttgccgacattaccacgtaaccgaaaggtaacacgaatcggacctcgtgctaacactgcaattaagctttctctaaaacaaagcatccaaggaaggtggtaccttcccttcactaatctatttggcaggctgatgactcggagaactgaagcaaaagtagcccgtccgtgtcgctgtcctcctagattgtggaggttccagcggcctgcttatccccagaatcattcgtaacctgggctcgtatctgattccttgatagagatcctgagtgtcgcggactcgcggtgtgcagtactggattactggtagtgatgcagtgaggagtctccccgccgtccccggaatcattggtaaacctggcacgtatctgattccttaatcagaatggagttttgcttgagtgctggactagtggtactgtgtcgtgggctagtataccgtgtataagttaaacaatttcaactttaactattaatagtgaaaaataaaaaataataatcacgtaaaattgatgttactagatttgtcattaaaaaaaactatcgtaatatgtaactctttttcttaaaacatcttacttctatatagatattgttagtcaaagtagcatattagagatcgtgttgagtctatattttaagacggaggaagtagtagttttgtttgagtgctggagtagtggtactgtgtcgtgggctagtgtaccgtgtaaaccggcaaaacgccgcaccgtaaaacaagcgcacatgggtaccggccacgggctctggggctcgtggcagtcgtgggtgggttggggggacacggcgcgcgacggcgccacatgcgcggcagcgcggccacccgccgaaccgcgcgcggggcggagagggatcgagagggtgagggtgagaaccgcgcgcggcgccccaccgtgcggggcgttgttgtcccgtgcgccgtctcccacctcggtttcaccgcgggatctcgcgggcgcaccggtgtttgcgcgaccgtacccccacccacatggcgcggctgctgtgctggtgccgctgcgcgcgcggcacatgtgccaccgctccatgcccgcgcgttctcgtcggctcacgtggccgcgtcgggttggacacgcgtaggctgccgtctctctcagagcaacccgggcacatgcggacgcggggggacgcacttctccatgtgtccgccggccgtacgcgaggcccaagggccaacgccactcctcccgcggtcccgcgacgccaccaatcgtgccgcgtcgccgtcgccgctgcaatttcgtttcgggaattcttggagattggcaccgacccggatcaggggcggcgacgcgatcgcgcggtgccattatgcccgttttattggcttgtttcgatatactactccgtattaaaaagaaaaagaaaaccctggtctcaccgagatctatatgcatgtttctctgaaagtctgaagttaatcacgcgcccaaaatctcggagttactattggccaagagagggctcgtccaatcgtccttgctgcaggcacgtgcttttcgtacatcagttacaaggaacacagcaattccaatcctttcacatgcatctatgcaagcgtaccacacagatggccgccgaagcatggaaaatggacgcctctaactccggaagaaatgtcacattgatacgaactgggctagcctgaaagattcacaacctggtacagctaacttaataacaagctgcaggacgatcgaagaaaacttgggggaaaaaggcatgtgctgaaaggacaacatcatttccatagatccactgttggatacttaaacggctttaattatgagatttagattctagatctctcctatcagctgctccatggcctcccttcacagctaagaaagccgtgaatttttaggatctatactagctactataccacttccaatttcacatgactagctcctgtattttcagttgagtcttactggtatttcttttccgtccatcctatctactctctctgtttctagttttacgatattgtttagttcattttaaactaatcaacatcaaagagaataaatagagagtatattctgtactcaggattcgtttcatcagctcgtaacaatcttaccccttttgtcttccgtcactcacgtttcagctaatttttcgtagtaacagtgtccatagaacctccgcatatctactgctcctagtctcctactacagtgaacgtaccccaattcccagatgatggagtttccactttccaaagagagtgaactagcttaaccttgtttttgccttgacagcttaggccctgtttacttcacttcacaaacaatctatgtcacatcgaatgtttcgacacatacataaagtattaaatatagattaaaaaaattaattacacaaattacgtgtaatttgcgagataaatcttttaaacctaattgctacatgatttgacaatgtagtgctacaataaacatttactaatgatagattaattagacttaataaattcatctcgcagttttcagacagaatctgtaatttgttttgttattaggatgtatttagttcacgctaaaattggaagtttgattgaaattggaacgatgtgatggaaaagttaagtttgtgtgtgtaggaaagttttaatgtgatggaaaagttagaagtttaaagaaaaagttgggaattaaaccatacattagcctacgtttaatactttaaatatatatccgtatatgtaatgtggcatgaaaaaaaaaattgttcccgaactaaacaggctctcatttacggctaattattctttcagtggtaggcgacgtacccgtcgacagcgaggcgtctgtggtgacttcatcaatttcaagatatgccagcccagtcttccggaggtgcttatagggatagggtatacatgtgtgagttcataggggtgagtgtgcgcacgttatgagcataagtcggtgattcaccatccaggcagtggcttggatggcaagcaagaaggcaagcggtggaactgggccatcactgacacagtgacgcgccttaaccggtaacgcggcccccacggttcggtgggagcggaccagtcgcgtggatcggccatcatcatcctgatatcgctcgcgtgcgtgcaagctgtgcgtggcaggtgtgaatcagatccccgcgtgttgtattccgtctccacctagaagcgtacgtacgcggtgtgtgtataacgcgagcggccagtcggtggtgctgcctttgcctgcgtattttgcgatcgtttcgtgaaggccgcggcttttctctttaatcggttactgccgagttggggttgcagccacaagaagtagaaacgaacgtgtacctgttcagctatacaaagtaaacgataacaaaattctaatttgctacttacaaggatgtgctatttagggtttgtatttatggtcatgttagcttaaggtaataaacaagaggaagagagcataatagcagaacctctattttccctacttatatctataaattacatgtaaacactccactggtttggcaaacaaggtagcagctgaacacaagaaagaacaatctgaaaagggaaaagtgggtgacaggtggccaccagggatgggccagtgaagctgtctctcttccccaatcgagccgctttcccctgtccgaacgctacaaaaactttccacacgccaccctctcccataccaccacatctcccaaagaattccccgttccaggcagccgagttcggtccaaagtccaaccccgcgactgcatacaattccactcgcccagtcctctcccgcgaccgccatttgactcgcagggagccaacgccgaaaccgcgccaatcttttgcccccattttagacgggcgctgactgagccaaacccaacccaacccaacccccccgcccggcgcggccacctcacaagggagcatcggcacagccaaccgcagcgcagcggcagccaaaaacccaccgtttccaattcctcgcccgattttgaaccgctctccgcccgaccgaacctgttccactccgccgagcggaaaaaaaaaacttcttcgccgtctcgaaggaaatttattgggaagaaaccgttgcgggaggcgggcaaactgaagcggcagcggcagcggcagaggcgatggagcggtaccatccctccgaggtgtatgagctcttcgtgcggcacatgaacaccccgaggtaagggttctcgttgctgttgctgttgtggtgtgttccggtttgggatcatcgatcgaacgggtggtgagggtgctgttgttgttgcgcgcgggcgcggtgtggtacagggtggtggtggacagcggggtgtgcgcgacggcgacgctggtgcaggtgcacagcgcgcggaagcacgggatgctgctggaggcggtggcggcgctgtcggagcacggggtgtgcgtccgcaaggggtacatctcgtccgacgacgggcggtggttcatggacgtgttccacgtcacggacgccgcggggaggaaggtggccgacgcggacgcgctactggcgcgcctcgagtcgtcgctgtccgcggaagcattgccgcgggcggcggcgggcggccccgccgcggaggggctcaccctgctcgagctcgtcggcgccgaccgcccgggcctcctttcggaggtgttcgccgtgctgcacgacctccggtgtaacaccgtcgaggccagggcgtggacgcacggcggccgcgtcgcagcgctggtgttcgtccgcgacgaggagacgggcgcgccgatcgacgacgcggcccgggtcaggcgcatcgagtcccgcctcaggcacgtcctccgcggcggcgcgcgctgcgcgaggacggtcctggctgatccgtcggcggccggaaacctggaccggaggctccaccagctgctgaaagaggacggggaggccgacagccgcggcgccgcgccgatgacggcggtggcggtgcaggattggggggagagagggtactcggtggtgaccgtgagctgccgcgacaggccgaagctgctcttcgacgtggtctgcaccttgacggacttggattacgtggtgtaccacggcacgttcgacaccgacggcgatcacgcgcagcaggtgagccttccagctgtttctccccatcatccagctttcaagatttgttttggttggtccaatttccccaagtctcattgttaattttgggttcggtgttaccaattcccctctactctgttcttctctttggttgagctggcttcctctcacgaatctagatgtttctttgggtggttgtgttaggcgaatcgtcttctgtcatttttttcccaaattcttttacctcgcttttgctttctaatgacgtttaccgtttcccttctttttttgtttgatttcactgctattcctatgtcggccccatcgtcgatggaaattatgatttcgaatttggtgaggctgatggaatagttgctatttgcctcgtgtgttctgcttcgcgatgttggattaaaagttgcattttttttgggtatacatgtgtactagcttaacctgagctatgtttgcttggcttcaccgcttgcaggagttctacatacggcgttcggacgggcggccaatcagctcggaggccgagaggcagcatgtgatccgatgcttgcaagcggcaatcgagaggcgcgcatccgaggtacgtgatggagtagcagtagtatctcctttgctttccctccatgccacgccaccgatcgcggccgtgctgtgctgtgcccacttcgcagcaccaagccgcgaagtcactttcgttcttgcccgactttccactacaccccccatgtgttcggccgaaatcccagccagcgcgcgcggtgcccgtccgtctgacgcgatcttttttctgtgtgcagggcgtgcggctcgagctccgcatctccgaccgccgcgggctgctcgcctacgtgacgcgcgtgttccgggagaacggcctctcggtgacgcacgccgagatcacgacaagggacgacatggccatgaacgtcttccacgtcaccgacgtggccggccgccccgccgatcccaagacgatcgacgaggtgatacagaggatcggcacggagagcctccgggtggacgaggagcggtggccgcgcctttgctcggcggaaggcgacgccgccggccgcggcggcggcggcgggctgttctcgctggggagcctcgtcaagaagaacctcttcagccttggcctcataagatcctgctcgtgagtacagatgacgtgtccgatccgatggcatgcttgtgtaaatatgggggcggtccatgggttagtttgtaaattgagtagatttttttatgctctttttttaggatttattagttgtcacgtgtatatagtagaaatgaaaaaggctgcttgtcggtaattaacagcttggaggtttaaagggacgcgttggtgggtcatgcatcttttacatggaaatagacagatagaagatgaatgtaaatagggtttgtacataagtgctacttaatgatgtttaactaaaaggaactatcatgtttgacctgcaaatgcaactagtgtcaattctcatttgatcccttcaggcacctgttgtatgcaatgcaaatgggggcatgttttctgtgaactgtttttgcctgattgttataggagcctagtaactggtgtattagcggcccataaatattaacgtaactcattccacacacgcaatctttacatatcctgtggcaactgaataatttacttttatcactgctgattgtaattgtaaccacttgtttacaagttgtccaaaagcgctgccatgtggccagacaagagaaatccgagaacactaaaaatattaccaactagaatcatctaaagtctaaattaaacgaagtgaggcaacaagaacgattaatcaacggaatatgacagccgattcaacatgcttaggttgaactaaagaactgtgctccaatcctcatccatgtcaaaaaccctttgtacgaacgtcgctttaccacgaagaagtaaccgttttcaatgtatttgccgacaaagcttcactgtccatgcgtataaaaccatttgacattgctacagcctcattaaaaagtcgttttgagagagtccaatggccacttaggtgtccatgcgtgacatatgtgctcacggcttttgtccccgtgaaaagaaacaacaattaaagagggggaaaatatcacaattgctcacacctcgcatcaccgcgcgcggcttaagtatttaaccacgtactcgcacggaccgggcggtgccttgctatcatcgttggaattatggccgtttctcctcttatcaacgcaccaggatgcacacgaagtccgtgggtttaattccttgcgcgacgaggacgacgctgacgctcgcttagaatttttaaccggaccatgtcacgccgtgcggaacgaaccggcttaccggtttctgaacgttctttgcctgcaggttttattacgaagcgatcgaggagaaacccaacaactgccgacctaccgccaactgccaccgatcgaatcgagctgaaccaaaccgaggcgtgtgcatgccttggtgccaacgaaacgtcgagacgatacgatctcggttttgctttcggggcagctgtgcgtggtagtagctcaacggaagaaaacgacctgtaacctttttagtttccgtttccctcttttccgtcggagatgggcatgatgtaggtagctcaagttcgtaccaaaacttaattggggattgatttttgggggtgagccgtagggttccttgtcacgtgaatcctccaaggacgacgggtggatgtagcgtccatagggagcaaaacgtgcgggaaaccgccacggattagccgatttatgatcgaagctagccaagttggcaatttggtgaaatgacgatttgcgagctcgatcagaatcagccggtaagaagactgaaaaaatgaaaagaaaaatcatgaccggactcgaagctcgaattcattgcaagtttatccggacgtgaagcattgggcgaagaacaatgaatagcagtagatggcaatgctgctcatcagggtcccctttccttctgcttgtgttttctgggcccggatctcagctggtccaaccagcctttctgctactccaattgctgcaggggtttggtctggactatgtcggtattgttgcgtgccgcgtgctagacctactcctaccaatctgcatatcgaaacggcatcgttttcagaggacgacccttttcctggcttcgatctcgacaatgaaactagagctgctggcgtcctgtctggccccaagagtgtacatactcacaaatacttttttttctttctgttagtgccttaaaaatgacagctccagttggcaagaactgtcaagtgcctggcaagcaaggtagacggctagacgcttccctctgcctcgacccttgcccgtctggacgaccaaggtaatggcccccagcatcggattccttcatacagcttgggttgctgatcaatcactggatcaactgcatgtcctgattgctttatgctgtactcctgtagagccatcaggtagaactgtacaagttactacaggaacagcgatagtacttgaagttgacagtactttcatggttgcaaggtctgtaatgcggcaatggctaatcactgcataaattgattaacatagtgcaggaaaaaaaatgaaacgaggcaacaactggatccatgcatttcgtgctgcaaaagaatggttcttcccctgctccacaatccctaggagggcagggagaagactatacagtgaggtaatatgtggttctgtacaaatgaatttgcggcgtttgccagttttggtgaagtttgtgacgtggttcacacagatatttacaaccatgcacaaacatacgtatctgagagcttttcagtctaaacagggtcactgcttctaggaattattcttacaggaaggccgactggcgtggggtcattagtatcagatgtgccatgtcgagcatcttcatccttctgcgggagatcagcaaaaggaagattcaacccttcctcaatgtcagagtcgtccatataccttgtagtggacaaatcttgaggtcttctccagctgctgctacttctgttatagcttcgctcaagctcttccacacttccatcagacacatcaccagagtgataactggaacggttaccagcaacatatcgatttccaaattccggaggctccagaaaacttccttgttgaccagtagaatgttcaggtgcttgatcccaccaatcgataatatttcctttggtatcatggtgttctactggagcatgatgaaacaaattgcttgatgtcgatgcatccatatggcttcgaaccctttcatggttaaagttccactcatcgcgatctgctcgaggcgggggaaccatatcagagtcccagccccttgcttcttcaatttcagatgctttaaatgctgctgaacctgtgttctcactggtctcagggaacacttcgttgaaataaggagcctcggttctatccaagtgaggtggatggcagacgtagtaccaatccagaatatatggatgacttctttgatctgtgtcaagcaatcctaacgggcccaaattgtaaacagcaggtgagatggcctcagcacggttatggatatcactagggagtagttggtggaagatatcatccctgtgacctctggtgcttgccacaaagcctgatgcttccattgcttgatattgtgcaagagcctgctgccgtatttgcttttccttgaacttttggaggttagttaagaattgtttgccttctgcatttggttcccatgatggatacacactttgaaaactgtaaacaatcatataatagaattagacctatttttagcattaaaccttgggctgagctagcttgtattaagctaggccatttgtatcttcgaattttgcaattggtaacaaccaattacaagggcgttgtgtcctacgcctggatctacccttggctgcaacacttgtgactaactaaaacctcctaactatacatagtacaaagtggccagtatccattaggcctgtaggacaacagcagggcacattgcatacagttggaagttgggtggatagctaatctagtccctaaagttccaccagaggctcaatttggtcctttaagttctattttgtccacacaggtcctctaagtattcgttttggttcgaaatcatacttgcacccacttgattagccaataataagtcaacatttctattacaaaatatcccttatctaagagaactcattgtacacaaatttcaacagaaaaaaaaaaacagcacacaaccattgggtattggaggggtcttgagaaacaggttcactggccaaatagtacatatttgtctttttcttttcctttttcttatacatgtgaaattagggaataatagtcatttatcaagagagatgctaattagatttagctatatgtcttcacaagtgggtccaacgatgagtttgaactaaaatgaaaacatgaaggactaatggtctaatatggacggactgaaacgtcaaggaccaaattaagcctcaagtgaaacttggagtacaactttgcttattctgttattcactcttgaaaatgcaatgtacatggtggactaaagtactaaaccaaaaatggatgtcgctttcttggaatatgatgtgacgagggcagcaccgtagtgcctatattctacagagtctatagtgctgacaagaagacacccaaaaaagtatcatggtcaagtgttcagctttggccatatttatggacaaaacagtatactcaaataatactctggtaaattcaattaaatgctggaaacacatttgttgtgattttctgagaaatattttcatcatatatccatagttaatgttgacttgtacagtctagaccatatgcactatgctgttgacatgggcaaactacatagacaaactaacacatttcctcgtaaaatgttcatagaactaaaatacccccctagtttgaacaagagtatgaaataacaatagcgtgcaaatcataccacagtacaacctcagagccaagaactactaaagtacaccaaagccatttcaataaacaaatgatggcccttaagatatctttttaataacaatatgagtacaatataatagctagtaagaaacacatgaagtaattcaaacttgaaattaaatgtaccttaaaaatgatttctccattttcccttgggagctcctaagcgttttaagtgcatcaaatggtgaagcatagtttctatttccatgtcttctgaagtcaaacaagcttaggctattgaaacacagagaataaatgatgttaaatgttttaaaaacccagtggcaatatatgataacaaaattcatttcttaagaaacatcaagagagaacctgcacacatctcccaccccatctacataaatcgtgaagtctgagatgaatcgcagaatatcatcaacacgctgtataataaaaggagttcactgtcaaagaactttagaaaaaacactgttgttgagcaagttcagaacattacctttggtacctcaaagatgagcaagtaaggagagatgaaaatggaggccatctcttcaagcagcattactatggtaaactgcatttgtaaaattacttagttaaaattcagagcaatatgatatggacaatagagtattaaacgtaaatcaaccaagatacaaatgtaaggtactgatatctagactgcaaagcacttaaacaaagagaaactcattttcttttcatcttcagatatagcgctttaactgaaagcaatataaaacaactagaaaatgccaagctttgtcattagttctatcagagaatttgaacactattatttccagattcacctagcaaaataagcaagtgagactcatttaaaaatgcaactgctgaatcacccagtggccacgaacaactttaatatcaaatgagtttacgattgtcagcgttactgcgatgtaacttagttgggccgtcactttttcatgtacttctctaaggtgggcattgcacttgtacaattttgttgaataacattctgttgagatcaacatacaacctttcatagttctctcaataaagaaagacnnnnnnnnnnnnnnnnnnnnnnnnnnnnnnntggtgacattccaaagccaaattgtacagcacataggacaagtaagtatgttgattagttgattcagtacggtatatgcacattgcacaattctctcagtcaactctttgccaaaccacctttttttcgtgtacttttgtgtgcgcaccttgcatttgtacaattttgttcaaataagattatgtggacatcagcccagagcatttgcgcagttctttcaatgacaaaaaaataaagagcagaatcacaaataactagaaaatttgatgatggtgatggttgaagttccaaagccaagtagtacagtatacagaacactaaatatctaattgattatatatggtatatgcaaaattctctcgaactgataaaatacctgaaatagtgtttcgaattctcttcgcaccacttcactgtcctctttaccacgccacctcttaggcatataatgcgtttgttggacaacattgcacatagcgccttctgggtcaattacttgaagttcatcagccactacttttcgacttatggcagctattgttccaaaaacaatagtataccagaatagatttcttccaaagatcttcagaagatatgaatgtatgtgagatttagtaggtcaataagacatgtgtaaatgtgtaatagcaaatgagaaaaagtggaagaaataacttacatggccctcaagaacagattcacccagaaatccaatgattataagagcaccagccaaaccaccagaaacaaaagatatgaattttgccattatagaaatcagtggagttggaaattgcttcaggtaatttaaagagtgcacagcgctgttgttcatcctatgtctgaagaaatgatctacctgaaattattgtaagcaactgagctttagacgaagaaaaacaaggctgattgcatagcatgatagtatctataggcctcaacaaatggcagagcttgcagttaatataatacagtaagcacatggcaggcatttagaagaaatactggacaggacaatgactgcatcataatagtaataatatctctgcaaaagaaggtacctcattatactctctaaaaatccaccttgataagtttgaccatcttctagatgaagctgtactggggtgattataaatttcttcagcatgtctcagaatgaggtacactaatgggaatattacaaggcagggtgaaaggataagcattgaaatgcccacaaatacaagtcgcttctttaacacagctgggcttgttagaaaatctttccgaacacagaatttactgcagaagaaaatgatattggctttcagtatagttttagaggttaaaactacacacacaaaaaaatcgtggaacatcccaatgcgatgtgcgagctcttgctagaaggtttcagcggatgttgtacaaactggaagctgggagggtatcttagcacaaatacgtctttaggtgctattgtgcaaaatccacataagagctgtttgatgggaatagatgggggtgaagaaaagcatccagcttttacacagattgaatatctaaattactcgatatctctatgaagtcatcagaaaatcagtaaagcagtaaagcttgagttaagatgtttagaatttagtaaccagctagctagagacaattatgcataacatcaacaattctgtattccacacagattgaacataatgtataacaaaagagaatgataaagattggtagggacatttgcactctcttgtgcaattaagtgttattacatgacaacttaagggtgtcttcacccgctttctcccaaacgcaggattaatgtggaagaaaaagatacctagattcattatgttgacagcagagtatttgccaaacaaatgttatcaaaatactttggccgaataatccaatgttagctagttaaaagtaacagagctacagacttccttacctatcaaacatactttggaagatgcaccaatttaatgtccattctagggctttcgggagtatcagatggtttctcctgttttgcaaatgggatttgacagttggtccagctccaggtacccaaggacgaattggaaatgagataatgcctttattgaccatcccaatcaagtaattttctttcctcattattctcatgataatatcatgctccgagaggtcccttacaacacaaagtttctgagatttctgtagcaggacaaccttctcaattattttgggccatgagatggtttggatctcaagatctgtaattttcagactacacaaaaagaaaagagaaggtggattcagtcattgatgattgcactgagctataaacacacatattaatcagaaatgttacctgttacagtagaagtcacgaatattcaatgtacttctgagttgcacgaaaaacttgaggaagttgataagaccgtaagttgtcaatataaccattgatccaatagtgatcattttaggaaatgtgaatggaactaatggattatgcttaacgacttgcattagatcacatggtttttccccggattcgagtgcctctacaccacatttcaaatggccgagggcattccaatcaacaattaagaaaaagaacccaatacagcataccataaaaagtacgttaagcatctcaattatccatttggtaacaatgcatcgtagcccttttgcacagaaatattcataaagcctttcaaagaaaatatccaagtcagcaattggttcgtccttgaagccttcaccatggagaagtccagatgggctctcgcttcctgaacctggcaaccttctgtagtccgataactctatttcaggtggaatatcaatgagcagttgtgctgataatggtgattcgcttctccatggccaattaaatcgtggttgcacatttctgtccttcgaacggaaggacatcattcatgaaagaacaagccaagaccaatatgtatccttgccatgccacaagaaataacctgtcaccaaaaccaaaaggaattcaatgaatcacactttgcataccagcaatttccagcaagtacaacaaaatgtatgtgtgtaaaaactcacaagtatgggagctaagaagaaactgagctaacgctcttacttgtacgtctatatacagctacctttttcatacaatctgagcctaaacaaaattatgaacaagcttaacgcaggtaaaccgaaaaggcaccatggataataaggctaaaaacgaacttatcctatacatgcactagatgccaaccagggtagtgcctccatttccagaggcagcagcaatgtgatgccaaatgaattcattcctaatgatgaaacggattttgctcagaaatgttgacgaattgatcaatcaactgcagccgaaacgtaatcgcgcagtacatatcaccattcacatcgtctgtgtcgcctccacggaaagcaattcggtgtcccgcacggacctcacggctatctacttaacaaccagttgagctaacttctagccaaacctctccccaccaacacccaacccacctccgcacaccgccgttccaaaccctagatttctcatcccaataacgcctaacaccaaaacgaaaactcgttcatccaaagctaaaaaaaatcagcacgaaagcggcgcggaaggaatggggggagagagagagagagagagagcaatagactccaccgacctggcgggcaccggcgatcgccggcgcacggggggagggggcgcggggcggaggaggcaggcgacttgcggtggactgcggcttcggggagggttggggaatcgcgcggaggacggggaagacgaggcgagagacgaacgaggagacgaggagacgagaagcgggtggggtgtttccaggagacgtgacgggatcggggacagaatggaatcgtactggacgggggatcgtgtttattcgtttcgtttatccatgggtttggctttgctttgcttcgcgtgggcggctgctgctgcgcgcgcgtggcctcgcgttgtgctggtcgccaacgacgccaagtaactgggacctgggggccatggggcttgggcttgccggcgcggtggatttccggatgaggctaactaattaaaaattgactaacactaatattgccatttggggaacggatttgttgtctcttcgtttcgtcgtactgctatatattttggttgggttggtgcagatggcacgttaattttaatctgttgaaatcgaaggcttgaagccacttcgcagatgattcacaatttagcctctctcatcattcacagcagatttcgtccttacaaaaacaattagcaaattgactactccctcgttcgtttcaggttataagatgttttgatttttgttaaagtcaaactactttttattcatatttaaccaagtttatagaaaaaaataagtaatattttcgactcaagataaatttattataaaatatatttaattattaatttaataaaactaatttgataaatataaatattattatattatctataaacttagtcaaatttgaaacagtttgattttaaccaatatcaaaacatcttataacctgaaatggagggagtatgagaatgagactagcgtactatggtggtattctcttctagagaaaaataaggatgaaattagttaggaaagaaaactattagcacatgattaattaattttaattattataaagttaaaatataaaaattatttgatattttaagataacttatatataaaaaaatttaatacaaaacacataatttaacaatttgaagaacatactaaaataaaccgagtttaaatatatatgaaagaaacagcatcgtatatctcctctgcggaaatatgccgcgcggtggaaaagagggcagctagcgcacgggatgccgtgcaaaactaaagtcatgggataattagacactcgataaattaatagatctttccaaccgcgtcacctattgtccacatgattcctcgttgctttcctcagccagatcctcctcagtctcgcgcgtgatacctcatgggcagagcactgtcgcagcaggccagagcaccaatgccctcttcctccaagatccttggtatcgctccccccacgtcttgaaccatgcttccgatacagagagtgacctcggttgcggcaatagtagggaacaaggatcgagccgagtggaagggagaagaggagtagtagggaacaaggatcgagtcgaggggaaaggagaagaggaaagagggcatgtacttgatacctcgtagttagccatacctcgcaaccaaccatgatacctaatacctcgtagccagccatgatacctgatgcctcgcagctagccatgatacttgatacctcgcaggtaccatgtatcaggtttgatacctatgggtatcagtcatggtaccacatgtactaagcatggtacctacaggtactaggtctgatacctagatatcagtgatgataccacatgtaccatacctacggggtatcggctatggataatacatcatgtacctgcacacactccgacaatgagcatatgatggctcaccatcgcgtcgccgccaatgaaagctctacatctagaagcttcatggtcatgcccctccatcaccatcagcaacgcgtctaggagttcgagaagcccacgttggtcaacatccttcccgacagcctccctacttcctggttgcccccttccgccatgggagcctagatgtagtgggtgtccatgcctcaaaagcttgagacggaggaggaggcaacatgaccttgtaaccaacgtgcactcggggtagatccaacagtgaggaggagggggaggggattcgttttcgggggcctgcttcgccgtcgccatgcatgcatagaggagctctctgcaacagagagaagggaaagggaaaaaggagggcggaataggagaggcggatgaggaagacgaagactgggaaagagaagacaaatagataataacgaagcgttacccacttattccgtttccacgggatacggttgggtagtttttctgggtggaaaaagccaacgtactagtccctccgccgcgcggtggaaaaagccaacgtactactccctctatccaagattataagggacaatggccccttggtttgtctctaactataggggattctatcaactcatctgacaagcaggagtagtgctgtttaattttgggaggaatgtttaaaatttgagtagatgtggtggaaaaatatgctctgacaaactcatgtcagatttttttaagttcattctaaacctgccaaaacaatactttattctctaaagtacattttgtagttcgttgaatgttccaatgtatactccctccgtcccattctagtactgaatgtgacatattctattacactatgaatttggacacacatatatttagattcgtagtactgtaatatgttacatccggttttagattcgttttttatgggacggagaaagtccttccatatgtccatttatccgctttttcatcttccttaattaatactaaatagaaaataatctctcataattttggacggatggactagtacgttacaacgcgcggatgcacgcgtgtcgctgcgtacagccgaccgcggctacgcgtcacgcgttacacgcgtccacccgcaaaatccccttggtttgttcctaagccaccagccaccgggccacgcgaggcaagcggtgcgccgccgccgccgccgaggactcgaggtgcaactgtgtgcaagtcccgtgcaggccgtctgatctcatgggccagttgaagattaggattcagtccaaataggggatatgtatctgttgggctgcatgacatggccaggcccaatgaagatggcctcatgaaacaaggcctgttcctgggccagtaggccagcctaatcgtctgaaatggcccgtcgacgcgagaatgctacctagcgatccctgggcgatcagattttgatcccctctctccacctggttttctttgttggcaccgtgttacttttttattttagtaaatttgtgcacctaaagtttgtacacctcaagtttacacatctccataaatctttttaaaaaacaaaaagttagaaaaatttatgtatagaaatatatatatatatatatatatatatatatatataaaatttgaattcaaattcaaatttgaatcgggtatgtaaacttttgacttataaactttgggtctataaactttaggtgtataaactttatatgtatagaaatactatatatatataatatttgaattcaaattcaaatttgaatcagatataattcaaattcaaatttgaatcaggtatgtaaacttttgacttataaactttaggtgtatagaaatactatatatagaaaatatttgaattcaaattcaaatttgaaacgggtgtataaactttaggtctataaactttagatgtatagaaatactatatatataaaatatttgaattcaaattcaaatttgaatcggatatataaacttttggtctctaaatttagatgtgtaaacttgaggtgtataaactttaggtgcataaatttactaaaataggaaaataatgcggtgcggtggagggagggagagggggagggggatcgatcgctacccccatcgccacccattaggtgtaccctgcccacatctgactgttcgtgacactaatatttggtttgttcatccctcaaaaaaaaaaaagaggtttgttcatggctagaagattcgttggcaataccactactactgttaaagtggaatcgtcctcctttcgttccctcctgacaccacatgtagcacccgtacatttcgcgtgtgcatccatgtatccaatatttagtttttcttgatcgtcctctttagagtcttagtccaataaattgctgttactatatacgggatgtattatcttttgaaaaagaaactctctctgctattggaagcctccactcaattaatggcatcccaaggagaatccccctgttgaaaccaaatggatatgatgctcaaagtctctgccatgccatggaagtcagccgctttctcagctgtgaatctccgtagctttccagaataaaatggtgaaggacaatcaaggcgtgaagtctgtttcacgatacctataggtactttggattgctgatgtgctattctccaatttcaactttagcgcgccaatgaccgtatgtcgatttcgatgggcctgcaaaggaacggcgccgtccaggtttattactccgtaagtggcggagagaaaaaaaagaaagaaaagaaaggagtgcaggtaccacaacagaaataacaagttagcacaaccagccacacgccccatatagggatgttgatcttgtggtaacctacgtgcagtaaacaaagccactagaagaacgactaccagaataaaatggtgaaggacaatcaagccactatagaagaacgactaactcaagactttctcagttagatagctgctggcatttagtactaccgtacaggcacccctatttgatctctctttcagacataaacaacagaattgtactagtatatgattttatttaccagtgaagtgttccattcctaaagataacggattgtatgtagcaaggtagcatatggtgatgatcagcttattaaactggtatagcaacagcccggagtggcgtagccaactctagtatcatcccgaacttctccgccatgtccaccccgttcttctcgacctccggtagaagcctccactcaaaccggtgcagcaacgacgcgagcatcaggtacaccatgcgaacagccagcggcaaccccggacagatccttcgaccagagccaaatggaatcagttcgaagtcacggccacgcaggtccacctcgctctgcaggaacctctccggcatgaacttgtcagggtcagaccacaccttgctgtcccgaccaatcgcccaaacattcaccagaacacgggtgcccttgggcaccgtgtagccaccaacctgtgtggtcgtttcggcttggtgaggaagcagaaatggcgccggaggatgaagccgtaatgtctccttcacgacggcttcgaggtacttgagctggctaatgtcggattcctcaatttcttgtttggagccaatcactcgagcaagctcctcacgagctttcgccattgctggtgggttctgtagcagctgagccattgcccattctacagttactgcgcttgtatcacttcccgcgctaaacaaatcctgcagaaagtaacccgggcaatcatgttgtatacttcgataatttaattagagttttggtgcaacgagattactacatggacatatcacatactctaaaatcccaatgaataattcagtagcacgcaccgtaaacagaaactgtagcgttggccgatcaaaaccccggccatcctccgggctgcggtagtcgagcaaagcgtccaggaaatcgttcttgggcggctccccggcagcgcggtcccgcaggcgccgttcgatgtgcccgtcgaacacggcctgcagccgctcgaacaccctcgccacccgcctccgcagccgctgcgggtcgagcggcgcgacggccgggaagaagtccgacacgttcggcaccccgacgacgatggtgaactccgagatcaagtcccttaagtcccccaccgacgactcagctcgggcgtcgccgaaatccgcgaggtcggcggagaagatggtgctggagagcaggttcagggaagccgtgaacgcggcgcggccgacgtcgacggccgcgccgtcgcgcgccaggcgcgcgacgtgggacacgagctggcgcaccttgtcccggcggaggcgctggtgcgcgtcgaggctgcgcggcgcgaagagctccgcggcgcacaccctgcggagcgcgcgccacagggcgctgctgggcgggagcatgcccatggagaagccgtcgtgcccgcacgcgcgggcggcgtccggcacggagcgcgcggagaaggcggcgtcgtggcgctggaggatgtcgcgggcggcgcccggggaggaggcgacgacggtggtgacggtgccgaggcggagcgtcatgagcgggccatagcgccccgcgaggcgcgcgagggagcggtgcggctgggagccgaggtcgaggatgttgccgatgagcggctgcgggcggggacccggcggcaggttgcggcgggcgtcgacgaagagacggaggaggtacagggaggagagaaggagaataacgcacggcgtacacaagaggaggagctccatgattgaccgtacaaaacgtgtgcagggtcggaacgatactcgtatgctagggtggatactcctgctaatctgctagtatatctactcccatatagagtgtgtactggaagagatggcaagacacgccaaagatgtgcaacgtgtttgattttgagccaacgagagagggttttctgatatagtcatttaattggaatcgtaccattatcattttacacatataaccattcgtcttattaaaaaaatttacaattattatttattttatttgtgacttactttattatccaaagtactttaagcacaacttttcattttttatatttgcacaaatttttttaataagacgagtaatcaaatagcgcaaccaaaaagtcaaaatcccttgtattatgggacggagggagtatgtcagtacttacctcttagatgaatttacaaaatgtttgggaccaaattgtcattttctctttccttcatccttctttccctttgtcggtacttaccttcaaggccgccgcctccgtctactcccgcttctgtaaaactatattgtataccttcgtgtggtgtctgttaggttggataagatagagtttgttaggatgttgttagtctcatctatccaactgaacagatcacgtgtaatatggatgtaaaccacggtgatggttgttatcaccatatattaacaaaggtgcggcctctaacgaggttcaacgcttctgcacctctgattttcacatggtatcagagcccttccatccaccaaatcgcatctaatccaactcatggtgagttcgtcgaagacggcggccaggaaccctctcggtggaaacgcgatctcggagaaactctccaaatcaaaccatgtgctttggaaagcgcaggttatggctgttgtgcgaagagcccgccttgaggggcatctcaccggcactaccaaagtccccaacgccctgatcacgacgacagcaggcgacaagggagaaaaagaagtcacggctcgtaatccagaatttgatgattggattgcaaccgattagcaggttctagggttcctgctctccactctagccagggacgttctggcgcaagtggccacctgcaacacggctacagcggcatggcaaatgctggaggagatgtactcctccgtctcgagggcgcgcttcatcaacacccgcatcgccctctccaacacaaagaagggcactctctccatcaacgagtatgtttccaagatgaagactcttgctgatgagatgacggctgctggcaaagtcgtcgatgatgatgatctcgtcttgtacatcatcgccggcctcgacgacacgtatgaaccagtcatctccaccatcgtcggcaaggacttcatgaccctgggagaggcgtactcccagctgctcagttttgagcagcgtctcgcgcttcgtcacggtggagatgcatctgcaaatctggcgaaccgaggacgtggcggtggtggaggacagcaacgcggcgacaatgctggaaacggacgtggtcgtggcaacaacaacaatggcgccaaccgtggcagggggcgcggcaacaatggcggcgcgcgtccaccgggaggtgtcgacaacatacccaagtgtcaactctgctacaagaggggacacacggtaattaattgctggtatcgttacgatgaagattttgttcccgatgaaaaatatgcaggatcagcaacttcctatgggattgatacaaattggtacgtcgacaccggtgcgactgaccatgtgaccgcgaactggacaagctcacagttcgtgaccgctacaaggggcaagatcaagttcacaccgcaagcggtgcaagtatggaaattagtcatattggtcattctactgttaaaaccccgaactgtgacattcatcttcgcaatattctatatgttcctaattcaaataagaatcttgtttctgctaatagacttgtttttgataattctgcttacatggaactttactctaaatattttaatctcaaggatctggccacgaagaagcttctgcttagggggccatgccgagggcgcctctatgcccttccatctacatcatctcatgaacgccctcgtcatctaaaagaagcctttggagccatcaagccgtcctttgagagatggcacagtcgtctgggtcatccttcctctccaattgtggagaaagtcattagcagaaataatcttccgtgtttagatgagtcaaataaacaatcggtttgtgatgcatgtcaacagggtaaaagtcatcaatggccatattctagatcttctagtatgtcaagttatcctttggaacttatttattctgatgtttggtgtcctgccctcacctctgttgggggcaaacaatattatgtgagttttattgatgattttagcaaatttacttggctttatttgattaagcataagtctgaagttgttcaaaaatttcatgagttccaagctcttgttgaacgcctgttcaataggaaaataatagccatgcaatccgactggggaggtgaatatgaaaaacttcactccttctttacaaagataggtatcacacatcatgtctcttgcccacacactcatcaacaaaatggctcagctgaacggaagcatagacatatagtagaagttggtctcacacttcttgcatattcctccatgcccttgaaattttgggacgaggctttccaagccgctgtatatcttatcaacagaactcctacaaaactcctccagtttagcacacctcttgagcgcttgtttaataaaaccccagattatacttctcttcgagtatttggttgtgcttgttggccacatatgagaccttacaacacacacaaactccaattcaggtcaaaacaatgcaccttcttagggtacagtacactcgataaaggattcaagtgtctcgatccttccacaggtcgtgtttatatatcccgtgatgttgtctttgatgaaacaaattttccctttgcaaaactccacacaaatgccggcgctagacttcgttcagaaattttgttgcttccttcacatcttctaaatccagcacctaatcctggggaacaacagttagatgacaatatggctaatattcctgctaaccctgctgatcagttttttggaagcaatgtgcagcctgtttctgcagaaaatgatgaaccagacgatccttcatatgccacagaagatccggccgaagaaatccatccggaattcagtgcagctgcaaaagaatcggcgtcgggatcgccgcctgcatcagatgctgccgccagccattctagcgctgccacgtctccggatgtggtacactttcccgcctctcctcatgtgatggcgcctacctctgctgacaactccacgccgagtcactccggtcctgacaccgccctgcctaccagccatcatgatgttatgtcgccatcacacagttccgcaggcgagccgtttgcgacaggggaggaagtgattccagcgccatctcgcccaaccactcgtctgcagagaggcatacactgatggcacagttaaatacaagaatacttttcttactgtgactgatgagccagaaaatttaactgatgccttgaaaaatacaaattggaaaaaggctatggatatagagtatgatgctttgatgaataatgaaacttggcacttagttccacctaggcaaggtagaaatgttatagactgtaagtgggtctataaaattaaaagaaaacaagatgctcgcctagttgctaaggtatagattatgaagacactttcagtccagtagttaaggctgctactattaggattgttctgtctattgctatgtctatggggtggtgtatgagacaactagatgtacagaatgcttttcttcatggtttccttgaagaggatgtatacatgaaacaaccaccaggatatgaggataagtcctttccagagtaagtgtgcaagcttgataaagctctttatgggctaaagcaagctccaagggcttggtattctagacttagtaagaaactgatctgggttttcaaggatcaaaaggagatacttctctgttcttttacaatagaggaggactaattatatttgttcttatttatgttgatgatataatagtcactagctcaagacaggaggcagtgtcagctcttctgcaggatttgaaaaaggagtttgccttgaaggatctgggagatcttcattacttccttggtatagaggtaaataagatacctaatggaataatccttacacaggacaagtatgcctgtgatctcttgagaagggtaaatatgtttgattgcaaaccagtaagtacaccattgtctactagtgagaaattatctgctcatgagggtgacttactagggcctttggatgcaacaaattatagaagtgtagttggtgctctccagtatctaaccttgactagaccagacattgcttttccagttaacaaggtttgtcagttccttcatgcaccaaccactattcattgggttgcagttaagagaatcttaagatatttgaaacattgtactaaacttgggttgaagctatgcaagtccaagtctatgcttgttagtgcttattcagatgcagactgggcaggatctcttgatgatagaagatcaacagggggttttgcagtttttctgggagacaacctggtatcttggtgtgcacggaagcaagctacagtttccaggtctagtactgaatcagaatacaaagctcttgctaatgctacagcagaaatcatgtgggtacaaactttgttgacagaattacaagtgcaaagtccacctatggcaaagttgtggtgtgataatctaggagctaagtatctttcttctaatcctgtttttcataccagaactaagcatatagaagttgactatcattttgttcgagaaagagtatctcaaaaattgttagagattgattttgtacctacaggagatcaagttgctgatggctttactaaggctttgcctgttagacagttagaaaattttaagcacaatctcaacctaggaaggttgtgattgaggggggctgtaaaactatattgtatacatgcgtgtggtgtctgttaggttggataagatagactttgttaggatgttgttagtctcatctatccaactgaacagatcacgtgtgatatggatgcaaaccacggtgatggttgttatcaccatatattaataaaggtgcggcctctaacgaggttcaacgcttctgcacctctgattttcatagcttcctctccctcctcggcggcaagcacaacatcctccctaaggctgtccttgagctcaccacacaggacctccgccagatcagggtctcccctcgcaaggcctcctacctccacgacctcgctcgcaagtatacctctgggatcctctccaacgtcgttgtcgtcaacatgaatgcccgctcccttgcctgcttgccaccatggtcaagagcattggcgcctgaagcgtccacatgttcattttttccctcaatcgtcccgatgtgctcctcgttgccgaccttagggtgcgcaagggcgtgcagcatgtctacgaccttgatgtcgtgccctagctgccgtagatggacaagctacgagcagtgacgcccttaccgatctgccggggcatggtacatgtggcagtaggctcatcgaattcaaggcgccgtagctgccgccggccatccctatcaggtcacctgcactgcctaagcatggtgatgacctcatgctctagcagcagcatcagcaacagagtgtcttccaaatgattgatcctcttcagatgctcccaaggatgggttgaatttggtatatgttatgtagttctactcattacttctcggtattagttgggtcctaactctgtcaatccaatgattgttttatgtacctatcgttctgtgttgggggagattggaagagagtagaactaaaaatgagggcagcggggaggcatcgccggcggtgggattcgggtggaggacaagaccaagagtaaggggaaatgatgagggaagagagaggtagaagacgagggcgatttcgtctaatacatgtgaaatatgaatttcagtggcaccattgagattacaaacaagtaacagtggcatcgttacaaatacacaaacagtaatgacatatttccaaactaggatatttttaatgctatgatccaattaaccaaaaaataaagtgcttgtttatcgtcacttacaaccttaataaattttggtactgctctttccatttcatatatattataaattgttttgactttcttttaaacttctttaagtatgactaaatttatagaaaaagttagcaatttctataacactaaattggttcaatcaaatataacattaaatatttattgataatattattttttttatattgaaaatgttactatattttattataaacttggttaaagtttaaaaaaatgactaggaaaaaactcaaaactatagtatgaaacggagggtgtaccaaattttggtaacgcaacaaactaaatacagtgctaccaaaatttattaaggttcctctcttaaaactctaccaaaatttggcaaaggcataaaagcaaacaaaaacaacacagtcgaaatttggtaatgccaatacaaaatttgatatgattgattagggcaacaaattaaacaagctcaacaataattatactctagtagtatcgatcactatctccatcctaaatatatatgtttatttttctatgtgaatattcaataaccggtgtagattaattaatatatttgatcacaagatacaattgtatatagggaatgcatgtatccagcaaaaagtatcaaacaagtgaaaactggagctcaaatttctataaattcctaaaacaattattaggtgtaaccgtgaaatatatttttaccaaatttaaagttcaaactcaactttattttggagtaaaaaagacaatttttggataaatagtaacaaaataatatttacctgaaatttgtcatcttttttgcaaagatgcccatattattttcaccactgtttttaactgggttttctaccatttccgaccttactgatttcaggtggttcggtcagtgaacatcagaaacaagtgttgatcggccggtaatttttgtgtacggtttttatacatagtcaaattggtgtagcaatagcttggaggggcgtagccaacgtcattacgatcccaaatttctcctccatgttcaccccgttcctctcaacctccggcagaagcctccactcaaaccggtgcagcaacgatgcgagcatcagatgcaccatgcgaacagccagcggcaacccgggacagatccttcggccggagccaaatggaatcagctcgaagtcgcgaccacggaaatccacctctttctgcaggaacctctccgggatgaacttgtcaggctcaaaccacaccttgctatctcggccaatcgcccaaatattcaccataacggtcgcgcccttgggcaccgtgtagcctccgatctctgtgtccgtctcggctcggtgagagagcagcaacggcgcgggaggatggagccggaaagtctctttcacgacggcctgaaggtactcgaggctgtcgatgtcggattcgtcgatttctggtttggagccaatcactcgagtaagctcctcccgagctttcatcatggatgatgggctttgtagcagctgagccattgcccattctacagttaccgcgcttgtatcactccccgcgctaaacaaatcctaccaaaaaatacccagacataagtcagataatttcatatttgcacttacacttaccagtggttagctacactacttcaagagtgcaactctctcgtttgccgtggccatcgcagtcgcaatgacacccacgttaaggttaaggtctgtttggagagcttaaaattctaagaaacaattagttgatagcagcttttgaaaacatagaaaaactgggtttatcagcttctgacttctattcattttctggtttatataactacagtttctcataatctaaaaaaaagctgaaccgtttaggaagcttccgattctgaaaaaagttgtagcaactataagctccctaaacagagatggagataaggagagcaccagagctgaccaatgagaatgagctaaaacgctattgccaactcacaatctaaaacagtgttcgggaggtggagcacatgaaaacttggtggtttattaatggttaattaactaagtattagctataaataatttaaaaaagaattaatataattttttaaaccactttcgtatagaaattttttgtaaaattacaacattcaataatttaaaaagcgtgcatacggataacgagacatatgagttggaaaagtaaagaaaaaaactcggcctaatataccggtataccgtaaaccgtgaccgtagcgtttgccggtcgaactgccggccatcctccgtcgtgcggtagtcgagcagcacgtccaggaagtcgttcttgggcggctcacccgcgtcgcgctcccgcatgcgccgctcgatctgctcgtcgaactcagcgaacagtcgcgtgaacaccctcgacagccacctccgcagccgctgcgggtcgaacgccgcgaccgccgggaagtagtccaccacgttcgggacaccgacggtgcccgcgaactctgcgaccgtgtccgctaactcccccgccgatccggcgcgtccctcgtcgaggtcggcgaggtcggccgagaacagcgtgcaggagagcatgttcagcaaggtcgtgaacacgacgcggcggacgtcgacggccgcgccctcgcgcgccatcctcgcgacgtgcgacacgagccggcgcgccttctcgcggcggaggcgctgctgcgcgtcgaggcggcgcggcgcgaagagctccgcggagcacaccttgcggagggcgcgccactgggggctgctgggagggagccagggcatggcaaacctgtcgtgcccgcacgcccggacgatgtccggaacagggcgcgtcgagaaggcggcgtcgtggcgctggaggatgtctcgggcggcgtccggtgaggacgcgacgatggtggtgacggcgccgaggcggagcgtcatgagcgggccgtggcgctccgcgaggcgtgccagggagcggtgtggcttggcaccgagctcgaggaggttgccgacgagcggcagcgggcggggacccggcggcaggttgcggcgagcgtcagagaagagccggagaaggtacagggaggagacgaggagaataacacacggcgcatacaggagcaggagctccatgattgaccgtacaaatgtgtgcttactgcttagttagccgcaaaacggtgcggcggactggcattgtatattgagataaggttgggggcgaggaaaatgagaatgatagttatgatatgattaattaagttttaattattaaaaacttaaaaaatatatttatcttatattttaagcaatttttatataagaagtaaaaagcattcgtaggaaatataagataaatactaaatcaatcttaatagagaaaaacaaaggtttgagtagtgacggttttctcttgccatggttagtccttgtactgttctttatctttacgggccaagcttctccattatactttccatcctataaaagcatctcaaacaacatctctattctactctctaagctaaaatttagctagtgtagataaatttacagcttcaacagacttgctagctggatggcttgtccatctggttggccaaacccatcccctcgctgaccagtcgtgcacaacaaatggcatggggcaagacagatcgagaaggctgcaagtggcggcgtcccacgctgattcccgtctaccgcttgcctgccgcgtgccgattcctgtcgtcggccaccccgtcgttgtgcggaaagaaaaacaaccaactgcagtgctgccggctcaagaaggagagtgagaagaggtagtgtgcggactctctgacgtcagagacggggatcttctggagcaaggtggagccgtcgccgccgctattcgactacctacccatcgacgcccacaccaagtctgtcaccaccgccggtctccgtccattcccttcgccgatttcctcgcctcccctaccaacgcgagtagcagtagtgtcgctaccattcatgccgctgccgcagccgggcgcggtcgctggagcggcaaagctttgccgctccgtctgccatgcctattgactacctctctctttctccggcgttggccgcctcacctacatcgtcgccttcgacagcctccccctccggcgctggccactccgccatcatcttagcgctgccagtggtgaaccatggtccgtggatagagattatggagtggagaggttgtggagagaaggggaggaagaaggaaagatttggatggaagaaaaaaacatataaagattgatatgtgggatccattgtcagattggagagcgtaatagaaagattattaggttgaagataaatttggctgggggtgtttagatggggctaaaactttttaagtccatgtcacatcgaatgtttggacgctaatttgaagtattaaatatagactaataaaaaaactaatttcataaatgagagctaatctgctagacgaattttttaagcctaattaatctataattatgaaaagtttactgtagcatcacattgtcaaatcatgatgtaattagactcaaaatatttgtctcgcgaattagtctaaggttatggaataggttttataattagtgtatgtttaatactctaaattaatatccaaacatccgatgtgacaggtacttaaaataagtccctgtttttcaaacaggctctaattattttgcaggctgatcaaatgggtatttgaagggtcatatttagagatggagacgttttaaggctgtaagtgggatcccttagcacctgtcatttttattttaaaagacatttccttccggactaaaaatgcccctgcagcaatctgtgctaatagtacaattaataatacccaaggagcaacaactcaacagtcaacacaaaactcgcaaattttctgccatccagactctgttcatccgccgaatgaactcttcggctcggagcataagctcgtcttccagttccacgtcgtctccgtgcttctcttgcgatgcatccgtagctgcaggctcttcctctcgtgccgcacttctgccgttttcgctcgccagtgtctcaacgttgtccccgtcgcctgctcgcaccagccattcttccgcgcggccattgacgccggcaacgggacccttgtgtcctccagggttcatttccctcccttgcaccactgcatcagcttccaaactgcgatctccgtcagcgcggctgctgatctccggggcagcgcctgcgccgctgccggcgaggaggaggagagcgattatgagatgagagacgcagaatgccagcagcgacgggctggaagaagacgcccagagcgcgatcagctcgacggtggagttgagcatttttggagaacggagtgtgtgtgcagctcagcagcttgatggtgatccttggcgccatggctcttatatatccttggtgttcgaatcgaattgtgcagaggaagacccggacagaatcgaattgtgcagaggaagattctgaggcgtggaccctgtggccttgtggggtcgtggcccggtggcccctggaccttttcattatcgattccttcctacgcaaaaatcattttcgctaattgaagaggtcagcagatgagagcacgtggccacgtgggtggaccctgtaaagtctggatcagacgggagacccatgggtcttccagcggaagacagctgagggcatgtttaaatcccattttttaccctgtcacactaaacgttttaatatctttataaagtattaaatctaggctaaaatataactaattatacagattgtgactaatttacgagacgaatcttttaaacctaattgctctatgatttgataatgtggtgctacagtaaacatttgttaatggcggattaataaattcgtctcgtgatttattgacggattatgtaattagttttttattagtgcccgaataccctatgcgacaccctgtatataatacctgatgtgacacgccaaaactttatatctaaacacccccttagacaaaggatttggcgacacacacgatgagtcgatgatttctatactcgaactataaacttcaatttcctcgttttcaacatgcttcaatttcctcgttttcaacatgctttctaacagtgcatttttataaaattcttttttaataagttacaataactaatatttaattaatcgtaaaatcgaaaagagccctcttgatttagtcataacaagcgaccccatcaactattatctagatatgtgttaattggagaatcttacttaactgtagtactaaggccatcaagcaaatagaaaacctatgcttcaataaaaattttctcttaaattactcatacaatctacgaaccgattacactgttgtattcgtaacaattaaatctttataacaagatctcacatgattatattttgatgaaaaattataaattactttcatagggcatgtttagatcaactggcaaaatttttcatgcttcaataaaaattttctcttaaattactcatacaatctacgaaccgattacactgttgtattcgtaacaattaaatctttataacaagatctcacatgattatattttgatgaaaaattataaattactttcatagggcatgtttagatcaactggcaaaatttttcaccctatcagataaaatgtttggacacatgcatggagcatcaaatataaatgaaaaaaaaactaattacacatattacgtgtaaattggagacgaatcttttaagcctaattgctctatgatttgataatgtggtgctacagtaaacattctaataatggattaattagttaataaattcgtctagcagtttataggcagaatccgtaatttgttttgtttttgtctacgtttaatatttcaaatgtgtatatgtatatttgatgtgacacgccaaaacttttcacccctagatctaaacaaggccgtaatatatctaaattacttttagatttcactaaattacttcttatagatatataaaattaaatttaataaagtctaaaagttatttaaatatattataaaaagtaacttaaaataaaaggattttaaaaggaaagtaattttgtcatgatattagaagtaaatccgttgtagggttaaaaacatgactatctataaattaaattaatcagcaaaaatgatggaattgattaaaaacaacaataaaagtaatcaccttatagcagtatgaatgtacgggaagtaatttaatcaaatttaaaagtaatgtatgtatacgataaaagtacgtatataataaaagtgatttacaaatataaatattttttccatcataatataattatgtaagatcttattgtacagatttaattgcaacgaatataacggtgcaataaaatcatagatagaaaattttatttgaaatttacatcggtaacgaggatgccattatttaagagaattttatttgaaacttagatgggtaatgaggatacagtaagaagtaagaagggtaacgatgtttttttggtaaaaatgatggtagctggttacactatactttttttttgggtaaaaatggtcactggttagcactggtgcaactcgcgccctcaattaattattaattactccctcctgttccgcaccgcaaattgtaattattaattacttaattttttttaataaaataaatggtcaaacacgtactaaaaagtcgtactaaaaagttaacggtgtcaaacattttgaaacgaaggtatgttctaataagctttcctgtttcgcaccgcaaatagtcttcccttgccatcaaacgaacaaaaacaaagccctagatagcgtaacgcagtttattccctaaacagctaccttcgtgaaacacaaccatacatgcctccgggtgcatcagcgtcagctggcagccagggcaaccttagcaaagaagcgggtgccgctgtcagatccaaacatggtgttgaactttgcttataacgtttaatataatcatttgtgttccttcaaatcacgcttgcgccacgcaacatcaaaattaagcgttttgtgggagcatgtccacccacatctgaccgtggggaattattgctcaaaccctcacaatcttcacaaaatttacggaaacgaagtggttctattcccatctagtagggctccactggtgcacggaatttggctccggcatagacggcagcagcaccaagctcctcctcgatcctaagaagctgctccaatttaaagaggggaaatatgagttagttagatgcaccaaaacctcaaaaattaaaagtgtcgttagccaacaccaggcaagtttacacaaacgcactgaaatcaacatgtacaaagtatagcagcagaactagtgtaattttgcacatcaaccaacagtacagaagtatagcaaaagagggttgaacatattcttgcctggttgtacttggcaaggcgctcagatctgcaaggagctccagtcttgatctggccctgtttcatgacaaaacattgatgcatttccaagttatcatcaccattaagagcggatctcacaagctctttcaaaagataagcggcctatatttgttgaagcacactaaagaaggcacgcaaagtatataccgtggataaaccaactgccagatcagcaatgaatgtatcctcagtttcaccactgcaaccaaatcaaggaaattaaatattgaagtcaggaaagaaggtaggacatacaagacgcagaacagtaaataaaaaaaacagcatatgcatacctcctgtgactggtcatcacaccccagccagcacgttttgacatcttgacagcctcaatgctctcagtaacagatccaatttggttaacctaaaccatataaacaggtcacaagattattacgctggcaaaccgatatggctaatttgaatacaaccttaaacagtatgtaccttaaggagaagagcattgcaggccttgtccttaattgccttggctaccctctgcaagtcaaattggtttgaatattgaagccaacaaggaaactgaaaaaagcagtatataagtcatatgattagcaagtaacatacagttgggttggtgacaaggagatcatctccaacaatctgcacttgatctccaatttcttcggtcatcttagcatagtgaacccagtcatcctgatcaaatgggtcttcgatcgagacaattgggtattcactaacaaatgacttgtacacattcttcaggctatctccagatatcttctgggaaccatcattgttctaaacaaggaaacaagcatcataaatgggggcattaaaacttcaaaaaatttcaaggggaaaaaactgacatttacctcttccttgaagttaagatcataggtttggtcctcagtgtagaactctgaagcagcaacatccatcccaatgacaacctggcatatcagtacaaataacattccataccaaatgtcagaaattgaagtgccttagcccataaccatcaaattaatttagccagttgtatgctcaacaaaccttgccagtgtatccagccttttcaattgcagtcttcaaaagctcaaggccctccttgttttcctacaattccatagatggcaaatatataaattcagaattgactactagctaatatctaatattttataacagcagattggacaatgcgattccttacttacacagttcaaaattcaatatgatatagagatgctcttgtatatccaaaataatagtatgaaacaaataggacaaaactcttaacaaacttttatggtactgaaatatagtttctgagctcacattttgaagagactgcaactaggttgcaaaccgaaacaacatataaattaaagcaagaaaaaaagataaatatgctttggagtgttggagggaaaatataacaggtaatacgtgtaaaagaatttgaaagtacatatgacagacatgtgcaaacaaacaaacaacaacctgaatgtttggagcaaaaccaccttcatcaccaacattagtagcatcttgcccatacttcttcttgataacagactgtagaacatgagatatattgagtgttaatttttgcacaacaatccagttccttaaagaaatgtcaagaaagtgacctttaagttatggtatacttcaacacccatcttcatagcctccttgaaagatgaagcaccagtagggaggatcatgaactcctgtacagaatttcaaacataaactacaatctctggaaaaatcactagagaagaattattatatgtgcatttttgttgaggcattgcctgcatagctagcttgtttccagcatgtgatccaccattgatgacattgaaagcaggcacaggcaaaacaagttgcttgttaccagcaaggttagcaatgtgctgcaatatagaaggcacgtaatggtataagaaaactggttagtggaaagaacaaactgtgtgcattcaaatataaaaatataaaacgagttctcccatacttgatacaacggaattttcttgataatagctccggctttgcatagagcaagtgagacagccaggatagcattagcaccaagctgaatttcaaaaaattatagtcagatagcagttagcactattaaatgagtgcagtgtcatgcagcgctacaacataacacaacatccacaacaattctgcagtaccttttgcttgcaccagccccactcgtttttggttccatccagttgctgaaccatgaagttgtcaatgacagtctgttctgtagggtcctgcaaagccaacagaatatgtaaacatacatgaatttaatactgtaatatgcacagaaatatggtagggaacacataccttgccaatcaatgctggtccaataatagagttcacattgtcaacagcctgttgaaataacaaacggcatgtaaagatgaaggcagacatccatagaaatgttaaaaatttaaaagatcgcacaacgcatgatgcaagagggggggctaagtaaagtaggtcatacaattgcacttgcacacaatgactatctcagagtagttggaatgaaatacaaaatattaatagcactttctgtcattcagaccaaaacattcagaaagagacagctctaagaataatgaatgttgaatatattagctggtgaaatgaaagtgaaacttgcttgtgcaacgctacatatagaaaacatctaaggtgatcattccacaatctttattagtatagactatagaatatacaaggcctgcattgtgagtgcatagctgcataagcaattaaataatcatccgtgctagttgtaaagaaccacaaaaatgcagcacaaatgaaaaaacaataacaatatgttaggcacagatgacaacacggaagtagtggatacaaaaagtcacaaagctatcaaagatagtatagattaattgcagaaaacagctaaccgaaatcttctgacaggaatgtgttaaaggacaaaccttgaggacaccctttcccaagtaatcagagccaccatccctcaattccaaagcttcatatacacctatagtgtagcagaaaatagcatcagttcactttctaactaataaaattgtcacccgaagctttccatatagttgatataagctgaaaaggactatcaaaaactaagttggttcaattaaccagatgcatcaaggctagaaccacagtagggaaaagaagttgctgataaacaaacaactcaccagtagatgcaccgctaggcacagcagccctcgcaaatgttccatccgagcagcaaatatcaacctggcaacacaagcatcatattttagtaagaccatttagttgccaaaaccattcaaaactattgatttagtccaataaaacaaacgaattctgtaacaactgtatgctcatatcatgaaatcctggaacaaaagcaccaagcaacacgatatctaacagtggcaatatgttcaaagcaaccatctgttgcagatatagcgcaaattccaaaatcaaagcgcagttcgacgtgcaactaatctctaggtacacagcagtagattggatcgagtagggatcgagcataactcaaagccaaagccgactgagccgacagaaataaaccgatcagagcccaatccacccttcgcatggccaaatcggagcagggggcatcaacatttacaattcacaaaccacacaattcaggactctaagccggttagccacatcgcacacagtgattaaacaaaccctactacgggaactccaatccgaaccgctctaaccaacagaccaagatcgcggaaactccaatccgaaccgctctaaccaacagaccaagatcgcggcatcgcgctaagaaagcacccgattcaatcgccgcgacgccctagacagaacgaaactggacccgcggcgtacctcgacggtggggttgccacggctgtcgaagatctggcgggccttcacgctctggatggtcgccgccatggcctggatcggatggatcttagatcggggaaggggatggacttggagaggaaggcagtgacgaacagaggatataggaattttctgaggttttgagaacagcgtcgcctttttatgggcagcgtgtgcgtggctttcggcggaggaagtgagggcccacccgataaccgaagaagtggcatcgccgtcctgcggagagcatattcgcccgcgccgcggggactgcaacgccgcaattgccgggccgttggtgtggtggcccgtttgtggtggcgtcgttgcatgcgtatctccttgggaataagttcacctttcatcgctcaactttatgctgaatcagtatgacatccctaatccctaataccagaaatcttcactcttcaaatcttcatccctaatcatactgctgtgagaaccacacggttttgtatagtttatgggtgaagatttctggtattgaagattagggatgtcatacaaactcgacgtaaagttgagggatgatatctgaacttattcctatctccttgcagctggtagtccagcccacggggaaccgccgcagcagggccgcagcttcacatcttgggctgtattactgttcgttcgtgtcgatgaatgccaatctggggtcactatacgtgatgttgcaagttaagttttttcttttggtacttcgaaatttgaatcacgtcgaatatttatctgatcttggtaagattggagtacacagatgggaagcacacacatgtcactgcatcgagtgagaaaacccgaggatctgctactgatatctcctggactcctgccatttgcttggctgtttctttgcaacctcctccgaattccaatccttctgaaacggagaaaaacatggccgctcagtcgagcatagagacgcttccatctcttagcttgagcacacttgtggattcaaaaaagcataaggatctgcaccgttttttcacaggttccactgaaacgggttttccaagtctatagttgtcaaaatatgcatatccaacctgcatatggtgcacactgcactgttggtacttggacggatcgatatctcctcgtgcttggagatgttcaaatgtgtatcatcgaattcagatttcaggtgtctagttgcttaataacatcacggagcagtattttgttttacctgtcggtagtctatgggctatggcagtctgcattcctgaataatgctcatacagatatgaagctgctctgaatttggaacatttttttctgcatgtttctaccgcaagcaagaaattaaacagcctgcattcctgaataaaggctgtgtttagatctaaagtttagatccaaacttcagttcttttccatcacatcaacctgttatacatacacaatttttcagtctcatcatctttaatttcaaccaaaattcaaactttgcgctgaactaaccacagccaaagacagactgtggcactgtgctgaactccaagacatggccgtggtttcaccacctcttcgcttctttcagacgcagggtcacaatccaatcggtgttgaaatccaaaatcaaagggtgcttgttttttaaaaggaaaaacgtcgagaactgggggttgatggtacatctcagtatcgtgcaaacactgtaaaactgttcctactgtgatcggcacagcttgggcccgaccaagctctcgcagatgatccgaactttgacatcgtagcaggtactcctccaatggctccaatcctccggcctctggtgtcagcgcgcacgtaccaacatgacgtgataaaatgcactgtgataggggtgtttatatcggagtgaaaaattttgacgtgtcacgtcggatatacggacacatatgtaaagtattaaacatagtctaataacaaaacaaattttagattccgcctgtaaactgtgagacaaatttattaagcatgattaatccgttattagcaaatatttactgtagcatcacattgtcaaatcatagagcaattaggtttaaaagattcatctcacaaattagtcgcagtctgtacaattagttatttttttagcctatacttaatactttatgcagatattgaaacgttcgatctgacacgatgaaaatttttggggtgggatcatatttccttcgtaaagtagttgacccacatttcttttagtacgagtattaacactcttccatcagctttcattgaccttggcagctataatcatttcgcgagcttgagacatgtaggcctggcctaagcaacgtcgtcaaaagagcaatccgtgcaccctgtacttagagaaaaagacgatggcatgcacacctggacactgatggagtagtcgagtagatgtgaacgatcatgtgatcgacttgtgagggttgcacagtgcccgtctccacgcgagttggaatcggagaacggaggttcccccactccacaaaaagctcacttgctttttggacttcaccggggtatgcgtgcgctgcggcacaggacgctgctggtgtcggagagggagcgctagcgatttggaccggcgcgagcgaaagggagcgcggggccgcacggaagttttacaatttacacacgcgcccaggcggccgcactggcgagtccactgcctacattgtcaccacgcacgcatgcacgtaaacgcaggcgctcgcaaaccgcacggaagttttacaatttacacacggggctcgtacgtgtaccgtgcgcccgttcgctcggctggctaggcggctagtatagctgcgtttgtttgctgacagtgcgtgtacgttgcctgcagctctccctctccatccaagcgctgggcacacagtataacggcaacaacggcaggcggcgccacagcgtacgtatggcgaagtcgtcgcgtttgtccgcgtctcggcctctgcccacccggagaccactacctgctagctttggcggtgtggccagtggacagtggtcctccacgaacgagccagcgaagctaagaaccttgcttgctttgcgtagttaatggtaagtgaaatcatgtgggggaatggggatgtgcgtcccgcggcatgtggtctcaattctcatcgatctgtatccggtggtggagacatcctgctgttaaccgggacaacttcgacttttcgagggggatactactactgtagcggtagatttgggttaggccggagtttttcccaattgtgaattgtgatcttggtcgcttgccccaacaaaattttcacggagaaaaatacagatgcaatcatgcaaatatccagttctttaaactctgctgatctgattcaaacctactggcctggctcagtggtataactcacaacattcactgttacagaaaaacacatacaagtcggcactataggtattacaagtttagaacagttaaaaccaacacatataatgttttactcgtctccataggttaaaaaaaatatgtaaccgatacttttgaacaactatatgtgtcggttcttgagaaaaaacgatataggtatcggcacctattatatattataggcgttgggttaattaaaaaatcaatacttataaaatattataagtgccggtttttttaaaggcaacctataaatcgagccgagccgcatgggggagggagagagccatgttgttcttatccgttcgctctctctcgcgcttcacccgtccttatctccttcagtccttctcctcctccctccccctctcccacctctctctcctctctctcatggtggcacggtagtggcgccctttcgtcagctcctcacgcgctaatacaacgggctccttctccaacctcaaggtggccattgcgagctttaggagtccatatccggtcgccacgagctcggggcggcctcctcctcacgacgcacacggtggtggcagtgtgccttccctttggcggtggtcctcccatcgcacccttctccaacctcggtcttttgtgatgaatttttctgtgtaatttagatttgcgatgaattttctaagagattttgtgattcaatcttggtataaaattctttgctcgaagcttcgcatcgagcagctttttttattattattcggacatttttagaaccgatactttttatttttcttatccgtgccttcttataggtgtccgttgggaaaaatggcatctatgccgtcttttattccaaccagctatcgcaaccgcagtccaggtccacacaactcgcgtacgctcgatgtgtggtaacggtggccctcgcttcagagcgatctcccagaatgccagtggactgacggcacattgaagcccctcttcctattttcctatttttggcacggtcgaacttgcgtccttttggccgccctacacacttaactccggtggttggattacgacgatactcctgtatacccgacgttgatatcacatggcggagtcatgtacgcggagccatggcgccgctgatgccgcgtcggccgactctaaatttcggatcatatcaacacccaaaaattcggatccagccagctgcgcacatgcaaccgtgtgtttgaattccgatgattcgttaggatatcgcatgcagttggtcctcgaacgggacctcgcctgcttgcccatcggtctcactggctcacggcttctccggctcgcttcgctagccttggcggtggccggggccggaacgttactgtagcttcaacgacggacatgaatgctctgtacgatcgctgtgcatgcaagctaggataattaagcaggcagaggcaggtgtaggtgccggccgatacttcagcacactgcacacgtccctccgctgtcagttcctgttttcatggtatgcagcagggcagagcatgcatgaatcatgatgcatatggtcgagcccgagaagacgacgattagactgtctacaagtgacctataagggcacccaaatctaaaatgggtcttcgataggactatttcagcctccaacagagtacctatacagaagacccattttgtgtgctataagaagcataacctaaatctgagtattctctctcctgaagacctatttgcagtaaaagttctcttttaggtcttattgttggagaagaccaaaaataggtattgaactctttgactgtagcgctatgcaaacgtgaaatgtgtcttgtattttgggtttcattgttggagatagccttagagcggaggcggtgcatgaaaaacagatcatttgcacaacacttaaaacaaatatgtcttctggaaatacttagggttggtttggtttgtggcctaaataggccttactaaattttgtcaatgccatattttggcatgactaattttggtaagacaaagttatgtttggattgaagccaaaatagcttaagttcactactgaaatgacctattttcttaggcatgacaaaatttggcttcaaaccaaatagacactacacactattgaaattgctaaatattggtaagcctaatttagacctcaaatcaaattagcccttaaacaggttatcaaaattctgcaacacttaaacccgtttaaaaatatttattaagttcatttgtcaacatttttaattgatttcttatagataatctgtgatcataattcactacgtaatctaaaacaaatggggcttaaggatttcagttgcacacatgttctatttttgctagctatagacacaaatgaatgttctacataattttcttctcttacataatttaggttgtaggtggacataattgctcccggctataaaatccgctcccttggactcggttcaaagggccgcatgcgattgattggtgaggtttggcatcagtggcgagagaaggaaagaggacgcggatgcgatgtgagaatggcatcggagataagggaaaggaaacgagaggactatggtaggtgaactaggggatcgatgcagttggcaacaccgagcaaaaatgacggtgttgaatgagagatgtagcgaaaagaaaaaaaataagacctagaaataatagttggaataggttagaattgtatttaacaaatctttattttgtatgatctcgatttatgtctacaaagttgcataggctaaagtatataacataaattggtgccacttcaagccacgatgtactcactagtacagatccttccatctgtgacggcccataacaagactggaatttgcgggccgtcacaggaagtaatctcaattgggccgaagtttcgcccgattgagatatggtcgcacagccatggtatatcggcataaaactaaagcccgtaccggattaaatnattnttaaannnttttattaaanntnaattaaaatttttttttttnnattaaaatttatttttttaatggnnttaaaaaatattttttaaaaaaataaatatnccttaaaaattattgattttttttnaaaattttattttttttttttaaggttatagggg

SEQ ID NO: 79683 - DNA, 21413 bp, Oryza sativa
cactaatcttatagctatctggtaagttttttttttccaaatgttagctagtcagtccttataaaaatttcgctcaatttgaacgaaattgtgaagtctatagctctggagcctagatagaattcaaagtaaatttcaataaccttacttcctgacattaggactgcaatacgtcaatatatagatttgaaaacttttccatacaccactaaatctaagtcatctctaacataaacccaccactactcactactagaaaaccaattttcccaggcggccaaaactaattttcgcaggcgggagggaggtccgcctgcaccacagcgactgcgaaaatcatcgattttcacagtcggggcaacggcccgcctgcgaaaatgcaaaaaaaaaaacgaacaaaaaaaatcgccgcacgcggctcaccgccgccaccctcccccggccggatctgagaggggaggggaggggagccgccgccgccgtcgtcaccgccaccgccgccgtcgtcgtcgccgccgccgctccacgccatcgttgctgccggcggcctcccccctctctccttcggccagatctgcgagggagggagggaggggagacgccgccggccgccccgcgcgcatcgtagccgccgtcgcccccaccggctttcccccttcctcctccggccagatgtaggagggagggggcgaggggagccgccgccgtcgcccccgctggcctccccctccctcctccggccagatctgtgaggaagggagggaggggagacgccgccggccgcgctgccacgccgccacagtagccgtccatgccgcgccgccgtccccgccgcgccgccgcccccgcagcgctgccatccccgccgcgcctccgttcccgccacgccgctggagaggagaggagaggagagtcagtgagggagaggagactgagtcagtgagggagagggagagagagagagagttgagtggtgggaggggtgggaggagaagataagggtgggttttttttttggtaggcacgatttttacaggcaggacccctaaggttcgcctggaaaaatagattttcgcaggcgccgctttagtggtctgcctgcgattaggcgtacagcatacttcactccgatttatatttttgtaggcggttatttggttctaagggtcatgtccgtctgcgaaaaaaagacccctatatttagaaaaatgctttttctagtagtgacttttcctctcgttgaaatcatcataggcgggagaggttcattagatcgatggatatattgtagctcaaaacgttattagcctcgatatatatctcgcatatcttagcattgacactactagaaaaaagaattttccaggcagcccaaaaccattttcgcagtcgggggagaggaccgccgctaccatatcgactgtgaaaatggaccattttcgcaagcgggcgcatggcccgcctgcgaaaatcatctcaggaaaataaaaaaaaaacacggggcgccgccggccagggctcccctccgtccgctgccgtcggcgccatcatcgtcgtcgtcgcggcggcggagggggcgaggagatgaagcggccagcggaggcggcgaggagagaagccggcggcgcgcgtcgtcgctcgtcgtggccagcagcagagggatgcggcagcgcgcggacgtcgtcgtggagggagccggcggcgcggacgtggcagatgagggagccggcggcgtgcggatctggagcggagggagccgttggcggcatcgcggtcatcgtcgtcgtcgaggagggaggccgccggcggcgaggagggatgcggcggctcgcgggagtgagagaggagggagcagggcaacttttccaagtgtggggggagagagagaggagggggagggaaatgagtggtggagaggagaggataaagatggtggtggagaggataaggatgaggatgactagatttttttttggtaggtactatttttgcagacggaccacgtaaggtgcgcctacgaaaatctattttcgcaggcgtcgcttaagtggtccgcctgcgaaaacaggcggacagcgaacttcatgccgatttatattttttttaggcggtcatttggttcccagaatcatgtccgactacgaaaataaaacccccacgtcggggaaaatgccttttcttgtagtgtgatacccgttcaacacaaaacatatcaacattgtttcacaacaggtgtatatttgcgacatctctacctccacctctataactcctcatctctagagccattagcaaattaaacattgtatacacacgttctccaattatgggctcatggcagcatgccaccaatcaaagataaatgttgacaaatagctacgtggtttagaccggtacttagtatcaatactaatatatttaatacatctctacctactgaaatattggtaccaaaatatgccaaaaaattggtactactatagattatttggtaggataaagaaccaaacaaccccataatatttatatcttagaatggaggaaatataaaatattcttggtgaggttatatatttcatgattatctataaagttaaagactatatagatacactccctcgaaacacatgattaaaaaaagagaggaataaaaaagaatacataatgttaacaggaatgtaagtacaaaataaaagattataaaatatagaaataatcttttaaatatatagaccatagaaaaaacatggaaattggatgagagatatatagagtcaaaattttccaatcggttcaagctcttcctaacatgtctccgtaatctttataagtgtgtccatttcataagaattttaaagtaaagaatatgattcaaccctttatttcaaatactatagtaggatttttttttataagattaaaattatttttcttacaaatgaaagtgggcaaggatctcatactagctagtagttaagaagaacggagggcgcacatgttttttctgataataagggaaacacacgtccggcctctaaatcaaatatgcatgtattttttaccacaatttattacaagattacatcatcagttggtagattcctgtttttaagaataaacaactcattactcaataaaatccatagtaaatcaaccacgaggtcatgttactgaatctcaatccatagtaaatttttacgaggacggaggaccatttcaatggtgcgcaactaaaacgctggccgctgatataaaataatcgaatcctggccactggctgcacgtctttcgtggcgattggcgaacatatatatgtacagttctacttctacactccatctaattgaaaccaccggcagggagaagtcacttgatcaggtcaattaactgaatattagtactactagctggaattaatgttgactgcaaagtgattcgtccgaggatgagccagagcgacagccatccaccatccatgcatccatgatccatccatcgcttggtagtagttggtagtactttttttagaactagtagtagttgcctagttggtactccctccattctaaaatgaataaatgtagttttgcatgattcacatttaacgtttaagcgttcgtcttatttaaatttttttttatgattagtatttttattgctattagatgataaaacatgaatagtactttatgtgcgactaaatatttttatttttttcacaaatttttcaaataagatagacggtcaaacgttggacacggatatccacggctgcacttattttaggacggaggaagtacatggtagtactatcttcttcttcattgactctttttagtgagcatactcaccttttgtgatgtagatatttttttagtaataaactttattctaatatttgcttaaaatgcaattattacatatagaggttgcagtgtaaacaacaatgaaatataaaatcatggcttgattaaaaataagaagtctactttaaaataccacctaaagacagagatacacatggctaaactttcaaacaccggtggagaaacgatttttactcccggtttgcaacccccttagtcccggttttccaaccgggactacgaatccgggactaaagatcgctatctttagtcccggaaatcgatctttggtcccggttagtaacaccaaccgggattaaagatggagccatttttaaccccggttggtattactaaccggagtaaaaatgaagccagatccggttagtattttcttttttcttttattgttttttactttgaatattgatttcaccacatccccaaatcatccccaaaatcacggaacaaaatatcatctccaaatcccaaatcgatcatctacaaatccaccatatccaaatacatcacaaatattcaaaacaaatacattacaaattctaaaaagaaacatcacaaatacatcacatatttacatcgcacagatcaaatacatcacaaattctcaaaagcaaattcatcacaactccatgggaaaaaaacaaatccactggtcgcttcaccgctgtcacctggccgccaccctccgccaggccgcacggccgcagcgcacgcgccgcagcccagccgctgccgcggctgcatccgccgctcgccacgcgcgaccgccgcctgcgccgccgcagctgcatccgccgcccgccgccgccgcggcgcttctgccgcccgccgttgcctgcgccgccacaactgcatctgccgcgcgcgaccgcgcctatgtcggggagggatctgccgtggccgcaggggagggggaggagaggggaaggggaggaagggggaagaagagaagaaggagatgagaagatgagaagggagaagaagattggagaagataagggagaggaggagagatgagaggatgagaggataaggctgttggtcctctcgaggaggcgcggtgcgatttttttttcgtttttcttttgtctcggttgttataagcaaccgggattaaaaatagatctttagtcccggttggtcatagaggggtctgacacagcctgccttctttcgaaccgggactaccaaccgggactaaagatcaaaaagtgacgtcagctttttcaaccgggactaaagatcatcggttcttattcaaaccgagattattgtagattttggacaaccgaccaaagctggtttctctaccattgaaatgtgattggtaagagtataaccgtttgtttctccccagcggcttataagatgcatttagtttttgtctaccttaaaatagaatacataatctctgtaatcaacggttgatcattgtgctgattggatttcactcacattcgataaccaacgttgaaccaaaaataaaaaaaaaacgtcggaaagtaaatgagttgtaaattaatcattcagccaaatctcgccaccatcatagccatcaaatccagtttgacgagagcattgctaccaaggacaccacgtcatcagagaacccccaatgcgactcctccaagaaggtcacaacatataagatgtcgttgtcactatttccaacttccaaaactaggttttaacccagagattctaaaactagattcctagactaggataaacggtctacattcgctgtcaggtaaatttagacagtgtatcctaattatacaaatctagacagtttatcttactataaatttagtcagtctatctaaatttgtagtagtctaatctaaggccctatttgattcagcttaggattattataatctggattattagtagtaagctaaaacaaacaagtagattattataatctataagctagattagtataatccaataaactcctctataggagctttttctagattattgagtggctaaagacccactacccttatatgcctctaataatccagagaaacaaacaactcgcagcttattctgtcagcttattataatccagcttatagtaatctgatttaataatctagttacaataatcttaactgaaacaaacagggcctaagactagttatatttccagacacagcagtaggtggttagaagatttgttggagggattgtatcacctaaaagtctctaattttggacttgagaggatgttacgggaaccttggtgatgctaatcggtactcctatccttaaaaaaacaatttttgactatgtatctagatatagccaacgtctagatacttaattacataggtaaaagttgtcttttttttagacggaggatatagacttgtagattgtagactagtctggtttaatgttggtcgatcacattacatttcaatccaaataacacaataaccatccattaaatacatatagttaaaattttaacttgcaattaatagctaaaattcgattgttttggacgggaagtagtagacagtacaagctgagtggttggttaatttgttttccttgttggcgtctttcgccgtcgttatcgatcgatatcgacggatcgatccgggagaagtgacatcgatttttttcaggtttgaatcatatcgatcgcatcgcttgactggctgctactagcagagagagacgagacgagatagagctaagcttacaacttccccggtcaacgtagccggcgcaaccgcgcgcgctccagtccaagcctagccctacttatgcgcgccaccgcccgcgcacgcacgcactcgccgaggagaattggaggaggagaccacctcgccggagagagggggaaaccaccgtgtgcttaggtcgccggcggcgtgcgtgcgtgcgtgagtgagtgagtgagaagtgagagagaagaagaaggggccgggcttttgatttcgttctccatggctcgagccgccactgcggcggcgctgctgctcctgccgctcgtcgtcgtcgtcgtcgctgccgcggcggcggcggcggcggaggagatgaggtacggcggcggggaacgcgggcggaggctggggcggcactgcggcggcggcggcggtggcggcgggggcgcttccacgcaggtaagtgactgggtttataactctactattgtaggcgtatatacgtggaaatgtcaatggcgaatagatttaagtggtgttgcgttgccaacttatctcgtaagtatctttacggcatggtcacaggaacatatatttccttgtgcataaatatttttaaaatcttgattcaaatccggactctatatttaaactggatgtacacgtgcataaatatttttaaaattttgattaatatccagactctatgtttaaactggatgtacaccgtccatacttactatacatatatactctctcctttcatattataagtcgtttaatttgatttttttttctacttcaaacttatttaatgtgactaaatttatagaaaaattatagtaataacattttcaatacaaacaaatatattatcaaaatatatttaatgctatatttaattaaactaatttggtgttgtaaatggtgctattttttctataaatttagttaaacccaaaaaattataactaagaaaaaatcaaataacttataatattaaagagagaggaagtatatccgatgatcaaattggataaaggataatataatactaacaagtatatatattctcaaaaatactacaatactaatccttaatttaccagcaggttctgtaaatatctccgaatagaaaattacgtttaccaaagtgacattcaaaaccttttttagaaattaagttcaattctatatatgctatatcactgcatattatcgaaagagggcgtcctagaaattgagtaatatagtataaggacattcgtaatagttaggatccctttgaatcgcagaaataaaaaaacgaagaaatagaaaaaacacaggattctaacaggaattaaaatgtaaaacaaatgattgcaaaatatagaaaaacacacataaataaccgtttaaaccgtaggaaaaactcaaaaatcggatgagggagatagacccaaagcaaaatttccaagagctttgagctcttgctaaatttcctccaaaatctctataggattgtctattccataggagtttcaaatgattggataggattcatttctttgattcaaaagtatttatagaaattttttatatagtagaattgaaatcctctaaaatactgctatgttttttctctaaatcaaagcatgttagaatacgttctggattgtctactgtaggttgggagtactaacatatttggcattgactaattaatgctcgtggaatcacgggctaggttagttgtgtcgtattcacggtcatacccagatctgtgtagactggtggttgtagcgtgcgcatgcaagggtggatcactgcatgttactgtatgttagctgcgccatgaatgctatccgcagtgaccagtagtagggcaccagctgttgaggttcaggtctcctgcttctgctgctttcatgcagcctttggaccgtcaacatgctgggctgtacgttcagtaaagtagggccattaatctttgaggcccacttccattcaccctgggccgggccgggccgggtgatacctattccatgagagttttttttttcctcttgtgcttctcatcgtcttcttgttaacttattatcagccacaaccaaattttgaagtcctttcatcgtggtatatttttatgttagatttacatattatttatttatttatttattttatttgttgttgtatggtttatgcgctataaggaaaatgattagagcagcatgattctttccccgcatggaagcttctttgggatcagcttaaagaacaagcatattgcaacctttttaagttgtgtttactagggcttaaatttagacctctagctacgaattgaacgtatatcaactagttaaatttcttgtggtgaaaataatccacccgggttcaagtcctaaacttgacataggtgctcgcatttacgactaattattattatggtcagtggcagatatgccatgcagctatggggtcttgaatccccactcactactaaatttttttgacatatatctattagaagagtggactatagttttgtatagtttgttcagccctcctgttagttctttctagatccgtctctgattctatttaattattcttttaatggtaggtgacgtacccatcgatacgttgcttaaatcggtaagagaggacagacaatttaatcatagtctcgtcaacagaattattatacacgcgtgaccaacttaagtatgatggaaaatgcctaagagcaagttaaaaggagtgcacggggagggaagatcgctaattcactagggcaggatgggcttgttaggacaagagcaatgcgtcacattatttgttctgcctggggatgtcacattggatggaacttgtaccaagcaacttaacccacagtgcaagctaattgaaatggctccaccaacatcactttttcatctttcacctatctctctctctcctctttacctttcccatccatcccctcccaacagattcctctccatcttcgggcaaccccatcggcgcctgcctccctcccctacccgcctcagtgttcaatggcggtggcggtggcgaacggcatcccacgggctcggcgcccgacggcggcggcagacttggccacgtctcctcttgcgtgcccccgccacctcgtccgcgtcttcctcggcgcgagcagcgatgtcgcccgcggcggatcgagggcggcgcgaggcgcgagcgccgggacggcccgagcggcggcgacggcggtggcggatcgagggcggcccggcggagcggcggggtggcgagatccaacccccctctcctcttcctaagcggcagcggcggggcggctaggtgccttctcgttcacctcctcctcgtcgcctctcgtccggtcctctctctctcccctcatctcgccgtcttcggtggagctcggcacggcggatgacggcggcggcgtcgagcggccgcggcacctttgagtggcgtggcagaagacgaaaacggcgtcaagcggcgcagcggatctcacggccgcggcactgtggatgacggcggggcgcaggcacagagccacggacaacggcggcggcagcggcgctcctactcctctccctctccggcgagcttcttcggcgtggaagtggcttctccggcgagcttcttccctctctctcctgctctgtgtgtggcatgctttttctctgacaaatttagttgaggttctcggagccaaaacaagccacacgaacctagtttttacatgggtcccacctccttctctcctccacacggacattgtgcatagttggatagactttgccacatgtcatgtgtgtgcattgtgaacacccttacggctgcacaaaacacatgtttttttttcttttttttaaaaaagatcagcaccgactgcacgtctgttacggagtgcgatagattgtgctatcaactgacgatgagtcgcccactttattttcctttagttctttctccacatatatagaaattagaatgacatagcatattttatagtccactaagttagtctactgcacccactctgctctaattccaatttcgtctgctgttcaaagtgcagtggattcgtaatgtgacaaccgacaacaaagcttcttcatcctgattaatcccctgaatcaactctaattaacaagcttattcgcccatagtagaatagtgcgtgacgcttatcgataggaatttgtcatatatgttggagctgcatataattgctcgatcaaggcatctttaaaaaaactcattaatgataataggatacgataataactgaaacgcccttttgcattattgcgcttgtcggtgccgttgccattcccatttttcataaagtggcaccattcattatgaagctgatttgaattaataaaaattatgctttcaatcgaattatcattacttcatcatgtgatcctttttcgattatatttctctcaaacatcagcgacaataattggatatgctcccatgtgttaaaatagaaaaaaaaaatgaaccaacgcagtgcacatgctcatttgtttatgatccattcacagacatgcgcatgagagcagctcaagaacaaacaaaatatgcgctacagaatttggatatcattttataatatcctgatcaccctgggccccgtgtttaagctgttcaaggcacgtgctgcgtttcagtatgaaaatcgaaaatattgggtgattaatgtagagtgacagtgtgacacaccttcactttgagggagcaattatgttccacgtggcccataaaagatgacatcgatcttatattaagaacagcaaataaaaatatctcggcaaaatatttcaaaaagaaacaacggcaaaatagaaaagcactagctccctctcatcataaatatttgacgcgactgatgtagtttgatcgctcgttttatttaaaaattatatgcaaatatgaaaaatatataagtcacacttaaaatatcattgataacaaaacaaatgatgacaaaataaatagcatttacacgattattttaataagatgactggtccaactttattggtaaagttaattgtgtcaaaataattatgagatggagggagtattatgcatcaaaatttatttaaattcgtggagcatcaagtattggtgaccaaactatataagattcgatatgtatggttaacaatttaatattgtactcgcttcgttttaagttacaggatgtattttgttttttaaagtcttgaccaacagttacttcattaaatgtatccttttgaaaaaaaatgataccactcgattcgtattcaaaaatacttttttataattatatttttcgtgttatataaatattacttgttggccaaagtcctacatcctatattttaaaaccaagggagcagtaaacatcgttggtgaaatctagaataatgatccatagttacaacgccagcaacaaacacggtataaaacagtaatcatcgatcctgcaggttttgtttgatcctttgcacgttataaatttcacataaccatggtttgaacttggaaatgttttagaatttcgagtgtaacatttggagctaaaaatgagttcacaattaatagacgtatattaagggtttaaatgagttcacaataaaggagggtaactcatctgggtttaaaattcgttgtccacgtatattaagtacacaataaggacgttttcagtgggatttattgatggtattgggagttgctgctggtctctactccctccttccaaaaatataaggcctattcctttttcatcaaaacatcaaaaccaaaaagcaattaactcactcaccatatagcaaaaccaatgaacatgtaaccaataagtattagaatggcttcttggttttcaatcaacaatttaatttagcacacaggactcatattttttgagaaatcgaagaatgaaatatgtctcatatttttttttgaaggagggagtatttattttcttctttttttttttgagaaactgcgtacttcatccatcccataaaaaaccaatctaatactagatatgacacatcctaatacaatgaatctggacatacatctgtccagattcgttgtactaggatatgtcacatccagtcccagatttatttatttttggacggagggagtaagtagtaactctatttaagtcacatttgtacaatcgtcctcttgagaagatagaataaaacccttaggaacaaataccctgtaaaacagctagagaaacaacttcttttacgagcctatgtgctaccatattcgtcgagcaatgaactctgaaagacgtttaatctggacttaaactaacttcatgattctataaatagaacggtttagttctgactaaaataccgtcctagtcatttccatagcatcattattcaattagaacggtctccatttcttttaatgtgggttagaaacgtattagtgtgcgtatgttcacaaatgcttcattcattataaaaacttctgctagtagaagcaccagtgatgcgtggtagagttgtgggtgtataattttacccaccataatttaaattctggtgcccacgaatattacgtatatgcaaatgaactttcgaacatgattttagtgagatcagtgatgtgtcgctagtttccgtctcttagagcatgtgttaggggacatattagtggggtgttacgtgtgtagtggtgtgtgcgtgtgtgtaaaaagaaaacttccgctatataagtaggagtatgaaacatgtggagtagattcggatgaaactgacttttttttttttttgctgtgatgataatttgactgtcactgtcagtcgttggctagacgttaatactcctacttccgatagattataaaaccaaaccccgcacgcttcgcctttgctcgccgcgtcttcccttcttctctctctctcggccttaactaaacccgaatcttttctcttaatcccgcgcgcagtgcacgaatctcaaagcggccccggctccttccccttcaccggcggcgatggcgccggctccggctccggcgggctcggccgaccagttccgcgggcaggcgaggctgccgcggttcgcggcgccgcggcggtacgagctccgcctccggcccgacctcgacgcatgcgtcttcaccggcgacgcgtccgtggtcgtcgacgtctccgcgcccacccgcttcctcgtcctcaacgccgccgacctcgccgtcgaccgcgcctccatccgcttccaggtagtagatatatagacctctctgcaccttctcctcctcctcctcctcctcgccgcgccgcagtctcactcgccgtggttggggttggttgcaggggttggcgccgacggaggtgtcgctgttcgaggacgacgagatcctggtgctggagttcgacggggagctgccgctcggcgagggcgtgctcgccatggacttcaacggcacgctcaacgatcagatgaggggattttaccgaaggtaatttttaatgcatttaaatcaccaatggcagtggcaagttcacagcctgaaagctggcactttcgtttgttgaaatttctgctttattccgtgaacctctgttgaaatgctcggaatcgtcagtgcaaaatcgtggagttgtaggcaaaggagataactgataaatatatagtctgatggtctgcctactttgcacttatattgattgtgattcacaaatcagttgcaagaatacttttctatagatgctgagggctttttatgcaagcatgtggttggaaagtagttatgaatctgtgctttgggtctatttcgacaagttgtgtgtatcatctacattttcatatgagaaaatgccattcgttgcagtaaatatgagtataaaggggagacaaaaaacatggcggtgacacagtttgaggctgtggatgctcgacggtgcttcccctgctgggatgagcctgcattcaaggttaattcttatgatagcacgacttgttcaataatcataattttcttgtccagatgtttgatgcaatatgtgttgacatatcatatctattttttctgttgtttcccctcttcatatttaatattttcaggcaaagttcaagttaacacttgaagttccatctgagctagtagcattgtccaacatgccagtagcttgtgagacaattgctggtcctatcaagaccatccactacgaagaatcgccgcttatgtcaacttatttggtggccatagttgttggtttgtttgattatgtagaaggtgtaacatcggaaggtaaccatctttattctcgtcccagtaattcaacattgttgatggttcatagtttctcacattgaaggtgctttaggagccattttttcccttttacattccatttcattagtgtgtttaattgtgttcaggcaacaaagtccgtgtgtacactcaagttggtaagagtagtcaagggaagtttgcactagatattggagtgaagtcattgaatttctacaaagagtatgatcacaacctgtacctgtattgctttctaattagtttctaaacaactataataattcagctaatgcatattctatgtgcccaaggttgttgcttgaattaaatcattaaccaatagttcattccttctgtgctctagctactttgatactccatatccactccctaagttggacatggttgctattcctgatttcgctgctggggccatggagaactatggattggtcacttaccgggaagtttctttgctttttgatgagcagtcttcatcagcatctttcaaacagaatgtatatatcataactcagattctttttagttacatatttcatcatttatggttcactttgtaaatagtgatgcattattatttattagacattttctttgggacgtccaaattccttcagtgtaagcaactgttctttttaggttgcaattaccgtggcacatgaactggctcatcaatggtttggtaatcttgtaaccatggaatggtggactcacttgtggctaaacgagggttttgctacatgggtaatcaattatacaacactgaattttagaaatttaatatcaggatactactgtatactgaatggttggaccttttatttcgacagatgagccatttgtcagtagattcttttttccctcaatggaatatctggacacagtttcttgatagtacaacctctgctctcaaattggattcacaagctgagtcccatcctattgaggtaatagctgtttgatacatgccatggtctggtactctggttcaatggttcaaaacattgatgcatttcttatggtgtacaccaaatttgtctaaaaccgtaaatgctatgcattatatcgctgtagaaagtagagaatatattgttgtgcaaattttgaccatgataagtgacgctgatgcataatatgctggttacattcttaaatatccactagctaattcactgttgaatcttgacttttctatgtggtaataagatggaaatgttaattttgaggtcaaattaataagtgcaccaatacaattacacttcagctggtggcactttaacattttgtttcaatgctgactagtgatttgtttcaatatttgttgctgtttactcaggttgaaatacaccatgccagtgaggtagatgagattttcgatgccattagctatgacaagggtgcttctgttattcgtatgctacaaagttacctaggtgcagagcgttttcaggtttcatactggctctccttgaaattcttcagaatcgtgttattcttatctgtagtgagcaccttttgctcaactgtattgcttagaagcgtatgaaaattaccccaaaccattttctttctttgctctcggaggaagcattgaccctttagtctgtccactattcatttagttgaaaaacgtcaagtggacctttggatattccaagtttccaatattttaaatgcgtgaatgatccttaggcgatacaattggtgttaatgttcttttgttagtgattttgtaagtgaaattctttttttaaaagcttcctatattttttagggcaaatattaccatttcccccctaatcatcttgcttttgtttaacgagtaccctgttatcgatgacgagtcaaccattaatacttcattgcacgtacttgcatggtacttttggacatatactcaaatgatataaagaagcaagattcaacagatgaaaatattaatcctgtagagagaggcacaacttcaataagggtttgatggccatcttgtgtacttctctagggtgggtaacaatttacaacctgtaacaccatgtacaagttacaggagttggagctatctttgccctttttttgttgatcatatcataaatatgaacaaattgtaaacccactaatatgataaagctccatttttgttaattacatatttatcgaaggtcaattcttgcttacttctttatcttgtttcttcattattgctgtgtgactccacaaattctcctaatgcatcctcttgtactaaacttgtggaactgttactctttcagaaagcattaacttcatatataaaaaagtatgcctactcaaatgctaaaaccgaggacttgtgggctgttcttgaagaggtatctggtgaacctgtcaaggatttgatgactacgtggacgaagcaacaaggttatcctgttatcagcgtgaagcttaaagggcacgacttggaacttgaacaggtaataaattatcgaaaagagtagcgtcattccaatgtactgcacattcatctacttctgaaccacctatatgtaaattcattatgcatatggtttgcttttcctttctattttgccgaggtatgattagtgaggtacaattcctaaattaaaatcctgtatgaaatgtttatgacaaatattacataaaaaaattatgacagaacttcatcttagtttaatttttgtgcctgctatttatgaagatgtaattggctgactagaatttacgttgccctttcagtgcaagacaagttccacaagtagttcccataatatcaaaatttcaacggcacacgggtcaaattctgttttgacgcatttctgacgctctctctctctctcttttttgtcacaggaccaatttttgttaaatggaacctctggtgctggcatctggattgtccctataactttaggatgctgttcacatgataaacagaaaagattattgttgaaacataaacatgataacataaaggccattgtttcgcaatgtgatagccgacagaagggtggaaacttttggattaagttgaacattgatgaaacaggattttatagggttaaatatgatgatgagcttacagctgcacttcgaaatgcattgcaggccaagaagctctctctaatggacgaaattggtaaacacaacctgtggcactattaaatttctattgcaatgttttttttcctgggcgctattgcagcgattaaaggtgttataacactatattacaggcattgtggacgatgcacatgccctttctattgcctgcaagcaaacattgtcatcgttgctccacttgctgtatgcgttccgtgacgaggctgattacagtgttctttcacacataaattctgtatgtgtattttatgttgaattaaattccaggatattcagttattcgttggcaatgatttgtatatatcttttactttggcttgtcaggtaacttcaagtgttgcgaaaatatcaattgatgctactcctgacctggctggtgacatcaagcaactttttatcaagcttcttctcccgcctgctaagtatgtttaccatgtttgctgctttttagttctcaatatattatttcccattgtatgttcatactatgtgtatgtttgttaaacatgccttcctttgtggccatgcatacacgatgacataaattttatttgcagaaaattaggttgggaccctaaagatggtgaaagccacctgaatgcaatgctcagaccaatgcttttggttgcccttgttcagcttgggcatgataagactataaatgagggattcaggcgtttccaaatcttctttgatgatcgcaacacttcccttcttactccagatactagaaaggtccttcttttacccctactttacatggtcctctttcttttttgactcatctgtatctttttttacaaaaatgaattgatatctgtatatcttctatttgaagacgaattcatctctgtatattttgcatttttttttcaggctgcatacctctctgtgatgcataatgttagtagcacaaacagatctggttatgatgctcttctaaaggtctacaggaaatcagctgaaggggaggaaaagttacgtgtcttaggttgatatcttctcagccatcttgtgttaacaatgcttgctgatattttgggttatccagacttcctgagggctctgtctccttatctgtaggcacactttcttcttgccaggataaggatattgttcttgaatcattgaatttaattttcacagatgaggtaaattgctaaatggtttttttcttccatgactccattggaaggacctgattgaacttatacttttacattagctacctgtaagttatatacaggtctcatttgtttctcttgcttataggttcgcaatcaagatgcatatcgtgtgcttggaggtgtcataatagaggcacgtgaaactgcatggtcctggttgaaggtacaaaaagtccagttacctctatgcgttaccgcaacataaaatttgtgatatctggacctttgaagcatgtgattctcctaggatctttaaatataatgaaatatccacttattggatgttttttctgccctagaaagcatcaaaattatgcaaattttctacattcaaaattataagtaaatagctaaatttcgtgctttcttcaagtagcatttccttcaagtaatcgaattgtgtagatacgtcaaatgggggttatatttgtaagagaaaaggacaattatagtttccttagctactttgctggactattttacactatattattttcatgttaccttacccattgaatccttcttttaaagtcacttcactccctgatgatattgtctttttttgcctccttgtacaagtcatgttttacaaagaaattttgtaggatggtagattaccgcatatgctatattactaattattctcgaaaatttccatgacttttgaaaatcagtctttattgctatgaacctatgcaagtagcctctccgaagaacactttgaatgataaatcaaatgggttacccttgtttgagaattagtaacttccactcttgtttatcttgcttctatccatttccttacaaaatacccccttcgtccccaaatataagagattcacacattcaaaatttgtcctcgcaaacaaggtgtcatagagtcctgctaatccctccaaccacccgtgattcaaatttctccccatattgccccaaccaccctcccactccctacacacccctcattatttaatgatgggctcatagtatttttcctctatccttaatttctccgaaacaacctagactcccttatatttggggacggagggagtattaaacatgcaatgaagtaatagaaaatgttgagcttacaaatgttgtttcgttcggatgcaggaaaactgggatcgtatctcggaggcattttcaggaagttccctcatatcggatttcataagatctattgttacactggtattactcatctgcattctctgttcaattccgcacgagttatctctcatcatgccatttgctgaaacatgctgcttctttgtttgccggtagttcacctcgaaagagaaggaagcagagatctcccagttcttcgcgacccgcactaagcccgggtacgagaggacactgaagcagagcctcgagagggtgctgatcaacgccaggtggatcgaaggcatcaggggtgaagctaagcttgctcagactgtccatgagcttcttcacaaaccctgatctgtatccggtgtgatccctcccccccgggagctgcattccctgctatgaagtgccaactttaggcgaagcatttgtcgtagcagcagcatcccagcacattgttgctctctgtttataagtcatgaagcataggctgcatacgaggcaaagggatatatagtgcttaccgtttctcttcataggttgtgtacagcttgtgcccaggagccatgcatatgattcaagagttgtcgcacaattctactgtagctttgaagtgtccgagtgaataagattttacctttcagcattctgtatcagaccgagctcaactatttgtcgggcgattgttctccttggccatgataacttaggctgtgttcttctcccccattttcccaacccacctctcgttttccgcgcgcacgtttttcaaactgctaaacggtgtgatttatgtaaaaactttctatatgaaagttgtttaaaaaaaccatattaatctattttttttaaaaaaatacttaatacttaattaatcatgcaataaaacgaacttcgttttgcgtaccgaacacggcctaagtcagatttgcatgaactagcggactgatcacaaagcggttagtacctccaggaaaaaaaatcgtgataatttaagagagctctcccctttcccctgttttttttttcatttcattcttaaaataaccaagcacggtaaaaacgtactccatccgtttcacaatgtaag

SEQ ID NO: 79684 - DNA, 19321 bp, Oryza sativa
tcttacccctgaaacggaggaagtattagttttcagttatatttatcattttcagaaatgaaaatcttcactgatttattagtgtatttcagaaacctgcaacttatatggttacaatatctgtttcctacatctttaagtcaggttttcagttagcaacaacttcaacaatcagtttccaggccttctggcaaagtgggtccacttatcatgcgcatggtcaagttgaccattacaatttaccatgtgtacaaactggacatgcacatatggctccctattggggctagggagaggagataacaatatgggtcctaggatcaaggtttaactaaaatagagttagttatgcacttacttgatggtggctttaccctgcgtggcgcactctcttccaagaccacgtcataagagcaactccagtgtggggcttaaaatgattttaatgcaaaaagatcgaactgtgtacactgtggcagtcgacgcatgcatgtcagagcaaaaatcaaactccaaagtatattcaaactcaaccgagtaaatagttcgttgccctgggccattggcacatgcaggcagggcagaatgtagtgattggaggaacttttttcaacatgggtcccacgattcgattcaacactacagctatcgaaccaaacctttattcaacttcggtggattgtagcagtcgaatcagcagtggagctgctctaaggccactttgcattgtaaatgccctagcagtcctgagttggccgtttgagaaatacaactgaacctgccttgtcaaatggtttagatggtagcagaattgcagttctgtgaacaaaatttgtgcactgattttgtggtagcagaattgctgaaatcatcccctgaagttgtagataactgatagttatgttaaatttctgttatcacatttactcttgatttgttgctattattcttaattgtctactcattattgcatattctttttcagaaatttattcatgcaatttctcctactccagcatctaccatgtccagtgttgatattcacgcaaggcctccaaatactactttatccccatatatttctccagcaaagtcagttcctgttgaagaaactccaaagcgtcctgctgaggatgctgatttgcaatactggcgttacgatgtcaagaagcaaagacatggtgaagccggtgggaatcgtctatgtttcaaatttacatcatcaggatcctgtcctcgagggagtaaatgcaattataggcatgatgaggaggccagggagcattacaataggaatgtctgttttgatttcttaaacaaaggaaaatgtgagaagggtcctgagtgtaggtttgctcatagcctttctgatgagggtgctgttagggatacaaaaccacgtaggtgagaaaatattccaaatctctcactctgtctgaagcacacatgcacaatctgccaccccacctactcacattgcacttttacaaattaccccttaaacttcttagtattaaatatcaatcaaatcctaaatggatagacatataaagttaaattgagtagtagtattataatatattttatatttttttatctatagcaaagcacaagcattcggctagtatactaagaattctgattatctaattgtgggattcaccctgtatttttgtttactacagcgaacgaagacgtgttgagagcagttgctggttctgcttgtcaagtccagatgttgaatcacatcttgttatcagcattggagaaggttactactgtgcacttgcaaaagggccacttgttccaaaccatgttctagttataccagttgagcactgctctagtacactaaagatgcccgtggaagctgaggcagagcttgggagatataaggatgctctggccaagtattttgagaaacaaggaaagatagctatatacttcgagtgggtttctcagcagtcccgccatgcaaaccttcaggtgaggacatttttttcctgatatgttgctccatgcttccatttaaatgatgctgtcatttggaatttggatgcttgtatgcgatctcatttgttttttgttcatactggatggtaatccactaaatttctgcgcaggctgttccagtaccattgtctaaagcatcaagtgttaaaaagatattccatttagcagcacagagactgggatttgaattttctgtagtgaatccaggtgaagttgtacctaactttatctctcttagtcagctgaatagaaaggggatagacaaaaacaatcttaggctgcgatcgttcccctgggttcccctgggttgggaacgtaaccctccggcacggaaaacggaatggtccattagcacgtgattaattaagtatttactaaatcttttttcaaaaatgaatcaatatgatttttttaagcaacttttgtatagaaactttttgcaaaaatgcaccgtttagcagtttgaaaagcgtgcgcgcggaaaacgaaggagaggggttgggaaccttgagtatagaacacagcctaaatgggctattcacacatcaatgagcatactgtgatgccaatacatcttcatgatgttgcttctctaaggaagtcttcctaaaagtttcaacaattgtgtatcacgtggccaagttttatgttgcttataattcgatttgccctgagctctctctttgttttcagatggtgatgctaaccgcgccagggaattgttaagatcagagtgtgacagcaaatcaagcttgttttatgttgagctaccagaaggttcagtgcttttacatttggttgacagtaatgagaagttccctgctcagtttggccgtgaggtatatataccatatgataatcgttaaggcctttttttgtctgaaaaataacctacatggggatggaaagaaaataatgatatcgtcgaaacctaactgtcaatctacaggtgttggctgggttgctaagcatggcagatcgtgcagattggaggaactgtaaggtttctaaagaagaagaaatccagatggtggatgattttaaacaagggtttcgtgagtttgatccagctgaatgacaatgtgcttaagttgctaatttgtcaccggacaagaacgtgctgctaaacttgcattgtatttttgtagttgaaagtacttaggtaggccatatttgagaaatggaccgactttgaggtccattattgtaatttctattgattgattcgggaacaatttttttttcagttaagagttaaaatttggccgtagtgccacgtttgttcttcgagacttctcgtatacaatgtgatgatctgaggcgatgggcagtggtcgaaattcttatatatcttttttctttagacctgtgtcctaaagtaggaaataacacatttttcttgtgcttgtcgatgcagaacctgattgtttttttcgcacttaatgtgtagttggtttgaggaaaaaaaagggtccaattagaaaaaaaaaaagaaaacatgaattcccaaaaaaacgagaatggaacgtactagcgtttgtttgaacatatgacaaatttgaccgcgatatcttttatcgcttcctattttctaaaccttgacttttgaaggagaaaaattagaataaaataaaaaccatatttaaaatcatttctcgttgctcgagtaacaaaaaaatagaataaaaaaaatcatatttaaaattatttcttgttgctcgagtcacgttagcctacaagggataacaaaatcaaacatttgtcacgtgtcagcagccaaaaaaagctcgaccaaataactataaaatcgtgcataacctcattaaaatattgataaaatatattaatactatggatatcagttcacaaatgcatgttagaactattaggagcggccaaacatgcatcagcccatgcccaccctaccccatgtctaggcatcccacttctaccgttgtcggagtaaacgatttactcatatcacgcgcccctaccactcacctttattcgagtaaacgatctacttcaataataaaaacaacttccctgcttccgatcccaccctacatggcgcatcgtgctcccaccattaccagaataaatgatttacttcaataaaaacaacttctctgcttccggtatatattctatttttctcgtacccaaccaaccactctcgcccccatttctttttttttctttttttcggatctgaatcgatccaccatcccagcccacaaatcggcgacacaccatgaaggaggacaatgacaccttggcggttgatggcggtgatcggcggctgttgaggcgacgacactgcttggggcctcgctaccgaacgctgggcagcaccttaactagcaaggaggtgttcacctgggccaatagcaaaaaccagcggctgctccatgtcggcgacattgatagaacaaacaagtaaggaattgacactgattttcatctgcatactctccttcaacttcacgtatgaagccccaaattatttttttgcaaatcaaattaacttgcaatctgcaatattacctgatctcaattgatgggctacacaagtcctacatttgcacatcgtgctccatgtggctggctgcagaggatagggtggagtccgccggtgatggaggttgtttgctatttttcttttactcgtcatctctatcgacatgaacgagaatgtttttgtatttttttcgtgcttgctagatgatggatggctgctactgcgcaacgtcgagctcatctctagaccacaccgctacatccttccatgattccatcatcgactactgctcgccaactggttgccctctccactaccagtcacaagacacataccatcctcttcatccttatagcaagatccagcaaagccactagacggatttttgacagaatcatttttttcttttctagtttgattcacctgtgagtaattttatcgcttgtgtgtgattgagcctataattttttcattcgtatgactattttgtgatatagatcactagtttttactcttatactgtatattgaacacatcagtaaacatattactacacggtggctacgagatcatggctatatcgataggaaagtgtaattattttactcgcagaccatgaaatctcaatttttactcttatgtattgtgtattgaacacatcagtaaacatattactatacggtggctacgtgatcctgggctatatcgagagaaaggtagtaattgttttactcacagaccacgaactgtaaacaatatttataatattggtaaaataattactagcattgtaagctggtagtaattcttttataaccatctagatatgacgtcatacgatgttgagacattcatgtgagtaaatatgttacttttaaatgagtagttgtgagaggcattcgttacttccaaaatgcgcagagatactaggagaacaaactcagaaaaaaaaactagaagctaaatattttactaaaacgcgaaaacataataactacatagaagaaacgaaaaaacagaaaaaattactaaaacatgaaaacagaataactacaaagaaaaaacgcacggataaggtggaaaggagaaaaaaaacaaaaaaaaaagtaggatgcagagaaaaaggtggggtggtaaaaaaacaaaaaccggagagaatgttatacggcgctcgatctattattccgcactctagcgctaccgtaaacatttctcgagtttatctccgtttcttttctgtttttttccgttacaacgcacggaccgcaacttcgttcgtcgaacgattttcaaacgtgcaacggctactgcaaaattacgaaccgaattacgaaagaaatcgaaattctcccccgttaataatccacgttttccgatgcatccatgactcattcttcgtccgttcgaccgatcgacgcgtattgtttggatcaggtttgttcatcggccagctagctatacctgcaggtagctcgatccaaattaaccaaaaaaacaaaagaggttaccttaaatagcctaattgcgcaattagccaccactaatcacgcagcgaaacacggtcccctcctctcttctcctccactcaccaagtcaccatcgcaccgacctcgccggccgcggcggccgcggcggcggcggaggcggaggcggaggcggagccagcaatgacggcgtcttcctccaccaccaactcctcctcctccgtctccaccgccgacacctcctcctccaacccaccgccgcaacacgcgctccaccgccaacacatcgccagcagcagcgctagcagcggaggcggaggcgccgcggcgccgcttccgccgcgcgcgcccccgcgcgtaggcggcggcggcggcggcggcgtagggcagagccaggcgtgcgccgcgtgcaagtaccagcggcgcaagtgcaacgcggactgcccgctcgcgcgctacttccccgccgacgagcagcggcgattcctcaacgcgcaccacctgttcggcgtcagcaagatccagaagacgctgcgggacacgccgccggagctccacgccgacgccatgcaggcgctcacgttcgaggccaacgcgcgcgccagcgaccccgtcggcggcgcggcgcgcgtcgtcgtcgagctctgccgccagtacgagatgctgcacgccgagctcgccgccgtccagcaccacctcaagctctgccgccagcagcacgccgctgcggcggcggcggcagccaacgatccactcgtcgcgaacgtcgacccgctcgctgacccggcagcggaaatgctcttcgccggcgccgtcgtccctaaccagaacgacgacgccatggtcgacgcgttctacgccgaccaacaaaccgccggcgacggcgaccaagagcaatacctcgtcaaggacgaggcactagctgcgcaaccgccgccgcaacaaccctacgagtacttgaactacgggacggccggcgacgagggcagcagccacgcctggtacaccggcaacggcggcgacgccgacgcctcgccgccgatgggtttgagcgatcagctccagcagtgccagatcggggccgcgccgccgttcgatgtgaagcctgagctgccggcgacgatggaacacggcggtagcgtgttcgtcgaacagccggagcagaagattctgccggcggcagggtcgtcgtcgtcggcggcggcgcattgccagctggagcttgggtgctcttctaatgcttggaaagttggaacacacgttattaattaattaattaattagtttctcgatttgattgattcggatatgatgaaatgcttgttgcatttcaaattttggcttgttgagttaggagttaattacaaaaataatcactagactagcttataaatagtcaagttttaattaatagtagatgatgtatctatgaatgagagtgcaaataaaaggctctgtctattaatgaggttaatgaaattttctacctccaccaaggaacagaggaaatcaccttcactatcaccgtttgagtttcgccatctccctcaaatcattggcaagagatgaattctgatccagttatgtccatgcattattcgactgaaatttgaggaaatctgagaaacaaagtttttacatatagatcttttcaaggaaaaaaggagaataaataataatgttgtacaaatgtttttttaaatcaaatttactcctttgttcttgcgagagatatataagtatcaaattaatcataggtgatgacggaaaaaggctatgcgcctatgcgacgtggctcctctattggattgtgatgggctgcctattgggctgggaagccagggagacctgcggctgggccaaatgagtaaggctagactatgggggtttgaaaattctgaaaaatatataaatactagaccactatttttttttcactagtgctcagtcctaagctgcctcaggtccaattccacccatggtgagaagagcaccagaataatagtgagaatgattcatatttttgttcttttggtgaaaaaggaaagaaaacacatactatcttcatttttttaatatagacaaattttactacataacattttaatttcgtggttttaactgtagaacactgcacaaactcactttttttttgaaggggggacactctataatataccgtggtaatttttcagcagacaccgcaccgattaaaataatgtatccgtgttgacaacgtgttaggggggccgattttttatgtcgagtgaccgaaatgcccttgcaccttttggtgatattgaccaggtcggcggtgctatttgccgacaccgaaggcgaacagcggcgattcgcacgttgtggccaaaagaaaaaaaaatgtagaggaggtcaagacgaacacaacggtggtacatgcagacagaatggccacgggagtcaacgccggttgcgatgcaagcgggttggagtttcggcatgtgtgtgcatgttgtgctataggctcgatttggctaggggagtgcattcatgtggctctggggtctctaacggcagccccaacccttcatctagaattgtgtttatggcattaactatattgtcatatatgacttttagcttatgtggcactatattaattaagagagagagtgaaaaaaggaagaaactgggtctcatgcaagatacagcttcaacacaagaacctatgtactagacgctatcaagttttgcattgggagataatagtgtcttcataatagatgaagaataaatatgattggtagataagagagataatgtatttattaatggcccactttaagaaaccatgggttgtagagtgtagtttctattgtgatgtcttagggcagtcccaacccatagtgtctataagtagtgtctatgatgctatgtcaataagacccccgggggaaatagagatgtctcctacgttacccataatatgtagaagtatcgacgtaatttcatagagtcattcgatctgaatgttacatgaagaacataagccagatgacggaacgcggagacctaggatgtagaacatcataacatgagcgattcggcagatttggattcctttcctatatatccactcatgtggtacttcatcatgcgattcatataagatccatctgtctagagatcgtcatatacatctagaaagccgtatgctttggaagaagcttgtacagtttgggaagaggttttttgagagaaaagaagaatctacttcaaccgatatgcccttaggcacggccatacataacatagaaatcacacgtggaaggggtggctaattagctagagcagcaggtgttgtagcgaaactgattgcaaaagaaggtaaatcggccactttaagattaccatttggggaggtccgtttggtatcccaaaactgcttagcaacagttggacaagtgggtaatgttgaggtgaaccagaaaagtttgggtagagccgggtctaagtgttggctaggtaaacgccccgtagtaagaggggtagttatgaaccctgtggaccacctccatgggggcggtgaagggaaagcccccattggtagaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcaagatattggacatcgaatgccactctttaaaatggaaaaaaaaggagtaatcagctgtgacacgaaaaaaaatgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatataccaatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaagaaataggtaagcggggaataaccttatttataacaagtttcaaactggtaaagtatacccctgggataaagaagaagaagagtgggctaaggaaactcgcaagaaaagtaccaaccgatcatctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggtagcagcaaatgctactcattatagggatttcgacaaagcaaatttattcatcactaaagccgaagtcagtagtactattatgaataaattcagacctcgggctcgaggacgtagttctcccataaaaaaaaaccatgtgtcatataacaattgtactaaatatagtaaagaaatcgaaataatctttagatccatctaagatttgattcccggtaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaaatggactcaggctcaagttccgaagtaattacacatagaaattcaaaaagaaatcgatacaatccatgtcataatacatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccaaaaggcaatgaaaaaagccattgaattaactaaaaaaaacagatataaagggagtaaaagtaaaaattgcaggccgtctcgcgggaaaagaaattgcgcgtgccgaatgcatcaaaaaagatagacttcccctccaaacaattcacgctaaaattgattattgctgctatccaattcgaactatctatggagtattaggagttaaaatttggatattcgtagacgaagaataaccaaccctgtcttcccattctgttcagtaatagaataaaaaatgacaagatacttattttccctaaaatccctgaaaaaaagaagaaattctacctctttctataagatttaatgaaaattgagaaatcttttaataaaattgctatgcttagtgtgtgactcgttagttttttttagggttcaaaaaggggattaaaaaaatagaatgaaccctactatgtaattatataaaatgaactaataaccaacctattgcttcgtattgttgagatcctaactaagaaacagtcactatatgaataaatacatctatcataaatgagtaaatctatcatatacgtgtagcaactgcaattttttgtttttaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacaaagaattcgaaatcgtaatttgattgaaacaagaaatacaaatttcaaggaataacaaagagtgtcccgagttaataaaactgagaaattgacttggaaagaaattttttggaagctccattgtgagattaaaacctaaccattaaaggagaagccgtgggaacgacagaacctatgactggataggattttcttgaaaagaatcccaatacttcattgggtgggatggcggaacaaaccaaaaaaattgtcttatttgataacaaataagacaggaaagagtaaatattcgcccgcgaaatttttattgaattagaatactttaccgcgattcaataagagtaaaatacaaaaaggagattaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccattgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacatatgggttcgggaaagggatcccccgaatattgggtagccgttgttaaaccaggtcgaatactttataaaatgggcggagtatccgaaactgtagctagagcagctatttccatagctgctagcaaaatgcccatacgaagtcaatttcttcggttagaaatataacccccgccaaaaaagtagtattgaaaataaaaaaccaggttcttctttctggaaagacaatatttctttcatccttttgcattgaaataataaattgaaatcaaaataatatgattcaacctcagacccttttaaatgtagcagataacactggagctcgaaaattaatgtgtattcgagtcataggagctgctagtagtcagcgatatgctcgtattggtgatgttattgttgctgtaatcaaagacgtagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacgtgttgattatagaaaaattaggaggaacctagaattagagtcttatgggcaaggacactattgctgatttactaacctctataagaaactcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagtgtatcagccgacctggcttacgaatttatgccaactatcaaggaattcctaaggttttgggcggaatgggaattgctattctttctacttctcgaggtataatgacagatcaagaagctcgactaaacagaattgggggagaagtcttatgttatatatggtaatcgcctcgcccatagcggtaatcgccccacctatagttatagtacccaaattctatcttgaacttcctatttttcaaacaaaaatacaatgtttttttatttgaaaataaaaaaagaaaaataggagaaaaaaaagtagtgtctatgatgctatgtcaataagacatcacaatagaaattacactctacaacccatgatttcttaaagtgggccattaataaatacattatctctcttctctaccaatcatatttattcttcatctattatgaagacactattctctcccaatgcaaaacttgatagcgtctagtgcatagattctcgtgttgaagctgcgtcttgcatgagacccagtttcttcatctcttcactctctctcttaattaatatagtgccacataagctaaaagttctacatggcaatatagttaatgccatagacaccatcctaggtggagggttgggactgcccttattgacatgacactatagacactacttatgggcactatgggttgggactgccctaaggtgcttaccaaggtccaacaaggttggtcgcagtctgaacaatagcaagggcatccggaacggcttggcgacattgtggacaccgagcgaatggcgacggcgtgcttcggcaaacgatctggaaagccaacatatctaggtgatcagtgaattcctggggattctatggttgcgtggaatcgagatgcaactcaccggagagcgggggatcgacgttggaagccagtggccggagttggagaagaaaaccccgatctcctcatcgctgcatccccaaccaaggaagataggggcgttgtagagggcggttttcaggatggtgatggcgcaagggttcagccggatctgcactgaggcgaccggaacacagggtcgacgtcggcggtagcgtctgaagcgcgcccgcaagctccttaggtgtggtcagggttcactcttatcgtttgaggactttgtattggggtcaccgaaatcccgaaatttccgaaattttgagcaaaatttagttgaatttgaacaaatattatccaaattcatgaaaatattgaaaaatttaaaaatttcggccgccgaagtaatatcgtatcggaggtgaccgaaatgaccaaaatttcaaaaatttcggaaatttcggtccgaaatttccaaccctgggtttggtcacgttcccgttgatccactattcaaaatggattaggaccaaaataaaagttgtcaggcatggcacgtaaaagacaaaatggaaagagatcgagaagaagctattcagtggaggattgtaccatcgtctccttcgcggccgccgacagatcggaaggaggagaccttggaagctttctgtcttggtttcaactgctgagacatgaacgtggaagacgagaaatggttcagggagcttaggggatgtaggcaagttctccatagaggcgtcggtgggggtgaagtggaggccgggctggagctttgccgacgtggcatgaaggagcttccacgacgtcttccgcgtcaatgaccaggtcaatatgaccaaaaggcgcaaggtcatttcggtcactccgcataaaaaatggggccccctagtgccttgttagcacggttacattattttaattgacgtggtgtccgctggcaaattatcatgattataaaatgtcttccccaaaagtgagttcatgaggttggatgcacaggaggaatggagaaagaggaaaagcaagtgattggtgccatgtaacttatgatctatttgaaattatctggtagtttggatttcaatgtcttttagagaaaaaaggaagctagatggaatagacgcatatagtcataaatgcggcccactcaaataattataaatacgcacgcacatagatcataaatgtggtttctaaggcctactcaaatagacagaggccaataacaaatcctcgatcttaataaatacctactaaaaatgtatctgcatatgcgcaatatttgtggtcactgatgtttaaaccttgttagatgaaatcatcccataacttcaacaccacatcacttgcgctttaaagcaaatttaatcaatctgtcatatatatactccttttcttgcctagagctccccctccccccccaacaaaaaaaaaggccaaaaaagtggcatgggagagttttaacacattcaagggagggcaatattgtggagtagccagtggtggacacacccattaggcagggtgattcgaccggcccaactatagcctgtgtcgccccacacctctaaccctcatttctaatattgtttctagcacattagtcattagttcactatcaaataatcatataaattaagtattttaagtaaggataaaaacatttatgaaaattcgtgaccaaatgagtattatttctgtataagtagtaacattttggccatacataaaatttgattttttttctatttcttcatcacatattatagtctacagtaaatagttaaattggtaaatatatataaaaaatccactttactcccatgaactattttgacgaagcacttaaccggttaaccccccaaatgctttttcatctcgttttatacccccgaactattaaaagtggttccccttagtgcctcaatatttctcttttgtttttatatctctctacgtataagtcatatatataagttgtatttgaacataaatttggtaggactcatatatccattataacagtgtaacctacctcttaacattttgttaataattttatatcactattatatatgtttcgatgtacttattttgaaaatattttgatactttgataacggtgtaatttatggcttaaaaaatttctgcttaaaatacgcatcgtataaagagaaacaacaaagggaaatactattaagaagcaaaacaaactattttcaatagtttaggggtataatgagcaaaaaaatatattttatgggtttattgatacaatggaacaatccacaagtgtgaaatggcatttttaaatatgaatatttccaaaggcctataattttttttaaaaaaaataaatgattttgtgttcattcattttcatccctaattcctggcatgaggcacccatcgtctctcatcttcgtgactacgtctactgccctgtctatctgactctgatgtttgttcaactgctaattttcgttgttaaccaatgtttgtgtggtgtgctagcgcaccggtgctgtgagccgacgactatgatttatatgcgttgtgccattatcaaattagtaatagctctttgcaagataatgctgcgttcgccgatgctaatcaaattaacacgccctaatgttgatcgccgtggcaaccaagtcatgaggtaacgtagatacccccttcacatcaacttgcacgtgcatatctacacggctgcacccagtcagcaactcagccacgaagaaaacaaaaaggagacaagaagaattttcttagccattaagttgctatcatcaacttaatgcatcatcctaacaagaataactttctcatgacagtgagcgagttaacatgacttggctcattaataagctggtgatgatgatacgcaagcaagcaggcatcatcctggaaatttaatgcatccaaaaatccaggtcctaacgcaaacaccattgaagtacacatttttaatttaagttgtagcgtagtaccaattgtaatattatatccatcctagaagcatccgaacacaataagaaacaaacaaattaagagttgtcacgcgctaggattttgagcggccaagttagagccgtcacttagtgagtaaccttggcctaatcaactttctcgacacctaattaattcaaagagccatcatcttttgttaggctgcttgcgtaatcgagctagtcagcccaggaaatgttactgagttactctaacaaatgtaataccccaacaattttactctttctattctcaaataattaattactctcccctttttaatggataatgtcacgttttactattctccctatttaaaaaaattatttaaataccatttatttcgttgtgatatattttagtattatagaaactttaagtatgacttatactttaacatatttatactattttttaataaaacaaatggtcaaacattattttaaaagtcaacggcgtcatctatttaaaaaagaagatacgattatcattttactcttacaaaggtaacttctaatagttagattgtgatgaaattacaattatatgatcatatttcagatgcaacacacgtcgataatataatattttttttaattatatggtagacgcatacgcacacacctctacgcatgcaacaccactctcactctgtaaatgcgccccctaacgcatgttgtaagagacggaaaccggtgataaattcccaatctcactaaaatttctgttcaaagcgtgttttgagtatatgtaaacttattgcctaaagagaaatggttaaagtgtggatagtattcactaacacatttgtataaaaaatggagacagacaaatctttgcgaactctgcatgtacatttttactttatttgatgaatatatgaatacctttgcctttacaatccttggtttttcaatatttatccctttgaattcattttgtaagcctaatttcctgcacaatttattacagcagtctcccagtctcctctgtcaagccaccgccatactaaaccaaaacgtccaagccaaaccaaaaatagtgaaaatacacacatgcatagtagtaaaaaagtggattaacaacggaccaatttgcaggggaacaaaccggcgtacgaagctacgagcatggcaagctggcaatctggcaggcccggtcaaagtttgactattttgcccacaactcagacgcgccgaaatgagccatcgatttcttcgttataatttaatcttacttttcaacttaaaaaaacatagctaattacgtgcacttataaatatctatcttccgatcctcgcaaccatagcattatccagcagcaaaaagattcccctctttttgtgcaagcgagaccaacaaagtgatcgaaggcgcaaacgcaaggcaaagcagagagaggcgcgcgatggcggcgccg

SEQ ID NO: 79685 - DNA, 23958 bp, Oryza sativa
tgtaggggttgggggtcgctgacgggtggggtccggtggtggcatgtggggaagggggtgtcctttctggcagtggcaggtattccgtgctggtagttgtgacttgtgaccagtagagtgaggtcgtactcgagttgaccgactgggaacctcctcttgccgacctcaatggtttttacagcaacagaaattttagaaaatcttacttccttcccctcataatataaataattttgtatttttttctttttgttttattaaaaaaaattgtgcaaatataaaaaacgaaaaattatgcttaaagtattttggataacaaagtaagtcacaaataaaataaataataattctaaaatttttttgaataagacgaatggttaaacagtgtaagaaaaagtcaatatcccttatgttatggggcggagggagtattatttgaagtcaaagttatacacaaccacgagtattacaacgcgtgacatataaacacggtttttcatggtctatgcgattcataaaattatgcatttattaaaatcttgaaagtagtgaagaggtaaactatcaacattagccaataacataataaattaaaaattttaaatacactcttatgttttagattttaaagtacaaacaaaggtgggattctgtgaaactttacaatcatggtattactatctaggattatatcctacaagccataacacttgtggttttctacagttttgacataaaacattaggttttctaaagcttactatatgattttttagagatgtatcggtgaaaagttggtttcaatctatcaaaaattagaatcctcttgctcttcttcttggtttctactggtggggttgagcactgccaactctcagtcgagagagatcccgcacgaaaggaggggataacgatggggtggtctacccttttttattttagggagtattatctcctgtataaaaagtacatcttttaatacttaaatcctcgataggggtttccaaaacaagatttacaatagagtttttggttggtgtgttttaaaggcattctcaatgtatgatgcttatatcacctttaagttgggcctctcgtaggtagttgctctgtccataaaaacaagttctaatgtttattaccagttgtcgacggggataaccgtagaccggatatagagggtattggggtacgctggtacgaggatctacgtaatacgacatcaagcaggcagaaaacaaagattatactggttcaggccccttgataggtaatagccctaatccagttgatatgggattatatgatgtaagccacagattacaaagggaaaagcggaactcgatgatatcgacgagatcgtagtcaagttgattcgactagatcacccggcgacttggctcctgtaggctccggcttcgtaggctgtggtggttgtcttggctatgagattcgatgccttaggtcctcccagggagtcccttttatatcgcaagtcagctagtctccaagtaggactcggagacatcggacccggcatgatacaatgacgacccagttctgtctaagtatgactccttccatccgtgaactccatgatgaattcccttaacgtatgccgaaaacgtccgtatgcgcgcaagtataccatatcgatatgtgacgtatgttgaagggtagagggtataccttacccgtaaccctgacaatggcccccgacttctgcttaaatgaactcatgtagccgatcatgacttctgatgtcgaggctgtcgttgttctcagtgtaaggaccgagagacaaggagtgatcgacagcgcccgatgaagctcaacggtcacgagtgaatttaaaccgaagtccaaaaaactgccgcgcgtaacggatccagaaatttccggcggcaatctctctcctttccttggaattcgcaccgtcggaagtacagctacttaaatgagttttggggatcccttttgaagtccgcctattgtgaaaaaactctccagcctccaagcgttcctcatcttctccgctcccgcaaaaaccctagctagcgcatctcggtcccttctccggtgatcttcggcggcaatggatctcgacaagtctacctccaccagcgcgtcgctgaagaaactgcaggaggatggcgcccttcccggtcgcgggaccatggagagagaagtaggaggtactgaaccccagcctgtcctgggtcgcatagttgcgatcgaggactttattctctgtggttttcttcctccgccttctgaatttcttctcttggtcttgaatttctacggcctttccttgctccatttgaactccaattctatcgccttcctaagtatcttttcgtatctttgtgaggcctatattggggtagagccgtttcttgacctcttccgcttttactatgagttgcgctggatggagcctaaaaagggtgtccggatgtgttggtttccgacttcgggatggtctgaagtcgcgatacatccccttccagtgcccctcatctcgcagcaaatggcgggggaggtggttctgtcttcagatagaagattcggatccggtcttcattattcctgaggagcaaccagacaagatttcatcttggaccgtcaaacccgccttgaccccatccctccaatctttcatcgatatcattgatgacctccgagtacgggggttgtcggggtatgaagtcgttgccgacttcattggtaggcggatcctgccgctccaagctcaagcccacccagcctttgattattctggaccgaaggacgcgacccgggtttctcctcggagtatttttctttgtagttaaattgactcccttatgtgtgtgttcctcccgacttatcgaattctggtctcgatttacaggcttggacagcgcaaccgtgaggcgccgcgttggccaaaatatgatcagtggctcgacaacggcgagcaacgtccctgtccccctttgcgagaaaggggtagccgaacgcgaaactgccatcaatgtaagtgtactcagtggcccttttgcatttttcttccgggatcgcattatgacatcatgaagcgtaggctctccctctaactgatatcatcgggccgctcgtggaccatcaggtggcagcgtcgctgaaggagaaagtcgctaaggaggcgtctgacgctgttgccgctgctgccacaatgagtggcggcaacgttccgaaaaaggggaggaaattctcctctgtggtcggacatcgtcggaagacgtccaccccttcggtaagttttcctggtccttcatcgcgtagtcgggaaacttccccctcatatcatgcccgttatactccaggcctcggatgcatctcccctgcctccacgacggcaatggcttgtgacgcttggcgagaagtgggtgaactttgaggttttatcacttcatcgagctcttgcagcatgtctcaattgcagcctttcacagggcggcgcaggcaaaagcggcgcaagatgggtccggagggacttccagcgtgtctcctgctgtggcctcgacacatgtcgtggtcgtacccaggagccgcgaggtgaagccaagcggcccagccagcgatctcgcggctggtcggggtccgccgactgccgtcctcacatgggaagagctccagatcgcgatggggcgcctcctcgaggctggtgctcgcggtgttagccgcgagatcgcggaggcgagagcggcgatggcgtcgtcggcgaatgaacgcgtcgaccggctgacgcgtgatctggcggagtcgcgaggacctccagaaaatgagggaactggtggccggcaacaagcgacaagggcaggggcttgagcaccgcatgtcggagctcgagaacaacttgtcggaaatccgttgctcgttgcgggtcacctacactggtctgcaccagctcgccggggagtgcggtatcaagtccaccatcccggcgaatcccgatgagttctcgctgacaacttcgcttgctgagctggcgacggcgatggaggcgatcccctccaagcacgcggccaggatcgaagaggagacgtccaacgggatctatactagggcgtgccatgtccttgcatatgtgaggctggcgcatcctaaactcgatctgcggaagattttggatcagggggcggctagcaacgcgcgcaaggatgtgatggaagaagtcgacgatctgggggagtctgtcctcccgctttttgaagagtaggattttggctttcttgtactctttagtcatgttttgtaaaactctctgaaagggtcaattaggcctagagagggggtgaataggataatttaaaactttatgcagaagctaaaactgagttaggatcggaaagtctgatccacagtcagactatccgaaaatatcagatagtctgatgttggatcagagtgtctgatccactaaaagaacactacaagaagatctagtgcacaaacaagagtatggcgcaaacagcgactagatctatagcggcacaaaagcaaagctaaataatgggagaagagatatcaccaacaatgaagttcaccaggttgttcccggagttcaaatccttgaggggattctactctccgttgaggagctcactaagagccgggtctttgctaaccctttcctcaagaggttgcactaagcacttctccttccactaaggggtatctctttccttgtggaggcgagatccggccttcacaaacttctcccggccaaccacacgtagatcggtggctcgggagtgacacctagccgtctaggagtcctcaacctccaagagtaacaaacaccacacaactcttggtcaaccctagtgctcaagatcaagtgaaacacacactaggcccacaaaccccaaatccacaaccaccaagatccaccacacaaagaacaaggagagatttgagagagggagaaagagctcaaagatccaaagcaccttagcaccaagcacaacccaaagtgaatgagaatgaaatgagttgggtaaccctagaaaagggttaggtggggggtatttatagaagcccccaaaatgtggccgttgggagagaatcttttcatcccacctcggaaagtccgaggtgacatcggatagtccgatgtttttgacccccaagcaggccagagacagagaacgaaattctggagaatttcggacaatccgatcgatcggatagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaacagagagtgaagttctgagaaatttcagatagtccgacgtatcggatagtccgaccttatatcggatagtccgatattttttagccaacactcagacccaagatagtgagcaaagttctgtgaaatttcagatagtctgagcatcggatagtctgatcaacatcggatagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcactctatgcgaggtgtggttcaactcgtatttgaagagttgctgcacctctatgtgaagagtctgtagagagctctgagtaccccgtggggatcccgaggaatcggcggctggatacatctcatggatgaatggggcctgcgcctagctcgaaggcatcagccagcgtatcgacgaagccctgaagcagtagtgtcgtcgatcgagccgatatgctggggggcatatattggcttgcatacgagatcatcgtccgcagctgcacctcgagttcctccacgaagggttttctcgttctcggagaactcctacggagatagatggcctggcgaagtcgatggtgccgctggcggagaaggtcttccagtccatggactggcgttggccttcctggtagtctccgtgtcctgtgacaaatgtcttagggaaaaagtgtaatataattttggatttttatggaattgtaagaagtacttgtgaaatagaaaagagatctatctaactaagctttcttactctggttgtagcgtgtatgagtgtcttctcacttcgcgacttcgatcaatcgtttgagttatacactctccctagcccccagccttgtcatcggagaattcttcttggaagataaggctcttggacctttgacctgcctcggttgaacaagcactgatcctagcccccagccgtgaagttggaaagttaatttccgatttacacagcttggttaatacgcacggcgagaactcttacacgaccagatcttacatggtctttcgtctctacaggatccgacaaggccttatctgctctgggcgtccccagccgaagttcccttaggttcctcagaggccttgtcaagacggcgtaaagggacatgaggataggtttcaacgctaggtgtcatctgggtaagggatcatcgggaatgaacactttgattgtagtatgtacctgaaaataggctttactgaagctgtaagatgtcttacaagtatggatactattgacttatacatagaatttacgtaattgatcaatgttccaggaattagccaactcacgaccatcgccgtttgcaattttgaatgcgcctggccgcagaacttgtgtgatcgtgtacggtccttcctatttgggtgagagcttgttccgccctgcttgactttgaacccgtcggaggacgtagtcgccgatcgaaagtgtgcgtgctcagatgcgtttctcgtggtagcggcgaagggcctgttggtagctggctgctcgaacggcgactcgttcgcgatgttcctcgagtagattcacatcgtcgtttcgctgctcctcctgattctcattggagtacttctgtgctcgtgcgctttgatatcgtagctcggtggggagcatggcctctgagccgtacacgttgttggtgtggtacgcacggcccatagtactgatggaagttcttcgacccacttcttgtcatgtgacatgagcctgtcgtagacgcgggtcttgattccctgtagtactatgttgtttgccctcttgacttgtccgttgctctgagggtgagaaaccgaggcgaagcagatcttgactcccagcctgatgcagtaatcctggaaatcggcattgatgaactgggagccgttgtccgttataatatggtggggcaatccgaatctgcagaatatccctttgatgaatttgattgcgttgtcggccttgatttcccctgtaggtgtcgcttcaatccacttagtgaatttgtcaatcgccacgaataggaacctgtagccgctctgtcgaatcatgtcgacttcacaccgctgaaccatgtcgcaggcgtctttgagggcggttggctagaagaacccctgtcgaaaagcttttccaactaatgtccgaccggcggtatgtgacctacagatcccttcgtgtatgtcgaggaggagatgtctgccgttgtccgacgagacacattttaggagtaccccgtttggtgcgttcttgtacagatcgttacctattatacagtagacttttgctttacgggatattttctcggcttctgcatcgtcctcgggcaactcttcgctgtgtatgaatttgatgagtggggtgcgccagtcgtctgtggtctcgatatcggcaacggcgcgctctatctatgtagcccccgagctgttgttgagggagatcgggctatcttcgtcgcttgcgtctttcactaatggccttgtcaggacgtccagaaaggtgccaggttcgagtggctctcgtctggatgcacgccgtgctagatcatctggttcgatgttgtccttgcggtatacatgtcggacctcgatcccatcgaaccttttttccagcttcttgacttctgcgagatacttggataactcggggctagagcacttgtaatctttatgcaccttgttcacgactagttcagaatcccctttcatgatcagttgcctgactccgagtgcagctgcagctcttatcccggcgagtagtccttcgtactcggctgtgttattagtcgccctgaagttgaggtgaattgcatgcttgaattgatctcccaaaggtgatgtcaagatgaatgctgcccctactccttggctgttgtgtgcaccgtcgaacgccattgtccacgtttcgttgtcgatttggttgtctgacttattatcaggcatagtccaatcggctacgaagtcggcaagtacctgggacttgatggctgttcgtggcacaaagcggacatcaaattggcttagctcgactacccatttcgcaatgcggccgacaacgtctttgtttctcactacttcaccgagagggaaggaggatagaactatgaccctatgggcttaaaagtagtggcgtagctttcttgatgtcattattaccgcgtagagcagtttttggatctgtgaatatcttgtctttgcgtcgtggagagcttcgctgacatagtagactggtcgttgcaccttctctctcttgacaacaatgacagtgctaacggaatatggcgtggtggcaatatatagaaataattcttcattaggttagggggcaacaagtacaggtggatttgataggtagcgcttgagtgcaatgaatgcctcttcggcttcctgtgtccatacaaatttgtcttgcttcttcagcagggcaaagaaaggtggtcctcgctctctcatcctagcgacgaacctgcttagtgccaccatgcatccggttagcttctgtacttccttgagtcttgtaggcgacttcatgttctcgattgccttgatcttctcgagatttgcttctatttctctgccagagacgaggaaactgagcagcttgcccgatggtactccgaacgtgcacttctctggattgagcatgaggcggtatcgtcggaggttgtcgaacatttcccgcagattgtcaatcaatgagtcggttgtcttggtcttgacaacaatgtcgtcgacgtaggcctcgacattgtttccgagttggtcactgagtacgccctggaccgtgcgctggaaagtgtttcctgcggttattagtccgaacggcatcttaacgtagcagaataccccgaacggcgtgatgaatgctgtcttctcctcgtcctctttcgccatgctgatttggtggtagccggagtacgcgtcaagaaagctcaacaactcacaaccggctgttgagtccatcggttggtctattcgaggaagagggaagtgatccttgggacacgccttgttgaggtcggtgaaatcgacacacattctccatttcccgttggccttccgcaccatgactgggttggctagccactctagatggagtacctctctgatgaaaccagctttgagaagcttgtcgagctcttcttgtatggcttgttttcgatctggtgcaaatctccgcagtttttgctttactggcttggcatcaagtcgcaccatgagtttgtgctcaatcacctccctgggtacccccggcatgtcggatggctgccaagcgaacacgtcagcattgtcgcggaggaaggtgatgagcgcgagttcctatttctcacctagtgatgccccgatcttgacggtcttgtcggggttggcactggagagtggaacaatcttgattgcgccgtccgatttcggcgtcttgtttgttttgctcactttcttgggtggctcagctgtggcgggtgggctgggcgtgtgctcgaccatgtcgaggctccgcttgtcgcattgcactgccagcttagcattcccttgaatagtgattgttcccttcagtcccggcatcttaagcacttgatatgcgtagtgagatgcggccatgaacttcgggagtgcagttctcccaatgatagcattgtatgttgtatcgaattcagcgacatcaatggtgatctgctctgttcggaagttatttgcttggccgaaagtcacaggcaacataattttgcccaatggtttggacgatgactgaggagtgattccatgaaagggttgatcggtgggtgtcaactcgcttcttgggatccccaccgcgtccaaggtgctggcgaagagaaggttgattgagctgccgccgtcgatcagaacttgcgcaaccttgatattccgaatagtgggttcgaccacgatcggatatcgccctgggatgacagcagtcttggggtggtcctcttctgagaattctatcttctgctcagaccacttcattttgggcacagctccttgccacgtcgaacaaacttcccgttccactttcttgtattctcgctttgaggagtatgccgtggaacctccaaagatgtacgagacatggagatcagagtctgggtatgctgagtccgattcctgagcagttgcctcagcgtccttctcgaccacgcgtactcgcttgcctttttccaatgccatgtgttttgcgagcgactttttgaagacgaggcaatcttctagagagtgtatgtccgacttgtgtatagggcaccatgttttctttgtgtcgctgccttatgggtctgggcgcttgggagggtccgcgtattctgttgcgagaacttccgcttgagctttccttttcccactcttgcgatttttcttcttgcttgactcaggtgcgtccttggctggtttcttatctcctccggtcttcggtttgtcgttcttgtgcctcagtgcgtcgtccgcatgagcacattgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgggtgtattattgattgtatgattcaggagaaatcagcatatgcccctagaggcgcccggaccccccttatatatggaaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacctagttcgaataccatcgccgtgtagatatgggatacccatgatctccacagtagcccccgagtcctttgcagtcgaccatcgtagccttctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaaatccgatatccaagcgacgcttcgtcttccccgccggaactctcgccattttccccactccctgctacagtgtaaagctgcgccggcgaactagggttctcaactccggccaaatccacctccgaaaagtgcatcaaaatccttcccgtgatccaccgcctcaatccctcacctctcccaagccatccctcaaatcaaatcaacacatttgagtgaaaccaatggcggaagagagagaaagcttcgaaggtcaatgggcgccatccgacgtaacggaagagaacttgaaggagatggtggcgcacggcgttctcccagccaaggagatcatcgggtggcggccagcgagcggtgagacttttccgacccctgatacacatgagatcgtagtcttctcgcatttcttctatggcggcttcgctcttccgacctcgaaatttttccgcgggatcctgaatttctacggaatcagcttacatcacctaaacccgaattccatagtgcatatcgccaacttcgtccatgtttgtgaagcctttttggggatcaaacctcactttgccctattccgccggatcttcttcctcaaaccccaaccaaacaagaacaaaccgtgtgtagtcgggggggcaggattccaactaaggggaactctgagtcaaaaatatttctcgatgcccttcaagacttcgaacaaaggatggcatgcaaactggttctatgttcagaatcccgagcctgctcttcccgggtactcttgtcttcctccagtgtaccaagatacttggaattctcttccgatcggagatgaagcagtacaagccttggagttgttggatcgtatgttaaatcttaaagaacaaggcttacagggagagcagatcactcggcacttcattaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcaactgccagtcgtgccatataatgcattcaatccgcctccacaggtatgcatcggaaatcctcaaaccgtgatcagaacatagttttatcttcacgctgagttgactaactatggaagcatcttgtccaggaatatgcattgatgaagtcagatccaccagtctctcagcgccggtctcctcgccaacacaccgctcagggaggcggagggccaacgatcagaccagatccgcaacctcagacctccaaattggctgatcaaacaggtcctcgtaaaagaaagctggtacttgatgatgatgaaggcgacgatgataaatctggggataagggctcgcctaataaacccccaaagcgtaccatgcccaggaaaaaactggctggccgtgcgataccaaagatcagaacatcctccaggtattagacctctcgatatgattccgcttcggcatgtttttctcatgaaaatgatactgaatactgaaagaacactctgcaggaaaccatctgatatagatccatctggaaaagaccctgatccggctatgacagagcaaaatatatccaaggaccccgagccgactaatgaaaaccagccgactgctgaaagccagccgactggcgcccatgcttcaggagatagggccaatccgagtgacctgccgccgactggaaaccagtcggcaacgactgaaacggcaacaactcaagagcccccgactggaaaccagtcggacgcaggccctgatccagagattcccgaagtagaagcgcagacgacgacttcgcaaggaccagaggttggtaacgactcgatagctgggtcttcaggtaaagaacaaagatctcctcacgctcagctaggtacatcttcaggttagttgtcttctcaaacaatggcgatttaaataacctcagtttatccgtctaatatcttggaaacacaccaggaccatcagatgatgacggggaagaaattcctcgcataaaggcgaccgacgactctcgtcctcctatcttgatcaaatggtgggatgagaactcacaagccgccggtatagtcataaaccgtcaaaaagaagatgaagaagtgtgccagctaaagaaagcgcttggagaagccactcgtattgtaaatgtaagtcttccgggtgacagccttcgataactttgttctctttttagcagaaactaaaccatgatccatcatgcagagaatccatcttcgcaatgaggccaagactacaactttggaaaagctggttcctcatttgggaactctagaagcagtcagggaccagctgcatgaggccaaggagtgcgccaaaaagacagaaaaagagttaagggaccgaatcgcccagctccaggatgcaaacttcgaactaagtggttcttcaaaaggtaatcatcccgatctgttccattgatttatgctgtcataattgcatcctcaaccatctggatttcaaacagcgcaagccgccaggatggaacagatggcgaggcaaattgaagccctggagagagacaagacagaactggctgcgcaaagggactcagccttgaaggaagtcgaaggtagcgccagctaacagtctgagcttctctccttataatgcaacagatgctcatcatgaatgtgttttgtagatcgcaagatcaaatctcaagctcagtttgacgtcctggttggtaagatcaagaggcttgaaggagcaagggatgacgtcgccaacgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggccgacaaaattgcgagcgatgttgtagagcaatttcgcaacaacgacctccagccgagtaatgaagactctgatgatgaaagaactgattctgactgatcatgaatgtaatgtatggaggctcaatttgtacaatactggtgtatttatgctgtgcttgatgattcttgcaaagtttttgatttcttaaaagtttttgctaagctttgttgagcctaaaacccaaagaagctattaaaaaccttcagtcctcgcaaactaagtagaaaaaccaaacaaggcaatgataaaccaagtaagcaaactgaattgataaaaaatcacactccattattatgatgatagcccccgactgacaacttcaaggagaaaacttgacgtttgacagtcaaaatagggaaatacaatgataaggttaagcgtagatggatccggggatgaatccgccgagtgtattattgattgtatgattcaggagaaatcagcatatgcccctagaggcgcccggaccccccttatatatggaaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacctagttcgaataccatcgccgtgtagatatgggatacccatgatctccacacacatcgatcgacaatttcgaataatctccgagtagtcgtgatacgcctcgttgccaactcctgggtagtatagcaatctctcacaccggacttgaaggcgcggattacagaagcgtcggtgatttcggggattgtatttctgcactcattaaagcgccgaacataatccctcaaggattcattcgggttctgtgtcaacgcatgtaagttgtcttcgatcgcgtggcgcttgtaagttccttggaagttggcgacgaacttctaccacaggtctgcccacgaagaaatcgagtagggagagatgcatcagccatgaacgcgtggagcctttcaatgcggttggcaagtaattcgccaacacgttgtcgtcctctccggcagcgtagagtaccgtggagtaaacctgaaggaattcttgtgggtcagtactcccatcgtacttctctattgctcctggtcagaatctctcaggccatcggacatcacgtagcgaacggctgaaagctctacacccagcgctgggggtggtgggttgtcggtgatcgtacgtccttcgtggatgtctatctgatgatgaggatgaggaagatgacgacgatgatgatgggtcacttgattccggtgtacgattacgaggacatcggccgggttatcgagaatcctgttgtcgtctcccgttgttgtctcagcgccgatctccatcgtcgtcgtcattatggcgacgtcctcgaccagtatcgcccagcacccgcggttcgcgatcgtcgtgatcgtggcggttgtggcggttatcacgatctcggtcttcgctcgaacggcctcctcgttcttcgttatcgtgacgccgtgaagagacgcgatgtcgggaacggttcttgttgtctcatgcgcgtcgcgcctctcggcggccatttaggtgatcgcggagatcgccggtgccacgaggtggaggggtggctcgatgaggcgattcccgctgttcagggttttcaccattagcaccgccagttggtggctgttctaggtgcgctgcagcagcagcctcttcgaacgcgttgctgaggttggtcactgattcccgtaaccgttctgtccatcgtgcgagatcgtcgttcagaacgggatcgtaaggggtttccctcagtattgcgttgacggccctgatgtgctgggctggtgtagtcacttgattctccgcttccgcattagtgcgcgctgatgtgccggtctcatcgatagccaatacctcgcgcggcgtacttgttgatgatgagccatagtcttcgagcaggtgcaagactgatggttcgtggggatcgatgtcgattaccccaaggaatcgatctgaaatcaacgtcgctccttgttccttgtcctcatccttgagggggatctgtgactgctggaccttaggaggtgacgtcttcatggcgctgagaaagaccttgcaggttgagaggtcgtgattctttatcttgtgaataggacaatagacatcacgggttgaagaagtacgctgaattccacgctctttgtaggcacgaatttcagtgtggacgttgagaaaaacccagcaggcttgcaaggtgtgttttctggttttgtggataggacaccaggaccttgacctcggaagtcatcctcgtcggctcgtgattcttgtcggaaagacaaggtttggccgcactaggatccttctcgggctcggatgtcgtcgacgttccgttctccgcttcagcgggaggatccttcgacatggagtcatcctgggttgtagctattgtgttctcgcttccgatcattgatggaccagccgagatcggcaccgtggtgtaaaccgggaagacgatttcgttgacttgaatccacaccagcattgttgaagtaggaactccttggttgaggttggtgttgacgctgttgtcgacgaagctggttgtcatagtagtagaatcttgaacaccaagtccccctacctggcacgccactgtcgacgggggatacccgtagactggatatagagggtattggggtacgctagtacgaagatctacgtaatacgacatcaagcagacagaaaacaaagattatactggtttaggccccttaataggtaatagccctaatccagttgatatgggattatatgatgtaaaccacatattacgaagggaaaagcggaactcgatgataccgacgagatcgtagtcgagttgattcgactagatcacccggcgacttggctcctgtaggctccggcttcgtaggctgtggtggttgtcttggctatgagattcaatgccttaggtcctcccggggggtcccttttatatcgcaagtcgactggtctccaagtaggactcggagacatcggacccggcacggtacaatgatgacccagttctgtctaagtatgactccttccatccgtgaactccatgatgaattcctttaacgtatgccaaaaacgtccgtatacgcgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctattcctccactccatcagcctcattgtagaactcttcctctgatgaatgattgcaaggtgagtatatgacatactcagcaagccacgcagcaaatatgcaagtgcacaagataacaaaggatggcataatagggtttcatttgcaaaagcagcatttagcaaacatttgagaatttaataaaacagttaagtaattaaacaatattaatccaacgctatacaacataccctgttgtataggcccaaccattctgaacaaccaccccgtctgcacagttctatctccaaaccaggaatattccattccaaaccaggagctaatcaaattattaccaatttaatcatcatttactatggtgagaagtgtgaaactaatcacgaaagacattgttagacccgcccataaccgctggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaaacagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaaagtgtaaatctcaatcttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagagggtttattgcgtcagcgggctagggtttggtgaaccgggcgcacgggcggcggttcacacgaacggacggccgagatcgaaccaatccaaaacggacggccgagatcgatcgggtccacggcggctcacggcggacgaccccgatgacgtcagcggtgacgtcaccgacagcggcggctcggcggaggagacggctcgaacggcgcacgctcgccggcgaacggcggcgcgaggacgcaaacggagggcaccaagacgaagcgggcggcacggcgaactcaccggcgaccaaaacgacggcggaaggtcaacggacggcgacggcgacgaggaggaagcggcgaagctcttcggcttgacgacggcgacgaagctccgacgatctccggcgacggcgaaggggcagacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcgacgggtagaggagacaccggggatccttttaaaggggctaggaggcgacgacgaaggcccatggcggcggcaacggcgaaggaaagctcggcttggagagagggaaaccgatccgaaacgaactcgattccacgaacttccaaaacgatttagccaaagattccaaaggagaaaaggtagaggagatcccggagattgtttcccctctatcaattcggccggagaaggaaaggagcggccggattggaaagcggcggcggcgacgcgaaactagggtttcggccggaggaggacgacgaacccgacaggtgggccccacctgtcagcgggcggacgcgcgcgcgcgcggtggcggactgggccggctgggccgaagagagagaagagaggttttgggccgacgccaaaagaagacttttaaaacctttttcaatttaaattatttcttaaatgcaattccatttattaaaatacttccttagctcaaataaatcccagaaaaatctaggaattatagaattaagcaaagtatttaatgaaattttatctggccactttttatattggcatttattaattaaaactagatcttctcttcaagacttttaaaattatttctaaaaattccaattaaacaacaatttatatattttgaattttcagggtgtgacagcgcgcaagtataccatatcgatatgtgacgtatgtcgaagggtaaagggtataccttacccgtaaccttgacaccagctctgagtaaggtcagaatcatgacaaaattttgaggacagaggctgtgtttagttccttccaaagttggaagtttgggttaaaattggtacgatgtgactgaaaagttgtgtgtgtatgacaggttgatgtgatagaaaaagttggaagtttggatctaaacacagccagaggtgagcgtggtgcgaggagtgagaatttgaagattttttttatattccttattgttggtcataaagtaaaagatagccttaagcttaataaggtcgattcaaacgtacatgtctcacggtgtataatggggctacaaagtgatatttaataaatggtctaaaaaatcaatacttaatctaaaactggacacactttttattttaaaaaaggacttgtcacattggactaaaaaaccggttaaaatatcgcaaaacaatataagttggttttgataaattttcacatttaacaaataatatgttaagttactttttacatacgttctctatcctaaaacaaactaagattatggaatgtgaataaaccaatttagtatgggatataatattttgaaacgtaaaggtatatcgttgagacgaatgcgaagtcacattagcataggcttgagagcacaagatctaggtagagggctatgaaagaattgtacaggatatagccatataggtagtggtgacaatagtggatgggagactttgactggagtgaggaattgttacagaatataatctcttctcacctttgaaccttttgtcagttcctcgacggttagttgatctaagtgaaagtttaagaaaagtataggtgaaagaaattcaataaagagaggaaaaatggggatagacagagaaagtgtcaaatgtactagataccgcactcaaatatgtggcaaacttaccattacaatcaactactcctatatgacaaacacattgtattatataatagcaactttactataccaaattttgtagtttcccaaactttgtactaccaattttttttagaaacaaaacacaaacgctctagactggaagactagaccgacatactgagattaatgaattcaccatgaacaccttactgttgacgggtacatcgtttatcaataaaaaataattagccataaataaaagtaccagtgtgaaatctagaacttgaactcggttggattggttacaccataagaaaactaattagttaaactacactcacttcgcttcgcttgtactactaaaatttgatagagcatgaaaccaaatggctaaattccacatcatccatccgctgatttcacattttaagtttgtaatgatttgtcacgttttctatgtcacgatcagctcagctggataagcctgattaaacgcaaataatgggacttccactaacgtcaccaaacagatcaattcataatatatgagagggccttccctaggcccaagatctggaacacaaattatactacaatctctccgtgaatgaatgaaataatgatacgagtgtctcctagtgcctctccaacccaactagccaagtgacccagcagcgtcgcgcagatgttctgagctcaccgatgtacgatcggatcgagccagcagcagtgccggatcaatggccaggggaaaaaagatcagctgattattggttcgtacatattcacacttattcagtctttactgatggatttgattcaactaaatttatggtataaatctgatatttatttttaattctagccactgcattctttcttcctatattttctttttatttttgcatcagaggacagcaacaatcaaacattattgatcctgtatgtactcggcattaacttggactatactgaattatcacaaaaaaggaagatctgatcatggccaactatagcaaagtgcctaagatcagatcctgatcgatgggagaccaacacaaaagtatacaacaatagaacacacaactgaatctacagggtcaactaagtaattcaccggacacaaatcatcacatattgacacacaagaacatctcactaggagcagagatcaaacttggagaggcacagaaacaaagcttctcacttcctcagaagcccttcccatggtgaagatacctggccttgttaccagccagcaatggcctggagagcaccgggagcccccactgcgacgcgaagatgatggtcgggcagatgtcggtggcgccctccatcgtcgtcgccccggcacggcggatcttggaggagagctccgccaccaccttccttggcaggaggaccgaggtgatcctgctccatttcagctttttgacatggaaga

SEQ ID NO: 79686 - DNA, 20509 bp, Oryza sativa
cgtagacgcccaacagcggtggtgtgactaaaccagccgtgtaggcgaaggcaccactcgccggcgacggaggcaggccggcggcgaagtcgtagacgcccaacagcggcggcataatagaccagccgtgtaggcggaggacaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtggtagacgcccaacagcggcggcataataggccagccgtgtaggcgaggacaccagtcggcggcaacggaggcaggccggcggtgaagtcgtagacgcccaacagcggcggcataataggccagccgtgtaggcggaggcaccaatcggcggcgacggaggcaggccggcggtgaagacgtagacgcccaacaacggtggtgtgaccaaccaaccatataggcgaagacaccagtcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcggcggcataataggccagccatgtagacggaggcaccaatcggcggcgacggaggcaggccggcggtgaagacgtagacgcccaacaacggtggtgtgaccaaccaaccatacaggcgaagacaccagtcggcggcgacggaggcaggccggcggtgaagtcgtagacgcccaacagcggcggcataataggccagccgtgtagacggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacgggaaggaagtgaaaactcccaaagcgaaaacgaagtcggcgactcatgaaattgattccatcgcgctcgttgataggaaactcgacgcaacccctacctggcgcgccaactatcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttgtgtcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatgactagtcggataaccatgccgtatgggtatggggtacccataatatccacactgatattgtcgaggctcgcaattcatgttgattcggaattccattggtcgtcttgatcgtgaaagtatgaatatatatgttccatttttttaaaatgtctgccattgcggagactatccattgattctaaattcaattggccggattgattgttaaaataattttcccactcttcctgtctagtatgatctatcatctttcttcagaaaaaaaaggatcaattcttcataaagtttttatttacatcgaataggaattagtgctactttgatcatgtgtcaatcacatgacatgactttgtttcatttaagttatctgtggattttatagatatatagtaattcctctaaactaacaagaatacggtcaagcatgcatgttaatagccattttgaaacttttctctgtttgtcacatatatatggttcaaacttatttaattatgtaattttgcatttgtatattcatgaaatgaaagttacctactggactactagttcagatatggctttcattgttgttgtgtgataagcatggtttgcaatttcattaattctttttttaaaaaaaaatgaagaaattttgattaaattcacaaaaaaaggaaatttttgaaaatttcagccaaaattgtgtcgtgccactggaggggaggcattctgttgacggtccttaagtaccaaatccgaccgtcaattcatgcataaaaacaaatgaaagaatataaagtggaataccaaacttagaggtagtggttattactaactattttcacaaatcttggtgaatatttgtatgcaggtgaattatggacgaaaaccatccgccatacgacgaaatacacctccggatagtcggacacgaatacacaaattagaggacccacatgtcaatcaaaaccaccaacaattgaacccaaccaagatacaatatgcaaagggcccaccaggcagccccccagtagaagggaggtcaagaggtgggccaaaggagtcggttgaaccactaggtcggccgaactgcctttccttcctctcgccatctgctgatatgtggagcaagatcctaaagtcccaatggaagttatgtgtggttcccaaatgttggttttctgtctgggatgttctacagatgttggcctatcttcaagagagtcctggaggagcgccggagttgttggccctctctcctcgtttgtacctcggctgatgcttcttcaatataagtaagtatttgagattcccttctggtatttaattaacttacttaagtgagatgtattgtcatcgttgtgggttcgtcgcttaatatttatattgagtgctctaatactaagactctggataaagaagaaatttttttggccgaggctagagtagtaatcgataacgtagacgtggtgtttaggttagaggttgccttcgtttgttgtgtgctccatagaaagtgaggtaggcgacaggtggtgacagttcagtccgtccttcgtatccctccacgtatgggtacatcatagagctacaggtcgaactcagctggatagacatagctgggagagctggtatccgaagcaatcgatagagttttacctttaacttaagtatactccctccgccccaaaatttaagcatttttggattctgaaacggtctccgagatgctactttgaccaacaatatctataaaagtaagatattttaaataaaaagagttatatattatgatagtttttttaatgataaatctagtaacatcaattttgcacgattgatcttttttattttcttgttattactccctccattccataatacaaggcataactactttttaaagttgtttcataatataaggcgtgcatgcatgcatgtcattaactagcacatattttccattcaaatattattatttaaattctccaccatcaagatctctaattttattgggtgcatgtattatatttattagggtaatccaaactatgaggtgataataattatttcttggtctttgggttaagagtggttgtgccttatattttgaaatggaggaagtaatagtcaaagttgaaaatatttgacttctcactattctaaaaatgcttatattttgggacggagagagtagttaattaactcataggaatcctctagcctaagcctaccatttattgttgtccttagttgaatcctttttctagatgtacatacatatttcttgtgatttgatatccttaaaatactccaaagtgaagttctataatagtatccgtgcaattgcggacttatctgtgaccataacaaataccagcacgctccgacattgctagtgagtaatcccactacccacacaaaaccccgctgctagtttcatttcctatatggtagtataaattttcgaagagaaaatgaactagaagtgagataagcgggtaaaaaaatcatgcttgcccatcctacttgcatccctaaccccaagatactcgagctccatagattaatcactctcagcaaattgatcatgagttgataattagcagggttacaataatatgatataaatcttgcttagcacaacctttagtgaagcagatattgtatttaagttcaaatcatgtagattttagctctaggctagctgctctgtgcaattgcacaattgatgtgtgcatataccttcaataattccatatcttagtgctactttatcaaattgtgttgaattggtgtccattaatttctgatcaaacaaattggtatccacttaaaagaataaaggcacactatttctccaaataaaatggaaacaaatttattaaaagaagactggccggctggggtctaaagaggttaggcaacaccttcaaagtgaagaaattactaccatgtttcacataagtggctagtccttttcacataccattttactttgcaaagtagtgtaaaaagttcacttttcaatgtaaggtaaaacagagtagctttcactagcttaaaaagattaattttgtccttgctttcggttaagttccaatgattagcgtggaaaacacacgagttagagacatgcacaatttatataatatatatggtggtatagcttttttttagtgctctattgcttaaaaaaaatcaaagtataaatatgttttatgatcttacaatagtgaactgattttgaaaaatatgcacggatcttataaagtgatcaagattatagtggcgtgtttaggtgaaaagggagtcttacttgtgtggttctcccggattcttcacacagatttcttcgactgataaaatcataacccatgccaaaaccatgcatatatttatgtgaattataatataatagtactttttaatacatgtaatgagtggactgcaagcaggatagcatgcaaatttatcacaaccagacaagatggaagaactgactgtatatttgtcttccataaacattgtcatttgccaatcaatcatcacctcctctggctgtatactccatgtgttgccaaacacagatttcttgcagaatctctgagtgttttcagggccagatgtaaggagcagagaggaactacaattcagagccaaatcacacaatattttgagacctgaaaactggggccttggctacccaatgagggagcaaaacgacagctcagcaatcaccatgaagcagttggcagcctctgattgggctgctccttgcttacctgtcccttagtagaaccccactatacctgtttctgtttgttcttcctgttgacagcttacttacaactgaagcacaaaggcaccaccatcattcacacccagcacacagcaaatgcatgaccccatgttttcagttgtgcagaattcatgcccaggttgtagtggcctttcagaaactgaaaccagttgagagtgggagccaatgcaatcatgaggatcgcgccaattttgcgcaatattcgcagtatttacctagtaaaattctctgaaaattaatcttgatatagtgttccgttcaaagaggtggatcaaatcctgaacaattttgttcggttcaataactcacgctgtttgcgcaaatattattcggcttatattttcttaactagtatcacaatatatcactattaaatttatattgcagattcagaaaggaaagaataatcaaattatgaaccaaaaaggtagcccagcacaaggaacacaagtacatcttcctttcctccctggtgtccctcctgcagtttccttttgcttagcacaggggggataaaacttttactgctgacaatggccggccacagcaaaagcctcttcatctgtggggttggctgatagctatcctgccctactacatacctttccatgtctaatatctgaagtcggttgagaggtgaattcagcagaaaggggttgttgcagggggcaaggtatctcaggggaaacttcttgcagcaaactgcacacggtttggcttagctgtgctgccacattttctcactggctgcaagcagcttagctagcttgtactcactactcccctatctatatatacaggcaccaactcttgtaaggttcagagttcaggtccattccaaagttgcaatcaatctgtctcgattattgcctctctgctctgagtgtgactgtcaatctgtgagcttagctagtgactggccattgcacgagaaaagaacaggttgatcgatcattagtaggtgaagtgttcttgccctgttcttttcttggtttcttgggtaaaccaactggttgggttcggtgagtttgagaacttcagaaactgtaacaacaatgggaggcaccatggattacctgtctgatcttctcggcggcggcgggagcagcagccgtcggaggtacaagaagaggaagcagttccagacggtggagctcaaggtgaggatggactgcgacggctgcgagctcaaagtcaggaacgccctctccagcatgaaaggtataaacacaaccaagatctctctcaactctcactagaaagatcaatttctacagttcttggaatcatttcattcatggctgaactgaaatgatgccattctgtgaacaattctggttaatacgcacaaacatacgaccaaaaatatctctgaaatcatgccagaaaaatcaaatttctactgcatgaaaggtataaacacaatcaaacacaccaccaaaatctccctgaattcatgccacaaacatcaatttctacagttcttggaaccattcatcatgcatggccgaactgaaatgatggcattacttaatctctgtgaaatgattttggttaatacacacaaacatacgaccaaaatctctctgaattcatgccagaaagttcagtttctacagttcttggaatcattcatgcatggctgcaatgatgtcgctacttaatatctgtgaagaatccttgttaatacaaacaaacatacgaccaaaatctctctgaattcatgccagaagcatcaaatttctgcagttcttggaacaattcatcgatcatgcatgactgacaactgaattcttgtttggatttggatggatgcaggggtgcagtcggtggagataaacaggaagcagtacaaggtgacggtgcaggggttcgtggagccgcacaaggtggtgaagcgggtgcaggcgacggggaagaaggcggagatctggccctacgtgccctacaccctcgtcgcccacccctacgccgccccggcctacgacaagagggctccccccggccacgtccgccgcgtcgacgccgtcatgcccgtcgccagctacggctccgccgccgctgccgccgcgccggaggagcgcctcaccaccatgttcagcgacgagaaccccaacgcctgctccatcatgtgaattactgtaactgaatattagtgtaatctcttcagagttcagatgaatgtacgaaatgtatgtgcagatatgagagattgtactccctccatcccaaaatataaaagaatctagaatctggatagttgtctagattcatagtattagaaaatatcacatctagtcatagattcttatattttaagatgagagtagaaaggagggatttttctgcggttttggtctcttgtcgcatgtgcattggaatcttagcccatatagctttatttatactactccgtatatatagtttaattaggttggtagattagattacaatatacatatatatatggagttgtgtgctgttatgagacatatggttgagttaataaaatacatgatatgcttgtacttggtggtgcagctggatttcttctgtccggccattgccttttggtaatagcaattagaataagcaagttaattaaaggtacgtttgattggttggcggctacagttatcattctaaaccttagacgtgtcacgctttgttaaccggttagctcttataattatgatgatgtgccagtacttcactagttcttatgtgtacactccatttctcgccaaatcttgtcacacttgtgaccaagatagaaattgatcatcgcacatagcaacattagtccccagatttctctaggacaagagcaaacttcccgttgatttactgccactcatcccaggccgcctgtgcaaggtgcattttcagcccatccatgataagataaagggttgtctctcgggattggagccatcactgtttgtatgcatgcggggttgggggggggggaattatgatgaacaaagttgtaagtgccatcccgacatacattatcacaataatgaaacaacaaaaacaatcccttcaagaaattgacaaaacgaggcgacgcttcctatgggttggaaatgagaacatgcatggaggcaaatgcaaggtcaattggcccaaggtttgctctcctgttcattatgacggccttggattttccaatttagaaaaaaattggtagagccctatggctgaggtggctctggtatgaatgaagggcaccaaacaaaccttcaatagaaaccgaaacatcttgcgatgaactggataatgacatgtttgcagcatcaaccaaagtccttattggtgatggacgaaaggcgagcttctgggaatcaaattggattgctggccaaatcctaaaaagccaagtgccaaatctttacaggcactccaagagaaagaaccgcacagttcaggaagccatgcggcaaggaagatggatcagcgacatccgccacagcctcacgatcgcccttctcactgaattcttccacatttgggggttctagcacaagtacccccacaactgacagacggagtgcaagactcgatcgtttggcgatggacaaccaatggggagtttagtgcaaaatcctcttatcaattccaattcaacagaatggtaatctcgccatcaacaaagttgacctaggaagcgtgggccttggtaaaatgcaacgtctctagttggcttgtgctgcaaaatcggatgtggacagtcgaccaattgcaagctagggggtggccaaataattacttcggccagctatgcttatgaaacctagaaaccgtcaaccacttattgtttgaatgccgatctttaagcaaatctggtttggcgtactcatgtggttaggccaaggacatatcatctcgaggtggaacaacagtactaacctattggattgatagacacaaggaataagcaacccggaagcagcaaatcacaaagagctcaaattagtcttcttgctcattgcttgggaaatctggggggaaggaatgtgagaatctttagagggaaagaggcgtcagtgtaacaaagaatcaatcgcaggggctagccgacgcaaaacacattgagagaatgttgccgtgaggtgtaaggagagttgacttgcaagtttgtttgaactcaagtatgtacaattttccttttcttttggcctttggctgtgtatacttaaactcccttctattaataaaacgtcagttgattggctgttaaaaaaacattagtccccatatcaaataagcccttaagggcatgctcaattaatgttgactacttataatataggtcccactgaagtcatgtacaagagaggatattaaagggtattaaggtagacctcatgaacccaagactagccgttgagagatggagagaaagtcgcactattatgggagaggaaggcgtgatagattttttttattccttgtgagtggcctttatacatatggctagctcaaccaaatgtctcctatcataatgtataaggtttatttaaaaagcttaagacccccttatgtctacattgtcgctgcactaataccaactagtggcaagcacatacacttttacctccttatttccaatcatctgaacactcgtcacaactatccccaatattgggatttgttcggttaatccatttcccttagggattgaggaaggagataggaggattaattgtaaatatcaatatatgtaattgaaccccaccaaattttatagacaagggatcggtctaattctcccctctcatttcttacacggggaataatccacttttacaaaattggcggcccaaaatgatggattgcgttgtagtcttaagcttacttgtgccctaaactaagcctcttattagctctatggctgataagttgtgaaaaaggaacaaagtaacaattaattatttatgagtgaaacttttattatatatgtttttaaattaagatttaaaagataatgatgaaaaatgaactacaatgaacaaaatcgttcaaatgaactctaaattaaaatttaaaattgaaagtttagttgcgactaacaaatcagcaaacaaacagatgattaattaagctttaaactactttctccattctaaaatatataaaataactactttttaaagttgtttcataatataatacgtgtatacattaatacaattaattagcaccttatcctccctaaattatgattttctatatcctgcactcccaagatctttaattttattgggtgcatgtattgagtgcatgtattgtattagtgttgatggaaaacacatggcctgaaagatttgctttacttcagtgcatgtctaattttttagtttaaaggcgtaaacaagacagataaatagcaaaaatcagtaaacggtagtctatcggccgatagggagtattaaaaagatccggtcaaataatcacagctctacaatgctttgaaaagcagaatttcctgtctctgcatgctttaatgcagttttaaagatggataattttaagctgaaactcttttccctcgctttctctaatttctgaaagaaaacaaaaagcttttcggacgaatgttggtgtcgacacgaatagaccgtgtttcacaaagcaaaagttatttttggcgaagcttccatggaataatcaaagcatgcatcacatgcttgcacattcgactagaagtgcagaattgatactccacaattgactgccggagatgaagtcgaatgagaagctgaaacaaatacttgcgccactaactaaacctgccacgttggtatggcctctgcgacgaaaactgaataattaattactacttaattataacagaggttttagctattggcaaaacctttattacgctttttactgtactattcatttgtttaagtttgtgtcagcaaggtgcttaaaccatgcattctactcactccgtttcacaacgtaagtcattctagtatttcccatattcatattgatattaatggatctagacatatatatatatctatctagattcattaacatcaatatgaacgtgggaaatgtaagaatgacttacattgtgaaacgtatatgtctagatccattaatatcaatatgaatgtaggaaatactagaatgacttacattgtgaaaccgaggaagtaatgaataaaatggcgggttaatgtgatacgcttcccaagtttataaacggcgcggttttcgtaaaacttttataaatatggttttctttaaaagcctattttcaactttatagtagttcatttatattctaattaaggagtgaacacaaaatcatttagctattctgccattcagctacactacaattatgacaaatcttattgtctttgtattggcttatgatctactagtacaaaacatacctcatctcagaaatagggatgaaaatagagctcatacagacagaaagtgctcatactatatttatttttttacctttagccggatataagacaaatacaaatagctcggatacataaacaaataacaattatttcgacaaatatagtcagacaggaatactgaaacaaatatttctcgcaataaaaaagacctaaacttctaatagagacaaatactatcacacacaattagctcgttttacacaaaaaagtttcattgtaaactaaaaacatatcaattaacttcaacatgtacatcattatactggtacaaaatgcatgtctagtcgatattataacatataacatacaatgtaatttataaaaatatttaaaagtttaaataatattaatagcgggaactatggttgtgatatggattactattaaaatctaaagaggtaggttgaaggtctagagttagaaagaaataggttgtgttttataccttcagctgatatccgaatagcattgttcataggatatttgtattattgttcgtatccgtcggaaactccaatataatattcgtattcatatccaggaaaaaaaatattcatatgcgtatccatatccgtattatccgagaactatctactccaaactatatacgtatttgtttttgtctagagtggatgaaaactatcagctctgtttttatccctactcagaaacttattaaaacaccacaagcaaaattatctaaaagtgaaaaatggacaccttattactactatatacgcaattctcaaataacagagatggttaataggtatgcatggaagtatataagtggagtgttaagcccatacttcaaacaccttaagacatttgaaatgggccggactgcatatctagatcattggacataagacttgtattgggaatttccttctattttgcatggtgattttttattggaattttcttggatggtctgctaatatttcttattcttttcctcttctacatacattcttttacaggatttcatctctacctcatgtctacttcctctgtctcaaaataactcaatctacaatgcaacaagtctttatccatatttattgtattatgatgagccatatccattcttggttgagttattttgaaagggatagagtatgaatggcaacatagctaccaattatttaagtagagattgtgtggttgctattggaacatgacaaattgataatcattgttggcaccgctatagaaaggcaagctcctaatctatctaaaaggtggaaagaatcgtggagccaccttcctaacttgcaagctcactcttttagagcaagattctcttctttaaaaaacagatttcatgttgcactctatgacactgacatgtgggactaaagaaaagtgccgtccacgtatcggttacacttaatacatactatataccgtagaggatgtgtattatatcccaccctttcaatttgaataattagactagcgcctataatactcactcttatctagaacaagtagtggtagaatgcttaagataaaaatctaaacagtaactcactagtaaatacggagtataaaagtatcaagacatggtatatgaaaaatgacgccaacagatattttttatgaaaatactttcatctagttatactttaattataaaacatcctcaaaagaaaccgatgtcatacactcataccttgttgtattagaacatcggctacatgcacgagagctagggaaaataacgagagaaccaaaggttgaccgcatagtgatagtgatgaagtgaaaagacatcgttgatcatgagtcagtgtcgataataccaaaagtaaaacccgtgaaaacaaaataaataaataaatatagtaatcactaaaaggtaatcgtttaccagttatgtcacttctttttctaccgtatttacactaaaatttctatacgaatattttattctaatcaatctatcaatcatcaatagttctaaagctggcactggaactgcaagcctatattggtccaagtgacagtgctatactttgtaagataaatctataaattataatccttccgtttcacaatgtaagtcattctagtatttcccatattcatattggtattaatgcatctagacatatatatctatctagattcattagcatcaatataaatatgagaaatgcttgaatgatttacattgtgaaacggaggaagtataagagataaaaattagagaaaagaaagcacctccagcttctcgattgggcagagtaatggacaccttgaaattagagaaatttgccctcttccaattgatgataattgtaatgattaaagaaaaaaaatttagagatgaaaaaaatattatatttaaaatttaaaatttatatgttgtaaattaactctaaatagaacacacgggttacgcaatgctcacaccaacagaaacaactttaaaaaataccgtgattgtgattacgtaccctttatttaattaattatgttcaaaacgacaacggttttatttagaaaaaagtcttgcatttcgactcaaaactaggtcacacattaggataataaatccaccaattatttagttggttagtcttctttattaaaaatgattttatctctctttgatgactaatattcaacatttgttattgtagtatcactttcttatattcattatttgatacgagaaaataaacttatttggccatctacaataccgaaatgtaaaaaattaattaaacaacataaacgggatataaaatataggcgtgccaattgacgcactgattttctaatgtttcaaataaatattgggtctatttggctgcaacaagccagctgttgcttagttcctgcaggtaaagaactagagtccggcttcgcggaacatgcctactaagattatgtactataaaacatctaagtataaacacctagatgatactcctacctaagcttgaatggtgaggtggaggagagaacagagaggatgagccacccctcatgcaagagagagggtgtgttcggactgttgatacagccaacagcagcccaacagctgtaatatgtagcttaatcgaacacagccatactcttttcacaaactttaaggaagaaatggaaaatagtgatgttgatcaaagttgtcagtatcctgatctatatcttagtattctgtgatactacaatcctatcaagctgaaacaatatcgatcctacgtagtatcctaattttcataatatctcaatcttattattcatttttatacgatcatacaaaattttaggtagcagcccgatactacgatccttgtgaacctaccaaatattatttaaaataagacagattgaaaataatactgaagtttacataaaaccaattaaatttatcagaattgatattatatgctttaatttatacaaaatattatatattttatataaaagttatgtatagtaataccgatactatgatactataaatcaaagaacaatcctacctactatcttgatacttattatcttgatgttgattggatgagagcgaataaaataaatacttatgtattggggttagtaaattagaggcaatgcgtagcataaattgctttccaattaattaattgataatgtgaataatattagatgtagcaatcacctctaccgtaaacttgcgctcttatgttgtgacttgcgagcttaactcatgctgagttcagcaggtggagttaggaactccatcttctcgcacaaaaacggtattacttattaataatacgtaattaattaagtattaactaaaaatacttaataaaagattaatacgattattttagcgatctttctataaaatatttttagaaaatataccgtttattaatttaaaaaatatacgtggttaaaaaaagagaggtgggtttgaaaagaaagagaagaacacagacttaacactaaccgaaaagcctcaccttacctgagcttaagcttaaataccactctttgtaataaacgacggtaaatcggatggaagtacccaagccacccccaattctcctcctcgtcgtcgttctccttcggcttcttaccacgcgcgacgcccgccgccaaccaggtgagctcaccactccccccggcggcggccggcggcggcattcattcttcctttctcccccccctcccatctccttctttccgcttcgcatccctcccgttcccagccgccgcggcttccgcccccttgggccttttgcggctccgcccgctgacaaaccctagatcgccgccccgccgccgtgctctcctcctcgtgcctcccctatggccgccgccggactccgccgcttcggtagtggtcgtcttctcatctgccgcccccccgaaccgaaccctagctctccgccgccctaccctaggtctccgcagcagcagctgctgctcctcctctaccagaaatccccgctatcggccgcccccatgccgcgcctccttccccctttgcctcgctcgccctgtgatttcgcctttcgaaatggagcctctgtgtgtgcggcaagctcacttttatctgttgatttttagttttggtcgcaggtggctgaggaagcagtcttcgggtggcctttgcgtggtttgcttcatcaatctctccatcctaaggtgagtgaaagactagtcccacctgattatttgtggcttttgatgatcaatctgggtagttgggaaatgtagctgctggaattgtagttactgagatggacatgagcagtttacttctgtgcggatttgcgtgtacttcaatttgctctgaaatgcttgaagaactatatgatttagcttattttagatctgtacctattattagatgctacactttacatggaaggaagactatctcgtgctatttttgtgcttgggatttatagttggctgtggtggagtacttgaatttttgaattatttgtgttcttatcatatacaaaatatatgactaaagtcaaagaaatgtacagatttaagacccaatttcctaacgataactgcatgtcacaactaaacctgtacatatttgtcaatatgctcacacacgccaattcaagggcccaatcccacacgtcacgtcgtaataaatgaattccatgcagtgatcccaccaaaatctttacccatagtccccaaactaaataacgtgttgccttacgttattatccatatcccgcaaacaaaatgacactttcctatattctgtcttcttccaacgcttaccagttacccctatacttggaagaaaggcatccctaaccgtaccaaagctctaacctctacttcatcactaaactccaaaactcaagattcagagcaagctaagcctcaagttcactccatattggcccatttttatgcaagaggcctatgcagctatcatgcacagccaaggatggtattgatgaattacgttcatggggtgccagcaaaaggaaacgaataaatggaagggcgcatttaataaacacatagcaaaaccagatttaccaaactagatcaaagtcaaatgaataaaaacaaattagggattccgtaccaataacagacatcagttttcggtatctcttcacactgatctcgcttaggagaggaggagagtagtttgagaaggcagattgttatggtataaggcaggcatgcactgctgtgaacattgatgattcaggcagcagtgttgaatttgagggaggggatatgatggaagagatataagaacatgttggggatcaccagatgaggttgattgaattcttgcttatttcctcctctgcattggaactggatcaatttacaagggaattttgtttatccttgatttcttaccatgtataggaaatgatttctctttatgaggcccctaacaatggaaaattaaaggattgtctaaatgctcccaacagatatgcttggatgcaactacacaacatagtcctttagcaatcatctacgctgctggccctgccatttatgcaccacctcatgggccatagcatgacattctgctactgactttttgtatagtcactgcatatgaagttttccttagtgcataaatttctatatattaatcaccacttaagaactgtggatcatgtaagctttattcaactacctccgtcccaaatataacaacttccggctatgaatctagacaagcacatgtccagattcatagctaaaaatgcttaaatttggggatggagggtaatacttaagcatggtacctggattttggattagtgggctcttacggtctaccatgatgatgtactgattactatgtctctgtttatccattaaagtttggttacttcatttcattttttttgtttcaaatacttgtatgtgctgataaggctttacttcaatttattatgtcattttttagcaacaaccagattttcatcttttgtctgtattagttcagtttaagtggtgactgttaattacagagcgagttgcttctcttggttatgtgtatttgaacgaaaaatttagctagtataatctttttctgagggagcagttttgggttgaaattggtcattgagaaaacattgcaactgtttgaaactttgaattcaattttactttctcctttctgatgacaccaaatgctgtagagctcttccgtactgaaggtgttgctagtgattcatatctctgacccatttggttcgaccaaacttccaaactgtcttttgcatggagtgaagacaggcattatgtaaatttgatgtgatgtttattagagagtatatgattcttataagaaattaatgtttgctcttaattttattttcaacttcccaagtgtacacatattattctgattctttactcacttgagtttttttttttcaaaccaggataggcaacagagtgctttgctaattgctatggaccggcaagtcaggggtgaccatgtaagatatattggaatgtgttcctatgttctttaaagaaagtcttgattgcattcattgttatgatggatttcaataatgtaggaagggatcaacgttgttgggtttgaagtgccaacatcaccagattcaagctacaacaaccctgttcctggaaatgaagatgaagctcgagagcccccattggttcctcctcatctgcagcatacattattgagcttcccaccaagccaagatgattcaagcagccttcctccacctcaaaacgtggtactcaaccacctctacatagagaaagagaactctagatccgtcgtcgccctggggattacccatcggttcagggcaaagtttgtgactgttgtgctgtacaagcccgtacaaaggcggtagggtgaaacattttgtgtacctgcattcctgcttccatttcctcgtgcagggactagacacccacgaggttgaactgccaaacaaatagaaaccctccttgttgtagtcctgaggaaacagaggaacaatctagctgcccatgaatctcaaatgattcaacccttgtacttaattggctgttggttgcggtgattggtggtggtccagttgaatgttggtttaatcttttcctgcgtcttgaacagttaaacccctattgtgatcttggcgtcattattcatgtgtgtgggggacaacagtgctggtgcttcttgctctcctctgatttcgtcttggcgtttggatctgcggcaactcaataaaagaccagatgccttttgtttcggcgattctgctagagatgtgataagaattggaggtgtccatcgcaaagccgaagtacatcattgcctgatttttattacagttggtacaaatcgtcagctcttgtcaattacagaacatacatatactcttggtaataacagaacatacatacatacatactcctacattacaaggggagactacagactcaaattgttttgtctagacaaaaacacgatccattggtacattgcagcagggttaacagcagtgtacatttacagacattttgggtcgtggcaacagcaggcagcagcagatgacagttcagttagcctctctgaaacggctgctccagctctctcagctttgggcaatgcctgatatcaacactctccaccctagcaatggattcttctcctccgatggagctcagctcctggcagcagaagatcttcagcctctggagagacggcatttcgctccatatctcaccgccgatgcactccaccccggagcaaaactgcaactccaagctcacgagcacagggagttcacgcaggccgcatcggagaactgaatggg

SEQ ID NO: 79687 - DNA, 42214 bp, Oryza sativa
cttcatcgccgaggaggcggggtcggacacggaggacgcctccctggagccacctccggcgaagtcgccgggagccggaggaggcatcccgaagagccccgcccccgcgccgccgtaccgctgcccaacaccgccgccgccgttgttgaagctggacagccgcgcggcgcgctccgcgaaccccgggtcgccgcagagcttgtcgaggccgcagtcgccgccgccgccgccgcctcccggcgccacgatggcgtccagcaccggcacgccgaagtcgagccggggggaggagctgaggaggctggaaatgtagtcgcccccgaccctgccgccgtccatcgccgccgccgtccaagaaacggcacggtgccccttctcttggctcctgtaggggggagagcttggggtggtcggcaatggcggaggaggaggtcaaagaggcggaggcggtgaaggtggaggttcagcctttttgggttagaggggagaagaagctgtttttccagactgcggacactgcccccggtgccttttaaggtcgggggtgggtctcttccgcttccgctgccacttccacttccacttctacccaccgtaagaacaggtacaatagcggctataagccaactataaacatattttaaagaaataaagaaaaagagagaagagcagcgggctacagatttgtagccagctgcagcatggactctaagacgtaacgtgtgtatgataggtgggaccagatattaataatatagtaagcaactattgtatgaattggctattacaatgactctagatgatttggagctagtagttagctatactattaaacttgctctaacgggtggtggtaaattccggcgcacggtgaccgagctctaacgtctggtggagatggagggatcaggctcctctaccgtcaaaggtaggtgcctttatcaccgatatgtcgcatgtaagtgacaaaggcacgatgcctttgaaggcaaaggatttcaatccgagatggaggggattaggatgggaggcaaaaagatcgtctaacttactgctctctgattttgagtagatgacatatagatgctataacttgtgggcctatatgttagtgatccatgttagagggcagtatgttagatgagtttcttctagagtgagcgtagagaaagaaatattttggcatctgacactgagtggttgatatgtggtcttcacgactagttggtgtacatgtcactgtcctacgttaatcagatggatctctttgtgggagtagggggacgaaaacggttagaagtgatattaatttttaagaaatgattcttgattggtcgttatttttattatatttattaaattaattgtttcagagattgtactataatgttgaaagaaatttatatgtggccaggattgaaaaataccgttttatgcacaaatgatccttggtcagttgagagtttctgataccgttttcatccctagatggaagagtacgttggtaataaatcttctatctgtaggagaaaaacagagccatcgcattcgttgtgaagatacattgttctatcacaatatagattgatcatgtacaatgcaatgatgtagcgtttataagacaatgtgcagttttgcacacctttccctatattttagccctcactctcctagcttcctctttaatgctcttatggttagcgagatcgagacgaggaaatgttagctagcagtgagctcaaatagaagagaaggtgcaaccgaccgtaagctcgagtagaggaagggctaggtcaccgatgagcttgagcaacgggggttggccattgtcaagggttagcttgagcaatgaaagaagagattgtggccagcagtgtattcaaatgacaattgacttcggatgcaacgaagaaagaagagaagagagtgggagaagataataagaaagaaatatagaataagagagagaaaaagtatggcctttcgtctaacgaactagatagcacaacatcgttcctaaactacttgatggcaaaagagcaaatacacacaaacttaagttttgtttggaacaaggtatcttttaagtaatttcggaggtttgcattcctttggaattatcttttttttaatataggtttgtttggggcaaaggaaatgttgttgaattcctttgaaaatgtagcaattctgcatttttttttgggaaagaaaacatccaatgtgagccaaaggaacttttcctttgcgtcattcatggctctgcatctatctctttcctagattttttttcactcatccaaacaactcaaatttcaccattcgcttggattgaattccttagtttccactttacaccatatcctaattccgtgtttttcatttctttgttccaagtagaactttcgtgttatattatcaattttccttagaaaaccacatcatgccttcaaggttatttcaaatctctttaagaaaaaagtaaattggactaacatacacatacctcaaagtacttcaagatgtgatttgtgtattacataaaataagaaatagaattttttttagataataaaataagaaatagaatggaaatgaagaagaatggtgttgtaaaacaccggcagtcttatccctcaagcacactgcagacatccaagttaattgtattatgcacaagctacatgcccctacaagtactttcataaaggatgagccaaatctatgcttttccttccgttttgtatttattagttattgcagatctgaagtgaaatgcaaaatgcagggtctatttgtatatgagaaaattaggtattgtatgccaaatttgtacatgcacgataataggcactaggcaatagtcatttatgcatccttataggcactaaaatactagaccacagaatatagcatcagcttaattgtctaccattacttctgaacaacagaaaattgatggtttttggcaaacctattgcctaattgtttagccaaaagtagcatttagaaaaggaccatcgatttctttagaattcaatggctcacatccgtttcaggtttatcctcgtggataattagatctgcctaacatttcaccatcttcttatcagttccttgttttcattaaagagatctgcattttcgtgcatgcattatgttgagattcagagagctgccaatattactcctattatcaggaatagaaagcccatgtaggcttttcttttaaagaaactacatctaggcgcacacgcatgacgcatccatactcaaatattatcggaggcatcagataccaccccgcaaagcacagtcatgcaacacactaaagtctacatcgatacaattggtgaacgccaacattaaccgctgaagcggcatatttgcaaacgaaaaataatttatgaataaagcttgtatataggtgttcttagcgatctaaaagtaaaggctagaaaataaacttcgatgaaaagaccccaaaatcaacttcaaatttaaagttaaaaatttaaattttggctgataagcataagtataagcgaaaagatgaagccataaatctagaatctgaattgtaatgagtttgtaacacaattgtactacttagctagcagaccacgggttaaccccatgaagattcaatctcacggctcccatgactccataagctaagaaaatagtacaacaaatgagatagattatgttttcaaaaaaaaaatgagacagactattgattagattaatatcgtggattatctacttcatcgtacaaatatattaaatattttgagaaataaacttaacaaataatttagaataaatagtctcagcaatatatgagagattttgtttttaagaaaacatattttagaagagttggtcaaataattcacgataataattcggtgaagtcattatctttttaaaaaaaaaatcggtgaagtagctggtatgaacatggtcctctcacacaattacttgaaactgttattataaagagaaaacagagcttgatcgatattacaattacctttgttccagcagaaatgcagcgttttggcttcagcgaacctcagcctagtttataatgttctgaaaagaataagttagaaggaaaatcaaattgtccaagttgcaatgataagggatcacattttaccacgacattgttctctacgggcacaatcattttacttcagatatgttcttgttcccccaaatcatttcacacctgcaagatcatgactaaactattttcaagtggctttgagcatctaatttcctctctagaaaacaaatgtgaactgcgcgttcaaaccaagtttagctgtattagtttcctacgccgaaactgcaatgagtttcttgccaataatttcaaaactcacaagttgccttcatttgaatatttgtccctcaaggcaccatctatacattcttttgtcaacggaatgcagagccagagtcgaataaacaaacgaactgactatagaataaacagatctttggcccaatcaaaactgttcccaatcagagctcacattattctagttaatcactgcatctttattctaatctgcatcgggatcgctgcagcagtcacatgcatcaggacgttaaacaagtcgtcgactgtactgacaaatactaatttgcaaactgaagtagagtagtatattttgcttgtggtcacaatctcgaattcacgaactgtatatatacgactgcacgattaacaattggggaaaggaaatgtcagtcttgagcaatgtaaattcttctcttctgaagaataatgaggtgcaaaactattgcgtattccagaagaaatgtctttctgaagcaagggcagacaatggtaattcattttgtaactgtctctgcatttcgattgtaatcttggtttataaatcagtaaagcatgaatagatcctgatttcaaatgaaaatgaaactagagattggcaaatttttgtgctgatcaaaaactaaaaaagaactggattttgtcgatttcgaaaacgtgttactgatgaatatctgaacaacactatagtctacagatgatctgaagtattctgaaccgtgttctacaatatattgccaagaatctaccatcttagcttgcaaactcgcattgccagctactgctaccactgtccaaattgaagactccattttttttctcagggaaaaattaaggctatgttcgcagcaactacccgtcgaaaaactggacaagcaagtaggtgaaagtgaatttgacacggttcttgattataaattgctcaagggacaattacaaccaactgtacgatggaacatatcttctaggaatatacagtaataaatagtagtagattagggcatcttatgagctaatatagtacaagcctatgtacttgtttaatcaaggagccatagaaaaacttggcctctagttatttactcctcctgctcaatcatttgaggcaaaatggaatccatgggcgtccaagaactgcctgttcctgcagttccttccaaaaacaattttaatagttttttccaatccaatttcttggcattgcaaacaccacagatgcatggcaacacaatgtgagcatcactgacatggcaagttcatccgagatggtaagagagagtgtcggattgccacattggcgccacgtcatgcagagacggttggtttctccagtttgtgtgttgctttaacgttggtgtttgttttgtagttgttggatctgaactttgagcataaagtttggtggatctgaacatagaatagctgcagaggacttgcatttccccaatgtatattctctctcgagatgaggtcaatgattgctgccattttctacctgtctcggcttacttcttggtttccctgtcgggctcatggattaatctctgcctttctttcgctgaaaagttgacagttaaagacattaacatatcttcatatcagaaagacaattttattgataaaaacctgggtattatgtgatccaagttgcataaaactacaataattttgatacgtgacccataatctttgatattatggtcattatgatcttacagttttataaatcacacagttaaccaaattgacttaatattataaaaaaaatatagaatatttgatacaacatttatatgacgaattaaaataactaatacattttgaacacaagtttagagatcaatgaaaaattggttaacgatatgttttgtcaaatctcagggctatatgcgacactctaaagtttgggcatatttggtaggtcctaaatttaactatatgggttgggtctagagtggagttatggaactgcctaaaccacatctctagttcattttgtgagaacgctccagccaacctcgctctctttttggatggagttgaaaccatttggttggattctagctttagaagagttagagctgtaccaaacgagtccaaaactatgattttatacaacttgaaccgtttatggtgttgagagatttactctatcgaaaaaatccccgatcctatcctaatcctaatataaaatgcgagtaaatctccatcaacaaaaacaaacaaatcaaactaaagatatgctatgcatgcaccagaatacataatattcagtcatatacatccaacccttcgatctgaactatcactgtaattaatttccaaccgttctgacggacagagagctcgatcgccattgatacaccctcccgttctcgcgctcgatctcccggcgtccgtacgtaccaccgccggcagcaatggcgccaccggctcatcggccagccagctgccggacttcgccggccgcctcgccgtgctgcgagtacagtgccgcgtgcgccttcagggcaactgcgatgaacatgcagagaggtacactggtactgcgtacttcgccggcaataatctctgaaaaataaaataaaattttccattgctcgcagcttttgacttttactgttgccctgcactcgtaaagctggaaggacgataggaaaaagaattaacaaaaagtaaagcttttcctacgttctagatggtgtactagctaggaagttagtcagtcactgcaagaaatttgatggtctttttatttgaccgtaactaagatttcatgatcttggcctcggtcaatatttcctcgtttttatgagaattgaacggttttctgtgaaattcccgcgttccaaactttctgatagtctcatacagtttaatttgtggtcctccatctgtttcaaaatataaggcgtattttgtttcattagaagaatggtttgacctacaattgctctattacgatactataatttatgtgatacaaaagtataataataagtaatccgttacgaatctaataaattcaagtacttgaaaggagtgtttatggataggttgtccctgaaaagggagattttttcagacaatgccctgaaaaaaggaagaagagacagggaaagagagcattatgctgttaagctgttgcccagaaaacattatgctgctaagctgttgccaccaccactgcaggaattcagaggacactgcaatgttaggcatcagcacaggctttgcacactctcctttattccaaagggagaacaaaaaaaaagttggcctacttattacttgaaaccttatgccaaactgctgttctgcatttgctgcagtagtagttgtagtgcttcatcctgaactgtcaactgaagctttggaacaaagaacaacaacagcattggccagtgtggccttggattggattgctgaaagctaaagcgttggattattacctgcctgtgcaatccaaggaagagagaatcggaggaaagattagctttggtgtcgagctgtggaagaagatcacctttgtgacagagagagagagtgatggtactgtagctttgatgctgtagcggccgtggaactcccgtcagaaagctgtcattctactcgacctaacatgatgttttctttgcaaagagtgaacacgaaaggtgccctttattggattctctctgaactttgatttattattattattatttgttcaaaggtagtagcttctgttttttttttaacttttcctactgaatttgatcgttgacacgagctgaattgctgacaagtcctttctgtcacctgctagtgacagaaccgtaggtaagaacaatatcacgattcacacaggaagtatgccttttgagactatcgtgcgagttgtaggtatgagattattcagtttcaaagctaattatgctagtacgatgtactgaatttggaggagcaaggaagaatgatggagagatgtacagtagtaaactgaagagaggtgaagcaaaacaaacctgcacctgtttcttacacacaccacaaaaatgagaacatttgtaaagatctaccagttatgtttgccatcctgagaatgacctaaaagatggagaaaatttatagagtaactgaaatccaagataacctgcaaacagcacttctttgcaagtttcctctgatactgaatcccatggcctcttaaagctcaaatccatgtaagtagccgtcagtaagcaacagactgtctactactggtatctaaaatcctaagcagataggctggttatggatgactaatgggcttgtctttcttaataagtatcactaccgtcattagagttccaagatgttcttttgagtcatccaagcccatatatagatagttctccgaaaacccatttgggtaactgaccatttccaagttagtttcacatatgttgctgccttttgacgtggtacacaggcaaaactcaataggatactgcctgaaatttgttgtatccagttgtaagcctttatgtaaatgtcagaaaaaaggttgcatggatgtagatgccaggtaaaaaatacctttctctaaaaaaaataaatgtcagaagttatatgttactaggctattatattttcagcttattcaccggattattaaatgaatcgtttgctctaggcttcgttacggcttcttaaaaactatattttactgtattgtttagatcacttattttaagctatttgtaagttaatttctcaaaattttattaccaaataatcgacaacaataatctaaatagaataggaccaagaactcaaagtgagtcctgctggagttttctagtgatgtataatgggcaatccaatgatgaacgaacacgtctacctgaatcatttttcctggtttacttttgaaacgaaattgtttgaatccgttcgttccatgatattattggccggcctccatacattcatcaaaaactactagtacgagtagtttaataaaacctttaatggcttggccgtgttcttttttcaattctggattctgaagttctatttgcattcatgaaacaatcttttgttgctctttagtttcagatggctcattattttgcaacaatcgttcagtccactggcacccatcaaggtgccgcctgcggttcaactcgaattaccatcaaaactaaaagcttctcggtaatgggccatacccttcgcggaatgtccggggtccagatttatatgggccgatatatggggcacagcatctgtgagtcgaaccagactctaacggcccaaactttactggcccaacgggaccatttcactctgtattaggcctggcctattgggttccctgaattgggcctcgatcaattatcttgggccgcatttattcgatgaagcgccacgtcaatgcgagtcaaattagccacgtagacgccacctgagctaaaaccgggtcaaatactgccgagcgaccttatttgttttgcgttcaagggacgaaaatcagactagacgacaaatagagggacccaaagtgaacttattccgactcggattgcccaaacgctattcctcttgtatcttgctttgctgatgctatcggagggcgaaggttacttggttggctacggttttgagcaaggtttacaatctcgagcggtatcatcggatttcatgggatccgtcaaaaaaaccgatgaaattcgaataaatttttatcaaaaagttaaaattcagtttaattttttaaaacttgaccaatagatgactgcaaaatttgtatgcgaccaatcgggtgaatataacatggcagctgatggcccactagatagaattgtgggcttgtggcatctctattcttaattgccgtttaatagcctggacggaagtttgagccttcaaaattttctaggctccagaaacccaattggaactacgcaaatcacgttaaacagaatcaaacgcagctgactagataaccaatgcggccaggccactggcaggtgatcccgatcctacccgaacattatagccagaaacatgctgatcaggacgatacctcaacacaataaattcaacagatacaatacagcattcatccagagcaaaaacgcaaaatgcaggacatgtaggctaatgatgcgatagtaatttggccacattagagtagctgctggtagcaaaaaggttgacataatagttatctttcacagtaccacatcgattgaaaggagaatacttggaggcgcgacagtttcctacaatcaaaccagaccaaaacattatactgataaaacagcctactcgtcctcctggctacggagccttgcaagcttgttggtgaccacgatgtcgagctgcgcagcacgctcaacgatctccttgcgcttcttcgtagagacgttgtgggcaatctcggcacagtaggtcctgtttacaggagaattagctcattagcagaaagtttgtaactgcagctggtgctgacaacagaaaacagcaatgctgaacaccaccccgctgaaagtaagcttggtgaacaaagtgattacctgttgtgcatcatgagcaactccagctcagagacattgtgcaccacaaacttcttgaacttgttggggaggtagtgcctggtcttcttgtctgagccgtaaccaatgttgggcatcaaggtgcatcccttgaactttctcctgacacgggagtcaatacccttgggcctgcgccagcttggctggacaagtatgaacaagttgaagttagtctcagcaaatatgccaaatagccatagttacaaacgaggatgccatgcccactaatgaaagcaataacatgcaggaactcatatgaaggatgataacagtaaacctttaaacggtggcatcacattagcatccatgaaacaataacatagtttactattaccaggacaactggtgcaatagaagtgcatagaagtccataacagactttgcaaacaaacttcgatatacttaaacaaaaatatcacaatgaagtgttggtccaacaacaacattctcagctaagctgactagtagatagcaaaattgtcagtagtgctatacatagctcaatatctgcacacaggccttgcagttctgataatacgaatagaaggaggcagcactaggagcaatgttcacacttcacaacaaaacagtttcttgacgcaacaatcctaatttcaagtaatcacatgcaagaatgatgggagatatcttgcctttcattgcgtacaacatcatgcaaatgggtaaatttaggttaaccaaccacaattgaaagagcattcagctactgggaaaccaaccacatctagttactatacaagcgtctcttgttactggacactaaactacttcctcaatttcacaatgtaagtcattctagcattttccattttccacattcatattgatgttaatgaatctagatagatatatatgtctagattcacaaacatcaatatgaatgtgggaaatgctagaatgacttacattgtgaaacggagggagtagtagttagcaaaatagcacttgtgtgtatcaagactaagcaaatcaccacatacttcaagcaaatccaaaacacttccatagcctactaaaccaacccatgaatttgaaacaaactacacatatccacaaatcggtcaaacctgagcaacacgtatgacctaattcaaaatcaagcaggaaacccagctgatctcaccgcagctactactactaccactaatcgaaatggtccattccagaaagcacaaactcgtcatcaccttgaggcataggtagcggtcactatggggcctcttgaactgcttgaccctcttcttcacgatcttcttcgtcagcagcggcaccgccatctctgctccaccaaaaacaacaaaaacaaaaaaaacttaagagacgagatcgacgatgcagcaagcaacaaatccaaccagctgcgtgaagaaaaatcttgattcctgggcaagaactgacgctgtaccttcggatcggagagggaagcggagcgacgaatttgggggaagaagacgcggcggcggtggcggtggggaggatggcgaagggttcttatacggggggagaaaccctagcgggctcgtggccttggtcgaatcgacggctaggatctcgtgagatggaagcggacggccggatcaagttgtatgggtgggccgtcctggcattccaaactgggctggatttgctgggataaatgggccacgtgcgtggttaggcccatatgatctgaactgggctggttctgctcggataaagctgcttctgggctcgtttgatgggcctcatcccacccggccacttagatgggccaggaaattctggcccaaactatacggagattcgtgatgtccaagcagcttgtctgttcccgtttggatttttctgatttgcagaattcagtagaccgaggagaatttagtagggtgtggtccgtagatttggaaggattcttatcaaattttcggcaaaagcgtctggataagacaagccaaatgttaggtggaaaagtataattttgccattgttgtttcactttgaacaacatccattttaaacggcatgagtcaccaaactataaatcctaaatttggtttgtataattgaatcagactgtgccaatgttacagcccatgtgcagtgtgcacgctcctcacatcttggtaggagtagctaggagcgcactcagctgtcgatcgcccttttcctgcactccagtgaagggggtccaacacaactttagaagaagaaaacgaagaaggaattttcaccatctcggcacatgatagacggccgtgccgggcccgttcacttttgccgacccatcctcttatcacacacccttttctctgatccattgagtgctcatcttgcttgtgttcatgcatctacaactcctcatcctatattcctatcttgatttctgctgcatcagtgcatacacgattcggtcatttcagactgcatgtgcactcattgtactctcgctgtatttggattgctaccattgcatttttttttgtcagtgctaaaacttagttaaattttgacactactaatttttttagggtaagattatatttggtttgctatcatataaagccaacttatgaattctagttaagattgttctagatattgatgtcaaatctagcatgggcattaccaataaattggttttagtccaaactaaacacatgtactatttaaactaacaaaatattggtagggctaagttttggtagcaacccaaaatggctcttagacttatcctaatgctacaaatctaaggtatatttagattcatagtagttttcatccctaattactactgtctttatcttaaattatgaaaacctaaatgaaatactagtattttctagtagtacaatctgaccatgaggtagtactgcatttccttttcgagtgcatgctgctgtactgcatcctcatcgattcagagacacagtacacatggtagtacgaaagagaaataaaatgtgcgtgacattatcgccgttttttactgcaaccatgtgtccatctgaacattcatgctcctgcaggtacacggtatatgtacacactagctgctactactagtacagtattagtaggttattttgtgaaggagacgagacgcaatctggaccgtccgatccatggcttcatacaaaccggtcaaccgtgtacgtttggcaccgtagcagttggatcgtcgctatcatcggtgttcgtttcggcaagctgacaattcctgctgctactggtgcgaatcatcctgctcgtagcgtccctgattctcagttacaccgaaaatccatactactttaacaagactctaataatgataacagtgaatctgtcactccaactgcttccatcgtaaattttacaaaccattcgatgaacttctttatgttaaaaaccaatcaatctaaatggatagcgacgtatagaatcaaattgagacaaatattttccatagcagaacgacgggtagaacatttcaccaaaaatgcattttatccgtagtaaaacacgggctttagctagtctaccaaaattctctactaaagcatgtacatgtgtgtgtggaaatatatttaccactgcctttatcttaaaatatgctccaataactttgtctcggttcatagttgctatattagctattaataatttggataagtcagtatctagattaataattaaaagttaatacttccttttggaaagaaagttgaattcttggctatgaacttagacatggcacatgtctatattcctagtcaagattcatttgttttggaattgagggcgtgtatatctaataggacatactctctccgatctttccgtttcaggttataaaacgctttgactttaatcaaagtcaaattactttaagtttgaaaaatataataacattttcaacccaaacaaaatttattataaaaatatattcaattattgatttattaaaactaatttggtattaaaaatattactatatttgtctataaatttagtcaaacttagtttgactttgaccaaagtcaaaacatggagtaaatctgaacatagctatatccatatttatagctgaaaagtgagtactattttgggaaaaaaatacatagtactacctccgtttcaggttataggactttctagcattgtccatatttatatagatgttaataaatcgagtcacatatatatgtttagatttatttatatatatatatatatatatatatatatatatatatatatgaatgtataaaatgctagaaagacttgtaatatgaaacggatgaagtattattagtatatcttgttaattgctattgcacggacgtattactgcaaaggattaatcctcagtaaaagctggcatttacactccctcccaacggtctccagctagctgggctggtgaatagcgtaaacaaatgcaagctcacatgcacactctgttcagacattcatagttgcacagtccttgtacctactgcagtcactgttgccaacctcactgacaagaaatacaagacaaattcatgggtaattaccccccggcaacacataattatatcgcaaatacataatcaaatccagataacgcaactgcacagtgcacactcttccctgccaacgcacaggatgttaaaacactgtaccacactgatccggagatccgaaattaaataaccccaaattaccaccagatcaatggcatgtacaacaatagtaaaatcactgtactaatctagtgccgaattaacaacaagtgctgtgcaccaaccatttttttattgcaaatggaaaaatcaaagaaaaactaattataacaaaaaaaaagcaagagaaaatgaaaaaaaaaagaggaaaggaaacaagaacagtagggaaataattgttcaagaaatgattcatcatgcaaacatcaatgaacaccactaatcatggtactaggacgtaggaacgtagctgtcaataatctttatcatacaatcgccaagaaacccaccaacgccgccacggcgagcgccggcgccgacacggcggcggcggtggtcgccgcgttcttgccggcggtcggcgcgacggaggacgacgcgccgctgtcgctgccggaagagggggcggggccaccggcgacgggcgcgggcgccggctcggacgccggggaggtcgccgtggcggccttgctgccggcgaggacgagcttggccttggaggcgaggttggccgggccgaacgcgtgcttgtcgggcgcgccgccggtgacggaggagccgacctgccacacctggttcacggacttcatccccttgtggagctgcagcttgccgtagaggcggatcttgccgccgctgccctcgtcggcggcgaggtcggtggccgggaacgcgatgggcgtcgaggcgccgccgagcgcgacgtagccggtgatgttgtatgtcttcacggcgggcgccgacgaggacgagccgcccttgagcgccacgagcgcctgcgtcccggccatcccctcgccggtggggttcagcccccacgccacccacccgccggcgcccgccggcgccgccacgaacgccaccgacagggacgacttggacgcgtcgtacgtgtagtgcagcgccgcgccgaggctcggcaggtcctcgcacgccgcgtacgccctccccgccgggaacttctcgccggcgcacgccgcctccgccgcgcgcattgccgccggcgaggcgaggaggatcagcgcgagcaccgcgacgagccgatgcggatgcgccattgccgagggcgagtggatctggagctcagtggagggagaagctcaagtggttggctgatttgctttgcttggcctcttcttctcctcctccttgaagtgtgggagtgtgagggtttataaggagtggaagtggggttatgtgtgattatgagggttatcagggggttatttgttaatgttttttgaattttttgaagatggaaagggcaaatttggtccgtatttagaggggtgtgatatcatttggttggtgacaaacatgcatgagacatgaatcctgactcccgtgagtttgttgcgtgtgttatagtagccacgaggttgtggggtttgtactttgtacctctgggttttattatatttgcaaggtgtcatttgtcgttagattcaattttgtttaaacactactcctagtactttagaagtacattctcacgctataaatattaatgactagggtaagattcggttaaactttcaaaattccgacgattggtaatttttagaatgtttaatttggaaatagaagaaatggtatacatatatttgtcttaaaagcactatcatattgttagtattctaaatatgagatatcatatacttctcgctccacatatgtactagtattagtggagcccactatataccaaatcatatacggaatcaatactgctatggcaagtgtaataagtagataaggaagtagtcatgtataagaaaaaggaaacagagtcctatttagatctaaccaagagtccaagactacccgaattgtatacataattgattttcctagttttacttgatcaagagggtatttataataacagtataaatacaaaacctcacagaaggagaggagacacgaatccaacaaggagggttctagagccacctctcaatcttgccaagtttgttctcaaggaagccgatatcaattagccatcaagcacatgcctgagcttcacactggtgtactagcaaactagattaggttctactccctattatatttatgagagatattgatatataatggtaacaccggtttcggtcagtaggaataggaatattacttgtcaataggaggttggaacccgtatacttttagagttttgtttgcattcccatatcagttggtccctacgttctcaaacatcctgtatatatatatgaataccgtgatcgtggtataactcgtcgacgaatactgtaataattttttactagattatataaggttgttttaaaatagatgatcggaattttaaaaggcaaaccaaatcaatttgtccaaattttcaaatatttgccaacaaagcactattttatcataaaggtgcggtattgataaataaatcaataacaccctctctgaaacagatgaattttacaagcactaccaactactactacacacgtccaaatatagcaacttcctggatataggatatagatctggaaaattacttatacttatccacattcatctcaatataaactaacttttacgcatgaatttggatataacgtatatttagattcatatataaaagttagtatattttgtgacggagggaacatattttaggacggatggagtattttccaaataaacagtaaatcttcgtaaattccaaacaggacatgaatatttgtcaaaagagctttgaatcccaactcacaagtcatctaacttcacaaagctagtccaatattgacttgcctaactccaaatccttcaaaaccgtgtgcagagagttgacggtgggttggctgaaaaatgtaaccacacacgtaaatgatccatgttaggagcaccgccactacagagtgtaatacacatgcgaatttttttattaccaaccaatcaatggtcaatgcatcttggttaatttgttactagctggccaattttttttttgtggagatccaacagaacagaacaccaagtctgaaacattcagaattcagacgagcagctctgaatctggccatgtgtgacccatgtgagaacttgacgcgtgctcccaacggccgggtgattagtagactgaatgatcagtaaaagacttgcaagcttgctaatcttaatcagtctaaattaaccctgaagctagtatatcattcttgactaagggcacatgaaccgatgcatgttcaactctgcacaggctatgacaggcttagggttaatttgattctgaaggttgacccgtgaattacgagattgcatgacgaatgggatgacaactaggtgatgtaattacaggatacacatggaagcattcaggatggagtgattggattaatcaactacgataacatgaaacagaatgtgatagcatgaagcgtacatgtgatcgattgattggagattatgttgtctgaaatgaacccggagatctcaatgaacctgtgttactgtgtacctatagatttggcagatccagaaatcaatacataaacacatcccttcgccatctcacatgatacgaagtatgaaacgtatccaaccattttggattcatctcaacaagctgctcaaaaaaaccctgtaaaattcacactcaaaacaaatccttttgcctctttcacctctgaactctgaacatgtctgttgctaactacaatactgtgtatcatgccatcatgcaaatcaaatcatcgtactctgcgcaaattgccaagtttgcaacggcaggggtcagcaataataggcaagaaaacaaacacatcttccattttagtattaccaaatactacattggagtacttaaattaatctgaaactataaaccccgtgatcattgataaccctatctgcagtactcgccaaacggccagctaggccatcagatactaaagcttcacgcaacgccatccagaagctgcaaaaaggtgacaggctacacacttgattattgcaaggcgggttatgaacttaatcagcatgaaatggaaggagataaaaatatgatatactcgattagatgagctattatacgggaagaaaaagttcggaggtcactgtcaattcagtataagtaaagcactagtatcctaaacacatcttgtagaagcaactcaatgatcttgtagaagcattgcatgtgattgtatgaaaaatgatcaacttttggtcatcagagtggctagtgttttacagggtgtaagtgaccccatctcgcaattggagatagcttcaaagggaaaactgaacaggatatgtgccaattaagtgattaggtgcctgcatatatacgaatgaatcatttcttcaatgatttgtgtctggtatacatgccagtattgaaatgattttggattcatggacttttcagtaactatcttttcatgatactgtatctgccagggtctgttttggattgcttagcttatctgaataaattcatttcagttttcaagatggcatatattcatttgaggttaggaatgaaagaatggacgcacttctcgagtaccatgtgattttcgtagaaacttttgatatatgatttttaaaaaagaataatcagttttaaattttataatagttaattcattcgtttgtactctcgaatagtgatcacaaaatcattcagccgttcagctctttagggggggggggggggtcactcttagctactactacttgcataggagagattaggattggaaatttgagcttttcaacttagctgaatctgagtctacttctgcaaaacagtcggtaaaacctaataaaaagagatgggccagagtgtcctatgtaagttctgattctttctaaacctgaagaaagctgttgaaaagctcctcgatggacgatgccttttggtacaaattaatctcttttcagatccaagcgttcccatcctgttgggtggttaggtttcacattagtagcaagctctgcacgttcacaactcttttgtgctggtcacagcgtttctttagcatcctatctcctgtgttttcggcgtgattttcaggtttcaggttcgaacaattagctttttgataggaccactctgagactatctaagtgggcattagccgttgggaattttggtaatgacaggttacaagcatcagaattaagacatactccttccgtcccgttccatactataagttattttagttttatcctaaatcaaacttcactaagaactttaattgagtttataaaaaaacactaacaattacactaacaaataaatgcgctgttaggacacattttctagtgaatttaatgaaaccaattcgatgttatagccgatcaaaggtaaagaagtttgacttatgacaaaatcgaaaatgacttatataatatatatggaacagagggagtattagcttatcttaacttttttttatatatgctagcttatcttaagtttggtttagatagtgagggagaagaagaggaaaaagaaaatgaactgatgacatgcatagtaatggtaatgggccaacttccataaacgttggatttgggccaaatactttaggtcaactgaacgtggttgaccattgatgggatgatgaaagcttcaaagccaccaactttttttctcctcctaacatatgggtgtgtttagttcacaccaaaattggaaatttggttaaaattgaaacgatgtgacggaaaagttgaaagtttgtgtgtgtaggaaagttttaatgtgatggaaaagttggaagtttaaagaaatagtttggaactaaactcggccatattttattccaacttccatgtggatgagagaaaaactggaaggactttttattcggctgtagtaattctgaagtgaaccacacttcaattttcttcaggtaataatgcccaagtccacaaaattgtgctgaaacaagtaataaaagttcacacgcttgactttgataaatcacagctgcggtagactgtatgaatcttttttagataatgaaaatggtttgtgctagtatagaaacaaattattcactgggttattcctacggattatctactttattgtagagatgagttaattattttggaattaagcttaataaatagcttcgaaccagtggtctaaacaatacaatagaagaaagttctttttttctttaaaaaaagttatgtaataaataaatctgtgacaataatccagtagaacagctaaaaagaactggacctaaggatggattggttactgaacaatactacatttttcttccatgctaacttgcccacgggggatttgcaattatgacactgcaaacattaacctttgctataatgacactggacccacatttcataaatacagatgggcccatttgtcatccactcggagtgtcaaaacagcgaaacccctatgtttgcagtcccaatattgcaattttctccttgcgcaccggtatgaagtccaaaagagacaattcaatcgtcacattaataagagaataaattcatgattgtagaacgagtttcaactttcaaccagcagtagaactcttcttctttgtgcgtttgtcgtacctctacagtgtaagtgcttacaaattttgtggacaagattttcagtggtcagcgagtacaaattcagcagggaaattcaatgccgaggattttcgtggcatttgtaggtccaaattgagcacatcacggttgaaaccatgcaagtatgcaacatgatagctgccattttcgtcgagtttcagatcgagaagcacggcagtttgactgacgaactcaaaaacatggcgtctttttttttaaaaaaaattgtttcaggaaatttgttcatgggacatgggggaaaggcgtgtggctagcgcacgtacggctgttgctgtcaacggacgagtgattcgtgatgcatattggaattggattcgtgattttaatttgctgtgtgctttgtactacagggtttagcagaagttgttctgaactttttgattctggttgcgttgagaatgagaactcttttcggggatatatatagagacagcgactacacgaaggtgataattaaatggagatatcaaatgtttgatcgagcaggagtcgctgatttgatttgatttcagttttgatgacctttgtgaataatcaatgtcatgcaataaaagctttttgtgcagaaagcgaccggtcagcagattgtaaggagtagtaataaacttttctaatttgtttggcttggggcatggcaaagagcgtgacgtcaggcgggcgtcaccgtggcgtcaccggggccgcgtccctctcaaccgcggcgcgtccttttccggctttgggcgacgggacgagacgacgacgagaggggagagaatcgcatcgcgaagcagcgggggctgcacgattcgtcgtcgtcgctttcctcttcatcctctcctcgccgtgtgcgcggtgcggcctcgttcgcgtcggcgtcggcgtcggaggcggagacggaggcgaaattgcaaggaaaacgacgacgggcgtcggggacgggaaggagcggagggaggcgtacgtggatgtgaactgattggtgcgtaggcgagccgcgagcggcggagctagcgatgctctactttcgaagtcacgttactttgtcaccgatacatggtgcgacactctgccccctcctgttggttggagttacgtttttaatcgtcgtaatagttgctagctcgggttttttatttttctttttctccccctctcccggcataagccagtctgactgtttgttttgtgtaacaaaaactcttttcctgttaatatattgatgtgcaatctttttgcgcgttcacgaaaaaaatatgggtgcgacagatattattcccttgatctcaaaaagtcaaaataactgtatttttacactgttcatctccaatgtttcaccgtttgttttatttagattttttttgttagtatttttattgttattagatgataaaacatgaataatagtttatgtgtgactaattttttatatttttttcataaaatttttaaataagatggatggtcaaacattgaacacggatatactttgatcattgactgaatccgatagactttgaacctatatgtcagcaactaagacacggtgatttcgaagatagaaattcttgatccgtgaagtgaacggcatggagcgtgaataatatgggccaagtgtgaacctatcttatgtgggagtgggacgacgtgctgcacggttcgtccctacatatgatgcaagcaacagcaaacccgacgctggaggatggatggatggctggctggatgctcattctcattctcattctgtttctcctttcacggctggtgtttcttttcccacggcctcaggctggctatgacctcgtttaaacgagtttttttttttacgaatcgacgaggctgttaattttattgaataaaggagacgaaaaatgtaaaaaaaaagaggtaaagtatagaaaataaaaaacccagggccgtggccctaactataggcagttacattgtcaaccagacggcaagattttttgcgcccgccaacccccatgtttttgcttcctcctttgtcttggctagcagagttagcgacgacagctccttgtgctggaaagtcctccggttcctttcgttccgtttaaacgagttttacactataagaagcagcggatgagaatacatagaaaagaagaaaacaaacatttaacttctaatttatcttatatattttaccattatagattcttataatatagacaaatagctaaactatttgtgaagaaaaaaattaaaaaaaaactgagctaccaggatatctctaaaggtgtgtttagttcacgctaaagttgaaagtttggttaaaattagaacgatataacggaaaaattggaagtttgtgtgtgtaggaaagttttgatgtgatggaaaagttagaagtttaaagaaaaagtttagaactaaactcggcctaaacaacggaacctacatgtcgtgtcataggagccctatgacatcaaccatctcctgcatctctatgcacagatggctgatttgatctcatcttttcacttatatttatacttatcaattaaaatttaaatttttagctttaaatttaaagttgattttgattttttttttatcaaaatttatttttcagtctttaaatcgttaaaaacacttatataaaaaagttttaggtataaattattttttatttacaaatatgttgtttgaggccgtttttcagtgcgaagtgaacaactgcatgccaaacgcatcgccggagaaggaaggggaaaccggtgacggtgagagtcatttaaggcgttctggtagcctacgctttttattttttttggcagttggcctgcatcggtgaccaacccccgaatgaaatcaaccgttgcaatctcgcaatttctttctgttggaacgccattgatttctttctcccccaagactaattaacatgtggatgtggtgtcatctttcttccagccaccaacccaccgcaggagaaactctccagtcaacttggttttgaaaaacgcgatgagtgttctgatgatgtgtacagtacgtgcttcgccccgcacgccgcggcgccaaggaacttcgaataatttaccgagttgtatacaggccgctgccgctgctgagactgagaccgtgcttgctaaattgatcgtcctcattgtgtcgcgctccttccacgtagggctgatgtttcttttcgtatggcctctgactatgacctcatttacaccgtgtttagatccaaagtttttcttcaaattttcaacttttttatcacatcaaaactttcttacacacataaacttcaaacttttccgtcacatcgttccaatttcaaccaaacttccaattttagcgtgaactaaacacacccttaaacgagttttacactatgagaagccggggaggagaatgtatgcaaacaaagaaaacaaacattgatcatcatatgataagaatccaaaatttctcaaattgatcatcatataactacatgaacacggatttcgtcggaatataattaatgcaatataagtgaatgtgtgcatgctagagtgtaattggcatggggttttaagagcatgtacaatagtgctattaagaaggctccaaaacttattaatcagcctaatacgagattagaaaaagaaaatcgctaggagagaaacaaatgggcgcttgttttagcgctagcgcttgcacagcaccccatgcagtatcggtcacgggagatgagaaaaaaaatgctaggtgggtcccacacgaaaaaaaaatgttatatttaatgtatgtatgctttaaccaaggcagcttatagctaacttgtagttaattagcatgttgtatgagttggctttgtaagttagctctaccttgacatgataaaattttggagcttgccgctagctgcactattgaccttgctctaatcaatgcatgtattgtgggagaatgtgtgcatggtgtcttcattgatgtgattagttttggtgtataaacttatatgatgatcaatttgggaaggagggagtgctattcacaaggtttttcttaggccctgtttagttcccagaacaaaaattttcaccctgttacatcgaatgtttggacacatgcatggagtattaaatgtagacaaaaaaaattacacaaattgggtgtaaattactagacgaatcttttaagcctaattgtgccatgatttgataatgtggtgctatagtaaatatttgctaatgatggattaattaggcttgataaattcgtatcgcggtttctaggcagaatttgtaatttgttttgttattagacaaagtttaatacttcaaatgtatatccgtatatccgatgtgacaccccaaaacaaaaatttttgtcatctaaataagcccttacttcctccatcccagataaacaaattcatagtgtatcatatttgtttattttaagatggatatagtcttgttttaagatgggtttaggaaagaaggttagaaacttctcctatgcacctaaaacagggtaactcattaccacatgattaatacttactaggtaaaacaataccgaaaaatagattaatatgattaaaaaaaagtcttccctatcaacttttttactttttattaaaaacatacctcatccgtcttaaaatataagaacttttagttggatggacacagattcaacgtactaggatcttatattttgggacacagaaagttattatattttgggacgtagggattatcttctaaccgttcatagaacgtttgcgtgaaaaacgagaaaatagaagttgagacatgtactttcaaacatatctttattctccttttgaataataggttcccaactttaattagtcatgacttaatgagttactcgttccatctacttttgatagtcatatttctaaatctgaaaaatttatttttgataggcatatttcaatccaacaacctatcatcttaatgactttctcggatttaatacatgactctctattatttcacacatgattggctacaagagcattgagaaatgtaaatattaatgaattgcttgtttacgtgattataaaagtagatagagggagtatttcgttttctatacggagaaatgatttacgaacacatccaattgtattacggttaccgcggcgtgctgactgaccgcttaccaaccacggttcacacccatcttcctggatcaaaccggctagtaagctagttctgtgatttatgagtaattaattaagaagcatgcgattatctttctcatcatgtgccaaagattcagggcggcgaggcaatctcatatattctcaacggacaaataataacaacgctttatctgcagcagccatccgaatccatcggcgatgcacagcgaatgcattgactccgatgagtactactgtacttgatggtgttctagaactgaaggaaggaatgaattcggtttgagtccgtgagtggttgattgatacaggtagtaccactgtaccaccatttgtggggttcagtttggcatccaagtgattgtgctgattaattgtctcattgttcagccaatcaacggtacaagatgagatgagatgagaggatgggctgttatctctgatgtgttttctgcctctcatgtcatcatcaactcgcccataacttaaaccatattatttttagggatttagggatattcagtttatttaccattttcaagcctaactaattttagtaatattaaaattttgtaaagtttgataatgccacaagatttggtaataaggtaaaattatgtatgcagtattgtttagtttgttaccttgtaaagaataatttggatgattaccaaattaattttggtatggtaggatgtgataggttattcgagacatgtttggattgttgtcattttaaattttggcaataccaaaatttaatatgtttgaaaatagtaaaaaaaaagtgaacacgcccttagtttatttatccgattattgaaatggcttatttattttatgctttgaaaaccaatttccttttagaaaaatagtactgtaattgatcaggctatttattttaacttatttataaagttcatcttttaaaatacttaatctattttaaaattgagtagataacttacgacgataatccaaatcaaacaaacctaactttaacactgcaagagaaaccgacaattatagcgagtaaaggaatcaagagatacgttatcatggaaacggtaagtactgaaagattagcgagcatacattaaaacggcaggtaaaaaacccaaaaaccgaaccggtgaacgtggacgcgaaaaagggcaacgtgcaaaaaaccttcctcaaatccaacctccgaccgcgtcaatggccgcccaatcacacgtccccacgtgtcccccctcacctccgccttcttaacctcgccacctcctcctctcctcccacctcgcctctctctcctctctctctctctagtttacttttcttggagccaccaagaaaccagccatgtccgtgctcggtgtcttcttggcgtcgctgcttctggcggcggtggcgccggcgagggcggcaggaggggggtgcgcggcggagaggttcagcagcaaccgcgtgtacgcggcgtgcagcgacctgccccacctgggcgcgtccgtgcactggacctacgacgccgcggcgtcggcgtcgctgtccgtggcgttcgtcgccgcgccgccgtcgcccggcgggtgggtggcgtgggggctcaacccgaccggcggcgggatggccggcacgcaggcgctcgtcgcgctgcccaaggggggaggaggcgggtacgaggtccagacgttcgacatcgaggggtactcgctctccgcgccggggaagctcaagtacccggcgaccgacctcgccgcggaggtcgccgccgacggccgcgtcagcgtcttcgggaagctggcgctgcagaacggcaccgccgaggtgaaccaggtctggcaggtcgggccggtctccagcgggtccatggtgccgcacgccatgagcagcgacaacaaggccgccatggggaagctcaacctcctcaccggggcagccacctcttccggcggcggcggcagcaacctcaggaagaagaatgtgagcactcttcaatcttgatttctagtatcattttgtttgcctttcttgaattcctaatcaaatttgagtgcacaaatcaaattgtagttagaaaaggggggcgatttcagctcgaattccaccagggaacttaactccaaaagctaaaatcctggggatttttttttttagcaaaagctctcatattgttgttttcttttattgctttatgaattagcaacagtagtggttactgaagtctgaagcggtactggtatgagtcaatttaatttgaagtatatgcttatgaggtggtagagcgttgaaaagaaagaaaaaaacaacacattttttaatgcttaagagtcaatctttggttaaaataatctttcctgcttctgttgccatgtgaaatgctcaaatgtttatacatatgttcgactgttatatcctggttggtttgagatgatttcaactgtgttaaaatctgtaggaataagatgacgtttgctgactgattatgtgtgacaaaatgccttctttgcttccgtactacacactcaaatttctatgctttcagattgcaattttcttgcctgtattggtttcttcctgctttggtggacttcagcacgatttgtctttcctgttgatggctacatcgaaatgctcatttcacacaatgcaaattcagtagagagtagggagccgtggtgttattgatgttctagtgaagggatcgatctttggttgcaaaccaaacaagctttttcttcttctgttgattcacattcacaaattgcttgaccatattgataatgatattatgatgtattactaattggttcaaacttttttctaattttatatgtgcagacccatggaatcctgaatgctgttagctggggtcttctacttcccatgggagccatatttgctagatatctcaagacattcaaatccgccgatcccgcgtggttctaccttcatgtagcttgccagctgattggttatggtgtgggagtttctggctgggccactggcattcatctaggtaacctgtctaagggaatcacctattcgcttcacagaaacatcgggatcacagtatttgcgcttggtaccctacaggtatgttctattgcacacattgttatgacctctttatctgccaatatttcaagcccattttgtgcaattgtacgatcatactgattgttctatgtgcactctttcttgaagatctttgcgcttttcctgaggcccaagaaggatcacaaataccgtatctactggaacgcctaccaccactcggtcggttacaccatcatcatactcggcatcgtcaacatcttcaaagggatgtccatcttgaacgtggagcagaagtggaagacgggctacatcatcacgatcagcatcctgggtggcattgccgtgatcctggaagctgttacatggagcatcgtcttgaagaggaggaaggaggagaacaagtcctataacggcgcttcaaacggtcacttgccactctctatgtaattcttgtagaggcaggagggacttgtgatccctacttatatattcaggaggctatattcagttatgtttatgcttataggattaggccttgtgatcttggtatctcttcttttgtatgatatttgtatactgcacactatactggagatgagagatgccagtacagcttgtttgattttttgttctgtttgtgaattgctgagttgaacatccactttgtatgattttggtgccattacaaatgttccttttggaaaagttgggcaaaggtgtcccaagtggttggtgaattggagaagaaagatgcaagaaaatgcttgctagtggaagcatgatctctctagaaagtttgatgctcgtagcagcctagcagaaaggaaagggtactgaatactccatttgctgctatgtttttgtgttgttcaagaaactgaagggagtgtggtgatgtcagatttcactttgtttcagtagcaaggaaacaaaatgtttggctattgtttcttcaattattagcttcattcagaagagtggcatgtgtccaaaacatgcaaatagaatccatctaaaataactgtgaacatgcaaacaactgaataattgacatatcatggcagttttaagtttgatgtaatagcaatttgtctgctttccatgcagacaactttattcaagattttgtgccaactggtccatgcattagagtgactccattgaaagaatagtacaccctccgttttttttatatagacggcgcgttcacttttaaacatatgtttcactaatcattttattcaaattttagtttacaaaatgtaaaaaattaagtaatgcttaaagtaccttttatgataaaccaaatcacaacaaaacaaatgataattacttttttttataagacggatgatcaaacgccaaaagtctacaacgttatctattaaaaccagaggaagggagtagtagttagagtggagtgtgtggttcaatcagactcagctaggagtcctgagcagaaaaagggtttgtggcgcgtgatttagtgcaggtcagttcacaactttcttgcttgcaaataggagaaaaaagatgctagatgttgtggcaaaccagggaaaaagttcagaaagcaacgaccttggcgagatctgtgacatcagagatgcccctagctagctgattgcacagatcgccagcaaacaacctcatgtcatgtgaatcccctgcgagtgttcgagtgatcatgctatctggcactaatcaactaaaccaaacgttaaacccttgttgcaatgatgctaatctgctattatcaggtgttaaaaaaaatgcatttttgactgcaacatttggcgaactctgatgcacctcgtttatttaagtgtaaagatgttgaatcattgactccacaactactacaagttagatataaagatgatgaatcattgactctctacaagtaagagataagtagattattagtagtgctcaagacgtgcagacattgttccagaatcctcactttccagatggtctctgaactcactggtaaacacctaccaactcaaaaaattaattatagtagacgacttcaccaaaactgtccaaaagggtttccagcagtagtggatccacaacataaatgcctgatcatttgtgagtgacacaccttctaagtgaacttggccaaactcaactactcctgcattttctgaactattagtattaagctgcagcaaaatcaggtagaaaaccaaattatgaccaaatctctgcatcactgaacttagatgacgaattgacaatgcagtccatatgatttgacctagcctaactcattgatttttgtcatctctgaatctaaacgtcatgtagctctcaactcaaacccttttcaattttctaatcgttagtcatgttcaaaccagaattccatcagattgtcaaagctaccaaacagtttggttgtgttgagtatgacccatcatcactcagtagggttcatgcaaagtcagttttgcttgagcttggctcaaacttccatcttagctcaaccagaactttttgggtggtctccttcagttgagtaggtagaactgcatccatctctggaacaagttgcaggtcagaaggagagttgagctgtattaggcctgaaaaaatgttcagaagtgactagcaagcatcaaaagcgactcatggattagaaaagcttttgctgctttatggaaggaagcaattcttgttgagctatagtagaacagtgcaatgtgtgcagtaggagcaaagcatcaactaactccaaacatcttattctcaacagcagacagcttggatggtgctatcaagttcccagcaatcctgcaaagctggtatttgttgaactgcctgaatattagtttctggaagaaaaaaaaaaggggaagatatgtgcctgtttggatgctttcagacagattggaatcttgttaacaaaggacatagcccacacaaattgcatgtaccatttgctgtaaaacaaagtaaaagaagattcgcaataattcattgaagtaaaattatagtgttgatcggtcacaactcacaacaacttctgaaaggaaaagactcgaagtaactttctttgtattcaacctgtaaagaatattttgtatcaccatgtgtcctctataaaaagaagaggaaaaaaaaaaactacatgagatatcttgtaactatgcacacatttcctttctgatgttactcaacgaatggtgagaagtcagtggtgaatatctacagaattaacagtgggacaccttaattctccctttggtaagtaacgtaagactcaactcctatacagaactgctacaccaaacagacaaaaacacacagacacactcatttttacatgtttcacaaggggcacaaatcatgcacctctgagctgccgaatggcttaaagtcagaacgttgcaaataattcaacggattcttctttgaacttcttgtagatgcttcacccgatagaacatcaacggatggggttgtgatagacggtggattgatgggcggggatgcagaaatcgttgagcagcaatgcctgacattgatcctgtgtgtaatggtttcagttgaggtgctacctgttacattgaccaaaagaacggcctccttatctctggtgacttcgcaccaacagttctgcagtactccattgacaaatacttcttgggtgtaatagtcttcatggtgcacggtaacttccattgtttgcccaggttcaatgagaccaactgatggttcaacctgtaaaacatagcacgatgaatgattaaattaccaaatattggtactgtgaaaagcaaaatggaacatgcaaagcactgaaaaatataataaactagtataacactcaagtcaaaaggcttgttatgaatggttagtggtagcagctgttcttgtctgttgactgtcatgacaaactggtcagtcagcaactccactgagatccatatccagtttaggcttatatggatgggttaaatggcagcccatccacgtgtatgggatgggttgggaatttgagctaaaatcctagcccatagatgtggataggccaggatttgggttcatgcaaatgaggcattaggatttttggctgaaacacatttatgaactgagcactgacagatatgatcatatgatgttgtctatcaactcatgcaaagtttggtatgattttgaccaaatatatgtccacaaagagtatcctaaatgaccactagaagacaatacatgcaaccaaacctgagcccacctccatgactgtctaggtacaaggtgatcgaaattgtgtttcatctcatttgcttttgcaatttttttccttcagtttgctttctcataattaaaagaaagtctgatatagttctcacaaagaggttggagtgcagctgatacagaaagtgcatgtcatagaagtaaaatactccatcccttctcttttacattatgtgaggggagtatataggttccatggttgtccaaaattcatattctagaatgacaagatatcttctatatttatgagctaaattttattttaggtcttgcaaactgaatacataatggacagactttctatggttttgaacttaacaggctttctatatacaagcaaaagaatggtcaacactacagatagaaatagaacactcaactgagagtgtaacactatgggttttcttttttcttaataagggaaaaacacaatgggttttaagactaaacaaaagaaaaaaatgaatgcaggaataaacaaataaacatattaatgcatacctcaagccaaagcggcaacccaaaggatgcccttggaggaaactcggatttagttccatcctgcttgctgattgactggctttcacacaggatttcaaaagcagccttgtttctttgacaatcatttgttatccggaggacaacatgttcttggttttccaaaattatattgtttgtgctgattatagtgtctggaacaaaatgggactctcgaagcaaactgtgtaatcttttgtcagattggagtatttttccatattcctgtcttcttgtaaactcatccactcttgcaatatcaacactaaatgcacacctcactggtttatgatcactatctgtgacacccatgcaagcttcatacctaccagaagagcaataaaacatcaaattatgtatgagggagtgattatgatcaagacaaaacaacatgtgtgtcttagattctccttctcaaaacgagtggtaactggtaagttgtagaatcttacgatgtaattttagcaacaacagggcattctaatgagcactctgctgttaatacatcacggctatctcgatacagtattctgtcgcaccaagcaggtattctcttcttctcacccgagtcatatcctaattatttttggtgtggaaaaattagctccaaagcagttgcgtcaatttaatcagcacataaaagaacatttgaatcttgtgacagaactggaactatttaattaaggaggtgccgctagcatcaaaagtaaaaacaggccatacctgcaagacctggtaggtgtctttggaatttgtaagtcggaggaaatctgatcaaaccttcacgcattccttggaaaacctttcctgccctcatttctgcttgaagttgatccctttctttaagccagtcaaagctcctttgagagaccatgtcccttgcttcatcataggtgataccgtaaagtcggtagttgaaatcaccaagaaagacaaccatatcagcttctgccatctcaggtatatcttcatcgacctgatttccattggcctgccattatgacaatagctataaataagtattctttatttccacggaaaaatctgcaatgcagttcagcgattacatacattcacggttttatgcaattgaacagatgtagcagaagctgtagaggaaaccaaaaaaaaaagatgttatagaattcatttacaacaaactagtatttaaatatacttataagatgaaagttgagaatgaagtacctgcagatccatgaggtttgttaaaagtcatcgttcgatagatatgatcaaaatcagcattacgacggctaacattttctagatgtgcagcaaaatgattgttcacaaaacatatcctgcgatcatagactctaattcttaaccctacaccaccctgcaagaagaatgagatatcattattcaatgcaaaataggaaaaagaatagagcaatatattgctaactattaaaataattttcctctgaaaactgcagctgcacactttcacctctaaccattgcacgctcacaaattgtttctagttggatgaagtatgtgaagaaaaacatattttgagtatcccatgattatttatcacagcagtataatgttctttgcgtgaacgaaattcccagttggtatagtgcacatatgatacgctcaagaacaaacagttaataaacattttgacaatcatgtaccttgttgccaatagcacgcccaaagccacatggtactgcagcagcatcaacatcaccaacatgtggcttaaggtccttccttgcccttgaaattatcatgatgtacatgccatacatatcgtatgagaaaagtacaaaagtgcaaaaaaaatgataattatataataacagaaaaatgtttcactaagaaatggttttaagataaaccagtaccatgcagcaataagtaatccagccagctgccttgaaccaactcggtggaaggatatcccctcatcaagggtcctgccaatattgtctatccaccactgaccattggcactaccctcaagccctacctaaggccataaagcaagaaatgttgaataaaatgctcaaaactcacatagcaggcatgataccagtacaggaaatagcccagtgcagtctagatatgaaaatcagacagaaacaggaagaagggggagatgatgaccagataggaaattaaattaaattttccttccagttctcagtggtagctttattataccaataaaacaccacagcaaacaaactagcatgaaagcaaatgcattgacttcccaaacatacagctgcaataactgtaaaagacaactcttaacttcagtttcagtgttcatcatttttatactaacagaaatatacacagttctcctgtgccttctcacaaaaaaaaaactgtaaaaaggtaatctgcacctagagctctagaatgaacccttatgcttaggtatatgcagtatttgtttcaagcagctaaattagaatcatatgagctccagatagagataagaaggataaaaattaaaatgtaacatagtacaaccattttatcagaaagacaagcacaccacttgtgtttttcaaaagacagtagcgcagatacagtcatattatcagaaataatacaaattaagctgtaatgcagaaataatcttattgtgctcactagtaacctattttcctatctcaataatagtttctttttccttgattgaaccgagcaagaaaacaatgaaacaacgaaatcaaaggtagggttgagtatttcatatcttacactttctttggctgcagccatggcaagaacaccagcacccatctcgacctcttgtagaccaaccaccaccaagtcaacatcaaaaaatgcacgacccaaccatgacatgagtgattcataagatgctttctcctggccaacattccaagtcccaacaagcattttaatgttcactagccttctatacgacaactccctgtttgacaattcagttcgcagaatatcatccagagggccaggggaagctagaggccatcctctaattccaccatgatgagcaagagtaaagacataagaaccaccaatcgccatctgtatgaccggacagctatgcccagtccattctgccagaaggttaccttccacatccatgacttgaataatgccactggcatagcccacccacaccctttctccaagtgccttcatgcactgaacagaagaacaatgatgctggaattcttgcagtcggttcccatttccatcccacataatgatcaaaccatctgtgcaacctgaccaaaccgttccattcattgcctgaaccactgcttctgttcggcgattatcttcaacaaatgtcccttttgtagcaactctgcgtactgcaccagctgctcccatcagggcattccttgatttctggaaaaaattgaaagagctttgtggtttatccttcttcacgggttttgctttgatttcttcctctataaattgctctggcatcacaggtgcctctaaccgagctgactcaatttggccgtccatgccaaacacttttagcagttccctggtccgagcatccctacaggaaaaatatcagaaaaaatagttcctaacttttcaatgggccgatgaactcaaggataatgcaatttatttatgaaagcataccaaacagcaaatgccatgctagttaaacaccaaacttttgcccgggaatggtcagcaagcatgtgtttcacatcagcagcggggaacgaagatatgttgccagctgctgcattgttcctaaggtcaatatatgacctttcaatccgtaaagcagccacatgtttttcttctggcattagtgagagggacttagcaatgacgtcccagggccatgcctttataacacccccttcggatcctgaccatatttcacctgtttccaagatattgaaatgaaataaatcatttttgcaaaacgttctacctcttttagtggacattgtgaagtttaaatcttgtatggagcagaagagatgccttaatgtcatataactacgaatgaatgattcagccattgacagcgatccaatgcaacaaataaagctgaaaattaagtttcaaaaggaacaacaataaagcatcttccaagtaggcttttcacatagtagacaactaaaacacaagtgaactttaagacttcaattattaacagacagtttcttaatatttcaagaataacaaggatttatttgtattattcgataaagttctctatggtatgagtgttcatttcgtaggctaatcctattgtttgtggatgttttttaggttacttttaccttcccaaacttctccacatttatgcaaagagaaaaacgcgcccaagtgattacatccatgcaaacgcatctaaaaaagataacggaagcctaccatttgagaaaacttctaacactaatactcccatatatggatgtcatgtcatacagaacagaaaaaaaaaaactagttcaactttcagattttccatttgcaagatgtcaatattactggaccccaccccccaaaagtgtttttcctaatttatttgtaatagactaaagttgttgctaaagccctgttattttcagacgcttaaaatcagctaaaatgaaacatttcatcagctaaaatcattcttcgtgctcttttacccaataatgctattgcctcactatgcacggagccaatttttatccatcccttgcgtaatttgctcaatgaaaaatagaattgattgagatgatcaaagtaagtaatcaagcttctcaccataagacgtgatgaccatggagagcactggcgtgcggctgtgtgcctgccacgtcagggccttcctgaacaacggcgcgtcatcgtcgtcgctgccggcggcgaggtccattcgccacgacatgatcctcccatccttgtggcccgtccacaccagcgcgttcgaggcgtccgcctcgacgcagagcacgggcggcacgggcacggactccctgaagggcgcgctctcctcgtcgccgcggcgcgccccgcacccggcggcggcgaacacgtcgtcgagcccccacacgcggaccccggactcggagcccgcccagagctgccggcgccgcggctcgcacgccagcgcccgcaggaaggaccccacctgcgtctcccgcagcgggtggggccgcacctcgagcggcggcgggcggcccgggtgcatcgcggcgcgcagcggcacccggtagatcccctcgccccctccctcaccaacaaactccggcaacgccccgccccccgaaacaacccgctccggctcctccaccaccgccaccgcggcgccaacctcgcggcagcagcgctcgaggcgcgcgtcgcacgaggcggaggcgacggggccgtcgtcggtgctacgcgcgtacggcgacgacgacgacgacgacgcgctcttcctcagcgtctcccgcgcccgcgccgccatggccgcagccgccgcctcgtcgtccgagtccatcctaaatccgagctcgtttggatggaagggaagagggtgacctgtcgcggaggcggcgcgccgtggagggaagggaaggggaggcgagctcgtcgtcgtcgtcgtcgatggcgatggcgagaggcggaggagaggggaggtggggtttaaatgggtggatgcgtcgtggaccgggaccacggaggcagtgtgaaccgcacagctgctgctcctcgcccgccgcgatgtcggaaatggcagctgagctcaggccggctggttttttggttgctgctctgaaagcaacggggtttccctttccaaatggaggccgattttgctgcgatttttgtttttccttctctgaagattctgtgacaggtcaatgtaggccttgtttagttgatgaaaaattttggatttatttatcacataaacacatagtctaataacaaaacaaattacagatttcgccagaaaactgtaaatttattaagcctaattaaactataattagcatatatttactgtagcaccatattgtcaaatcatggcgcaattaggcttaaaagattcgtctcgcaatttacacgtaaaccgtataattgattttttattttgtccacatttaatactccatgcatgtgttcaaacatttgatgtgatgggtgaaaggtttttattttgggaactaaacaagaccgtattttggaaccgagttagtgacaaatggtattatactacatctgcctcattttaggtgtaaccatgggtttccacgctcaactttgatcttagtatttttgttgctatgagttgatacaatatgaatagtactttactcataacttatgtttttaaattttttaaaaaaatttcaaataagatagacgatcaaagttagacgtgaaaaaccatggttatacttgaaatgggacggaaggagtacttgtatactcgagtactcactcggttttttaatatacaacacagttgacttttaaatatatgtttgaacattcatctaattctaaaattttatgtaaatgtataagatataaatcatgcttaaagtaaattgagtgataaaacagaggtattatttggtagtactgatttgatatagggtcttatcgtttgcactatggtttataagccgttgttgaaatttaaattttaaaatttgtgtttgaagttgatcttgatgttcttttaatatagtttttttgcatttgtttttaagtcgctaagcactcatatatatttaagttatatataaattatgttacaactaattatagtacaattacatttgaaagttttttaataatcatgtgacggttttttggagactaccaaataaataagcataagtagttgtctgtatctctcagcaccaacacctgtgatcaagcaagtcaaaccatgatacttaaactcaatttactttaagacaatgacatg

SEQ ID NO: 79688 - DNA, 36193 bp, Oryza sativa
tttccattaacacgttttttttcaatctgttaaatggtgtgcgtgtgttttttttgcaaaatcttttatatagaagtttattttaaaaatcaaataaacttatatttaaattttataatcattaatattcaattaattatactctaatggcttacttcgttttagctgtcgtaaaaaagctaaaccaaatatatccaaactaggcctaactcttcatcagccaatgagtgaatgtaccgtgaaagtatagcacgaatgtcatttgaggttccattagaaaaaaaaatggaaaagcaaaataaaaagggcaagttagggatgacttaggataaagaaagagttggatgttgatttacaagccatggtacattaggcaattaaaattcgactaaggtgacattcttataaagctgtctccatagcaaacacggcaattttagttaaaaaaataaacttaggttgcgttcgttgctccatgttggaaacttatcctcccacacgaaaaacgaggtgacttattagatcatgattaattaagtataagctaaaaacataaaagaagtgattaatatgatttttttcaagcaatttttctataatttattttcaagtattagcatttttttctatttttttaaaaaagaacgcatcatttagtagtttaggaaacgtgtgcgtgaaaaacgaaggagcgaaggttagaaaagaggataaacgaaagacacgaattgctgataaatctataaatataatgcattctgaaataaacaaataaagagagagagagaaaaaaaaaaacctccaacatttttcaaatgaatcatgcttcaaaggcaaattttgctatatgacactcatattttatgtaattagcttatagatatcgcaaaacgtgttaccactgaaagataccataaaaactagtaatttgctaatttgctaaggacactttcggctcaattggagagaaaaaactagtaatttgctcaggacactttcgactcaattggagagaaaaattctttaaaaggatgaggatgcccctaaggccaaaaacttccaagctgaggtcgtgtttagttccaaagtttttttttttccaaacttccaacttttccatcacatcaaaactttccaacacacataaacttccaacttttccgtcaaccaaatttccaatttcagtgtgaactaaacacaacctgtggctagagcgaaaatggaatatgatgtatgctagcgatatacttggggtgatggcaaatttaaagttgcataattttcaaaatttcactccatgtttgaagcatgtggtactagggacattctcgtctttcataagaacttatctcttcaattgaggcgaaagtgtcctctagcaaattatcaggttttagggtatcttttaaccgtgacacgttttttacgatgactaccaacaaatcacacaaaatttgaatgacctgtagcaaaatttactagcttaaaattgatgaagagggcaaaacctacacatcaaaatgtcacttcaagcccataatcctacccaagccaacatggcccaggctttgagggccgtgtctacgtagcccaaaatcaattaaacaagaggttaaggagatgttggtttaggccctgtttcattcagcttagaattattataatctgtattattagaagtaagctgaaaataaacaagtagattattatgatatattattataatctataagctagattagtataatctaataatcttctagggaggagctttttccggattattgagtggctaaagacccactacccttagatgcttccaataatctagagacaaataactcgtagcttattctaaaccagcttattataatccagcttagagtaatcaaatttaataatcttgattaaaaaaatcttaaactgaacaaacaagcccttagctaggcctaatgttggaacagccagaacatcttgctttttggtaggcttgttaggctttgttattccaactagaaatttccttttgaaaagggaatgagaatagcagaaatatgttagaatgtaaattaaagaattaaccaatccaaaacatatggaaatttacatgaaatttgcaggagtttttaacccagatgttttgctctttttttttggggtaaaaatagagaaactgtttcttctgcaaaggaaagcaacgctgtctttgctttgtccaaaacaaacttaaggccccatcaaacggcatatttacaaacgaaaaataattcatgaataaaacttttatatacgtgttcttatcgatctaaaagcaacgactgaaaaataaacttcgatgaaaaaacctcaaaatcagcttcaaatttaaggttacaaatttaaattttgactaataagcataataataagtgaaaagatgaggccatcaaggaaaaacattctacagaaataaacctgtcaaataaaaagttctatgtataaataaacaggcaagtgtttgactttcttggcctaatgtattaggtattttgacaagggaatgttgctctttattacttatccattttgaaatatagcaccctacatgtaacattatactacctccatttttaaatgcataatgtttttaaatatcaccacttattttattaaatatatatatgtaaatataatttattatgttatgacttgttttatcattaaatactttaaaaatggcttatattttcttatgcacactaaaattttaaataagatatatagtcaattgtgaagcatgaaagtcaacatcgtacgtgacaaaggaaaaaaatatgtgttgttaatacattttctaatcaaatattactgtaatgtacgcctccctaaaaaaacaaaacactttcaggctcatcctcgtaagttatattttttcgggacgatggaatataaaatacgagtattttattatctacaaagataatatggccttatccgtaaaaaaaaaatcaatctaggagtgaatataccccatataacgaatctggagtcccgtcctatcagattggcacagctccatctcccatataacgaatctggagtcccatcctatcatattagccaaacagtttcgattttgctatatctcactcgaaagattttttcttatctctcactcgattttctcactcaaatttacagtgcattttcttgtaagttacagtgtaatttataaaacttacactgtaacttttgtaagttacactgtaatttttgaatcttcacatgtaaattttaaattttgtattggatttggtctttttcttgaggatatggtaatttaatattcattatggtgtttcttaattgctttttgctttttattatatctatcggattttaatataaagattaaaaatctgtgtgatacgattataaaaatctttcgaaagatgtataggtactcccaacagttttgtggagctctatcacaaaataaactatagagttgtggagctgggtttatgcagcttcacaactccactccagaccctgaagctaaatttaaaagttggagttgtaccaaacaggccctaagtttttttacggaggaagtaaccacaaagttatgcaacaaatcacctataaacatcctgtcatatcaagataaatcatatggcatcatcagccgcccaacaataggcataagccacaacgctgtggatctcaaagaaaagtcatgacaatgtgcatcaccacaccatcagctgcccagcatcaattcttccaaacgatccaataatcccttccccctccccatccaaatcaccttttaattattctgcgtccgcgatttcgcaatcacccgaattcatttcgtgttatccccaaatctcgcgtcatctctcttgacctgggccaagcaatcgatcatcccgatccactcgggctttaaacaaatcgctgcaaatttgttgttttccccttaaatttttatgccaagatcgcttaaattcaaccggccaggtggggatttcctaggagaggaaggcgatggcgccgccgcggaagcagcagcaggaggaggagatggttgccggcggaggcgaggcggcggcgctgcgggcgccggcggacgtgatcgcgcgggtgttctcgcagctggactgcgtcgacctcctcagctgctcgctcgtgtgcaggtcagtgagcagagcacgacgcgattcccggttcttgcacgcggcgtgttcgacgtaatgcccaccccgacgcctcgagctcgctcgatgcagtgaatcgaatccgttttgctcgatctctccgagtcaatggctatgatgtagcttgctgtctattggtatctgccttttgcttacaggctggatcatagctctgctcttaacagtggagagttgaattgatgatggatcatcgctggtgaattagggagatccctaaatccgattaattttcgtgttttaagaacatttcggtcaagcaaacggccatcatatttcttgctgaattttctgaccaaagtgaaactacagttagtttaattggtgcttgatcagttgctaaaagaagtgaatactcttttttttttttgtaaaagaagtgaatactgaacacaagaatattcatcttttcttctgttacctcaagcaatttgctcagtactagtacccttctgacctgaaactttgctcatcattttgtgaatcatcaggcaatggtaccgcgactccgcggagctgcgagaggagtggagaaaggagtacatggaggcctggaaccagtttggtctctacgtcaagcagcagccgcagcagccatgcccgacctgctcaagctcgatcagaaccctgcgaggcctgtgttcctgagaactgctgctccctccattccctgtcctgccattttcacaaaggcaaaacatttgtagatggcaccaacttctgtattgcacatgagcattggtggtggcagacttgtgtgttttgggtagtgtcagtgctgcctctgcaacagattcatcagtatgtgtgtacatggtgaataaaactgatgttagttacatggtggattgctcttctgtataattgtattgttgattggtgtgtaatgcagtaatgcaatgtgcctcttgatatatgcaagaaaattcatgtgaacaaaaccaaacagcaaattcatgtgaatctgccattattgagccaccaaaaaccaagtacatgcacacaccattattatgaacattgcctctaggccctgttcacataaacccctccagctttgcacaacacaaagcctgataggcacacatcaagctcaatctgatggattttctacaaccatacaacacagcataatatcaccaaattcctggaacttgcaatctgttataagtgatataccaaccagtactataatatatgtctgacaaatggtttagcgcaactcatgaaagtcttaacaaccatctactcatctagtaggtaacaagtataagatccacaacttaaagagagatttgcatgcgtgtagacctaaaatatactccacttaaccattgctgtaacatttaatctcacacgatatgtttctaggatagtgatgaagaactccatgctgcttgcaaaaccgaagccatcattcagtcattgcgttcggcattggcctggaggaggccatctcttatctgcgccgcgacatccttgactgctccggggccatgggggatgaacactgaggtggacttggaggaggccccaatctccttcatggtgtcaaagtactgggtaacaagaaccatgtccatgatatcctttgcagtggttccagggacattctccgagaaggcgagcacgctgtctctcagcccatccactatggcctgacgctgcctcgcgataccgacaccagccaggtacttggactctgcctctccttcagctttcttgatctgtagtatcttctcggcttcggctttctcattggctgccaccctcaatcttgcagctgctcaacaataccataaatcaagatgttagatggaaataattctgagtacatgttacagaatcaatcaaaacaatcaatgtgtaaatgattatgtgattgatggaaggaactattgccaactcagtattcccaaaaagctattgccaactcaatctttggcgagaagatcgaaagcaagcaacaattatgcagggaaagggcaatggttacttgcctgcgttgatctcattcattgctctcttgacatggacatcaggctcaatatcaatgatcagagtttgcacaatctcatacccatatgcagacattgcctacagcaatcataaatccagtcagtccaaaaacaaatgttttcttgtctctaggatagcaaatagtagacaaaccttttcaagctcatcttcaacagcctttgcaatatcattcttctgctcaaatgcatcatccaagttcagctttggaacagtagctctaatgactaaaagataaacgatgtcgcccaatgagaaacgtagaattcctttcgttcactaattaaaaacttagcaggtatatatgatgctcaaaactgaaactgttaacttcaactagcctagcaaagaacacacgaagacaaaactatatatgaaaagagatggggacttcgacatgtgaaatagaattttcagacagatggaagtgcagaacatttaccatcaaagacatacgactggatttgttccctggtgttgcttagtttgtagaaggcatcagatgccttgtcagcaagagcacggtattgcacagatgcaacaacagtgacaaagacattgtcctaaattcacaaagatccatacattagagctaggaaaaaatatacctagtgagttatctcaaaaatgttaatgaaatatttctgttcttcactcatactgagttagtgagttatctgggtttcactttataacagaaatatgttcttcactcattgttcactttccagcaaagcatgaaaaaaagaaaaaatagaacgagattggagtaaacctttgtctttgtttcgcagcggacatccagctgcttcacacgcagtgagaggtaaccagcaatttgctgtcctatgcaccaaggtaagaagtggcacccaggctctagaacctcactaaacttgccgaaattttctttgatggctacagttgactgatcaatctgtactaaacccaaacactgacccatgtcttacctgcaaaggaaaacgacttaaacttgaaagatggttcagatactgcagaaagtataattttatttatttatcatctcacaagtgaagcttgcaatgcaaaatcagtgaaggtatcactgaaaagcgaggctacaaattttaggatatgcttcacaataatttgtacagattgaagttaacagtcccaactcccaagtaacagttagaaaagtgtgaatcatgcccaatcagaatgacattacatgatgacaaatataaagtagttcgtaatgcagctcaatgctttgaaaattagtaaatctgagacaccacaaaacagctcaatcatatcaactcgtggcacaatatcaaattcatcccccaaagaactcatcccatctaattatttcaaataagcgcatgcttgagacagtaaaaaaagtggatcatatgcaatcaaaataataatacatcatggaaacttaaaatatatatatacatatgaaacaccacaacacctcgaaaaataagtcacaaaaaaacattcagcggtatccgttagaaaaactcgaatcactaaaaccaactgatcagatcagtaagcaccgcaagacaaacgagtgttggcatggcgcactaaaagaacactgggatcaaaggaaacgatcgccaccaagatgcaaatttcttggccacctaaaggcaaactaaactagcacacccaaactacataaacaaacagatccatcacacaaacccgcaaaaacgactctcgaaccaaagctttttagtagggtttaaacacgctgaatataccccacaaaaaagaagaaaatatttcttccactttaatttttcacaagcataaccatctcacaaaatccccccaaagaaccccaggcccgtgcccgcattaccaaaatccatctaatactcggagaggagatgaaaaccttcaagaaatcctcgaaaaccttcttaccttcgatcgaggcagaggagaatccgacgaagaattcaaattcgccgaagtaaacactgagaggagatgattcgtgagcggttgcagctttgatttgctttggggttttgagagctccatcgtgtgggggtctatatatacacacagacgcggccgagaagtagaggcggtgctctttaatttaattaattaccgcgatggacggcccagatcttctctcgatgacgatcggacggcggtgattcgcctgtccgtcgaatatggtagtcgcggatacttcttggtgacgggaaaggactgtaattaggaaatagttttatttttggtcgatgttttaagaaagtttctagtagggttttattttggtccatatttacaatgtcctgatcgatatatttattaccttttcttttagaaaatgagataaaatttgggactacctatatttatagttatagcatcatatttttcaccaaaaaatagttgacatgtatttacattgtaagttcctaaattacatatgtaattttaatgtaagtcttaaaattacattacatatgtaaataccaaaattacgtattaattacatatgtaagtgatgtgtaagtggggtgtaattttttagataatggaagctttattaagactcagtcaaatataccaagatgatacatttcaactgagctcacccccggcctctgcataaaatgcacacaaccaataaaaggacgaaactaaacccccatcacgaaacatagatgttagtgactatcaatccgtagactagatcgccacctatgctcttgggtaaaaacatcccgtgccacctggtccaaacgtcgagataccaccgcaatagtatcctgcaatcccggtttgtggaggatagcccaggtacgcagccaccgggtaactagagtaataacctgtaaaggagaagacactaacttgttataaaaaaataaccccgtttctgcttagccaaatggaccaacaaagagctgctgcacccatcaaaagcagatttctcatttctttaggaacacatgaaagccaacgcccaaacatatgagtaacatttcaaggaggttgaaagttagaggccatatgaataacggaccataccaaacgagatagatgacattggaagaacaaatgttgaatggtttcatccttatgacgaaagcaacattttttactgcctttccaattttgtttagctaggttatccttggttagaattactccccgacgtaagtaccaaagaaaaacttttacttttagcggtactttaatcttccaaatacgtctattaatatttgggacgtccgtatgaacaagagctatataatgtgaattgaccgagaagaccccagtgggatgtaattactgtgcaaatttgtataaatatataattagaataacaaatttgactgctacaaagacaggaggtggagaaacggatgttcattgtgcacacgatgtccagcgcagcgcatccaagccattaaaatccaactgtactcagccacgtaatgtagcgacactttttcagcaaatccataaaattttggtcgagaattatggtggtaacattgacaggttttaaatttttggagtatattttccacgaacccaccgggaagtaccgtgtaaactttcaatacgagaagagaaacaacatagactaaaaatatcgtcgattttctaaaaatgagttatgagatatttctaaatgtgcaagcatctctctgtcacatttcctttttatgtttggaaagatgtacaatatatatgaaaacaggaatggtttccaatggtccatatgcaatgcacatatataggaagattatatccctaaatgatgacctgcgtgaattaggaaggacacattattggtataatataatagcactggcacacataattggatcgttcctcgcaagctactatcttcgagtaatacttgaaattgcaagtggcatcctgcatcattacaaggcctaattgaatcagcctttaggttagacgttcgatcgagaggcagtgatacacaaaccaaaccctctgtttggaacaagggaataaaatcgaattttcgccaccaaaattcttccatcacaaacatgactaaatttgtgagtgctgatttctgagaaaacatatggtaacattctaataaatagattattcgtggacacgaggatttgaaattacaagcaatatactaaagagaacttttcaaagatatatctttagaagcgtggagcaagtaatgcacggcaataatctggtgaatacgcagaaaagaacacaacctcacattcacagcgtgttcatgagccaagaaaatttatgaccatgcaggaaattcaggttttgcaccttccaggaaacagtgtaggaatgatggcattgccttctttaagcgaaatgcaggtaaaaccgcggggtgtgtatcactatccgtttctaggcaaaacgcagagaatcacgttgcctctgctgcaggtctgcaaccaagacttggcttgctgcaagaaaacagtatggctctctgcaaatatgcatccacaagagaacaagagatgcacagctgggaaaatgcctatagatcaacaagagggcattttttggagaacaataatgcactcacaacagaaccacattggcatatctaccaaccatttttgcattttagggtatgtgcagtttcgcataaacagtctggtaggatgcacctatgcctcctaaatgatgtaagggcaatcattaggaggatcattgtgtaattaaattaaccaaagctagcttactttggaggaaaaatatatagaaaagggtctatcagcatccagttaaaacctcagtgcaaacatccacaagggaaatctggtacctacagctccttttcacctatatccattttcacatgtcaatctacaggaaagatcaattcagattgcacaacaatgttcagccaagccactcagccccccaaccaagttccaccaactagaccaggattctctagttatttcacgttcggcttgggtgagtagcggaacggggaagcacgggggccatcggacaggctcctcatcggttgctgcccgttccgagcaaatgaaccctgcaccttaagggcatggctcctaccattcatgctgcttgagtgcgccattctctcagcttgcattgtctgatagaagtacgaggagctagccatgtccttgaggttgagcagtggcttgagaacctctaccacttggctcatcagtggccgggctttcgggtcccggttgagacaagcacgtgctaactgtgctgccttctgggcacctttgaccgagaagttaccctccaaacgagggtcaattagcttgtagaagcgctgcctttctcctaggagggggcgtgcccactcaacaaggttgtgctcaccatttgggcggttcttgtccattgacctgcgccctgacatcatctcaagtagcaccacaccaaaactatagacatcactctttgatgtcaaatggcctgaaaagtggaaaaaatacaagaaaattataccaagagtcataatgaaaatcgcataaaataccaaaggcaacaaatctgtgtttgaacttcatttgcacaaataatcattgaaaaacccagtgcccagcattagcctaatattcaaaaagattgttgatgatatgcaggcaataatacattttcctggaaatcaaatgaatgacaaacatctaccatatggacaacatcacttaactctacagttgcactcttagacatatttgttttgcccctgcaaatgtgttttcacaacagtgctgggatttctaatcaaacaagacgcacttgtgcaactactattaattgtaatgacaagtaattaaatattatggtatttcccttctacattattttcccaagatcaagtgtaaaggcttaatatagttcataaatagagctgacattaattacattaatcatagccaaagaaactaattgatacactgtatacatattattaattctaggaagaactaactaaaatattttgtatattacattcacaatattttgtacattaaccactaatctactatatcatgacaattcttcttataatcatttccattccatagatttaagtgtcgccgataagagagaccgaaagaccatagggtgcataagctgatcgttgatgcaagaactgtaatagtaaatcgccatagctgacttgtttttggcatacataggagagataaaacaaagtggaagtggaactatcttcagaccagttatgttttgtctgagtgatgaccagggtttcccaaaccgccggggccagggttaccgcaccccggcagtaagcacggttaccacgcagtaaccgcgataaccgtgaaaaaccatacaaaaccgtgcaaaatttatcaaaactttaaattattttttaaatttatttgaatttaaggaggttactgcggtatttatattaccgtacccccgcggttaccggcggtaacgtcaaccctggtgatgactgatgaagcacttacctgtcataacatactccggagctgcataaccatatgttcccattactcgagtagacacgtgagttttgtcacctacagggccatctttggcaagcccaaaatctgagagttttgcattgtaatcctgcaagagtagcataatatacaaaattacaagatgtgaatcgtgtggtgtgcaatacgtaatccaattcaaggacttaaaacttacagcatctagcagtatattagatgttttaaaatcacggtaaataactggtctttctgcttcttcatgaaggaaagcaagaccctttgctgctccaagagcaaccttcattctgatggaccaagggagaggaagagaccctataggtgaatcataaatcatataagattcaatatttctatctatttaatattttttccagcagcaagatgcaatgaccaaacacttcagaagagctactcaaatatgaatgataagttcattcattaaagcacaggcattgtatacaaattgaagtttcaatgtcttgagaaactggtcagacacgtacttctgaatagatggttatctaaacttccacgaggcatgaattcataaaccagcaatctttggtcatcttcaacacaatatccaatcagcctcaccaaattgggatggtgaaggttacctaggaaatcaacctctgcctgaaacgaagcagaacaaatgtcagtcattgggggttctaatgggaatggtaccaaacatgaacggaacaaaagcaatttgaacaataagaataacaaagcacataccacccattctttgtgcccttgaagcccatcatgattgagtgttttgacagcaactgtaaggcctgtaccaggtttcataggtgcagttccattctcttcaatccaccctttaaaaacacatccaaaacccccctctccaaggatactctcaggcctgaagttccgggtggcacattttagatcattgaatgcaaacttgcgcaactgtgaggcaacttttatttcctctccagctttagatgctgatgaactgctctcagcattactagtagttgttgagcctgagactactgatacaactggatggttcctgctaccattttcggttgacttttctgctgttccatgaaatggataacagttttaatatggcatactaatgagaaacgaaagaccatctcctcaacaataaataaaccccacaacactaattcagataaacacaagtaatgaaattggcaaactgtacagtaacttctgggatacagctgaaggacacagtgaagtgtaaagtttagttttggtctttttgggtatggatcccaagaaaatacgactttctcatgttccattcattcatgtccatcaatgaatgcttaaagcagccaagcagccttgatgagtgatgactcatgatttcaaacaccacatctgctgtcaaaacaccatcaaagtcaggtggctgatcctaacatatcaacaaccattcctgactggagaaaccaatggtgctcatttatgtgtgccgttctaattaatttgctacgagattaagtgtggcatgcaaggagcacgaacaaccacatgccacactaaaaatagaatagaaaccccaaaagaacactcatgccactggtcccatacagtcgctcatccaatatctatcttccaatttaaacggtaataggtagtaatgagaactacagctcagcttgaaatatgatgctggatgatatgtatgatttgccgactgtttaccgataattacgtgtcctacacgcttgtcgtaataattactagtcaatttgtacattcaatgcccaaaacagggacgcgcgcaaagcgctgaggattctaagtacaaaaacatagctgcactcagctctctacaaaactatatgcctatgcatacgtactcgacatttacattctaacctactataacctcagcgctaatcaaggccatgtggttacatcacatctaaatatccagacatatttatggccaaaatccatttacataacagattccaaattccaattatagtcgttgcaggttagctcatctttagaaaggacgaaagggacgttaccgccgtgcgtgctggcgctgctggtggaggtgtccaccttggaccgcggcggcggtgggcagctccccatcggccacagccggatgcagcacccggtggccaccgtggcgtcctccccgccaccgccgccgccgctgcccttccgtggcagccgccgcctgctgctcccgctgccgctgccgctacggctcccgctgcggctccggctgcggcggcaccacccccacctctccctctcctcctccccggagctctcccacccgtcgaactgccccagctccggcggcgccacccccatccccacctcgcactacacacactttcccaaaaacctcacaaagaggagagatcccctccaccaccaccaccacctcctcctccaaatcgcgcaaaaccacctcactccgggcgcctcggacgcatcagatcggccacaaaaccgccgccctcacgcatcaacgaaagcaccaaaaatcaccaccgccgccgccaccgcagaacaaaatcccaccagtatttccgccgacgaacacgcccacaaatcaaaccaaaccaaatcaaatcacccccacctacaccaccaaatctccctcaaccccaccaccaccaccaccaccccccatcctcacccaacccaagctcaccaccacgcccggcttaccgcagcagctgaaccaggtagacagcaggacagcccacctgcctcgctcgccggcggcggcggcggcggcggaggaggaggaggcggcggcgagaggtggagggggaataagcggagagaataatggatttgcgtcaaaagaaggaaggaaggaggagacaaggaagcggaggaaaagcacaaatgttcctcgcttcgcttcacactctctctctctcttctcttcgcttttttccttttttttttttttttgtgctgcttctcttcttcttctcggctttaggggaagggagcacgtggtctacgtggaccgcttttgcagcgtgcggcggcactgtcggctggggcccgcggcgaggggtggggcccaccgagccgatgtggcgctgacgtggacgtcggcgtaccctgcacttctccctccgtttcgtcattttaaatcgaactttttttaaggtttaattaagtttataaacaaatttaacaacattgagaatgttaaattaggtttattaaaggtaatgttgaatatattttgataatatatttattttgtgttaaaattttgttacagtttttttataaagttagtcaaaataaaaataatttgattaaaaagtaaatcgtaatagcttagtaatataaaacaaagagagtactgtgtaatcttgttgtttttgcagggaatgattggggataggggggaatgaagggctgtccctttgtgagatttttttcttgtcccagttcgtcggtgaagagattagagatgtgaagggttacagtgctactctcgtcgtttcttagtttgattttgttggcgtccaaaaggtgtcacaaactcataatttgttaacctagcgtttgcttgattggttatacacttttattacttctcgaattcgcatatggtggactctaccttttttttttagaacatcgtaaactctactggcatagttatctctaacttattgttgcccacattttatatgacatgttggcatgtttcgattagtgctaatttataccatacgattttttttaaggtaaatgtgataaatatatggatgcatttagtttgttaccaaatattagtaatatctagagaattttggcaacaacacatttagccttatcaaaactttacattgttatcactttactaaaattttggttttgccaaatttttgaaagttcattttggcactaatctaaacatgcatgtctcatccctttgacaaagtgaggtggagcagggggaagcattagcggtgtgatggtggagtcgtgatgcatgtctccgcccactacgattcaagtctagtgtcatgaatattacgcgcatataggtgggttttaataggaaattagtgagttcaatgcacatgtccagataatgcagcgtgagtgtagtgtgagtgttctatagcacatgacaccaagatgcagtccagatatcatgtggacaacgagaggccaacggtgaggcatgatatcttaggaaaagtcatgtgctcgggttgtgcatgtgcttctttatgcgcatcgcacaccctcatggacttcttcacgcgcggtccatgcgctcgtggacttcttcatgcgcatcatatgcccttgtggatttcttgatgcgtgatccgtgctctcgtggatttcttcatgcgtgatccaggcattcttcggcggtgaggagtgcacccccgccgagctccgcctcatcggcacgcccatcgtgtcagtcccgcgcaccgaccggctctggcgcatgttcctcccgcccgccgccgccccgtgctgtttcgccatggcctcgccgtcctccgccgcagttggtgacgatgacgcggctctcctccccgccgtcctccgccactcccgtcgcaagcgccgcggccgctcccgccgtcctcaagccccggcggccgacgccgccccgtgcccctctgggagagaagatagacagagaagagagagaagacagacaagagagctgacatgtgggcccaagggcatttttgacatttcacatgatttctctcctcttcaaccggaaattattattctaatcgacgcggtgtccattggcaaattaccacgtttatggagtattttcccccaaaagtgagttcgagcggtgttccacggctaaaactacgaagtcgaagtgtcctttagcaaaatttgccaaaaatataaggcacattttgtttaacaaggtaatccgtattatccaagaatttctttactaatatattatttatgtgacactttttttactaatatattatttatgtgatttcaaaaataaaatctaatatttttaatacgaatgcaatcacattaatttcgtatacaaattatacctaattaactaattgttgatcgcccaaatgaaacataacatgtctaatatatttcgagggagggttatagctgctcttttccctcaccttccctcctccatattagcagaaacctatataagagatatgctaattcttgggtagtagcagcggtgaggagctagctcccagacaggtcggacggctttctgggttcggctgctagcgtcttccttatagatagctgttgatgttaaaaaaatcgatcgatcaccaaaaatattagtattcgctcgggtttcacgacatcactagctccatcactggttagtagatttgaaaatctgtgacaaagcaaaacttcaagtacacgttactattaggtaagttggttgcatcgtgtgcttcttgtttttgcatctccgatccatgacgtccattttgctgacgtgactgtcaattattccgaccaaatatcaaaacgttcgtgttgacaaaacggccacatctaacatgcactctcacatgcaccggcaaaacggcgctcgtttgactctcgtggagtcgtggttaatttaatcaaattttcttctttcttctgcgtattccaaatggccattagataaattaagcaaagatcggcatggatttttttttgcagataaaccgatcagcatcggaagatccaagtatgcttcaactgcattgcattagtcagatcacacgtgctcttttggtgtaaatagtacatggtctcacatgtatcttgcattgcattattgccagttcagctcaagacataaacaacggttttagagaaactccaggtcaaatggctgccgactaatctcccaacccagctggtcaacgttgggttccgtctccacatgctattagaaaaataatttaaaaatagcatccaatgtgtcactgacatcagtgacatgtgggtcagtgagttaaggcctcacttagcaacacgcattggatgcttatattttgtaattcccgcatatctgcaatgatatattgagtcatttgtacatttaaaataaacaaaaatgttacatatggttacttttttttctgatgtatgagaataatatgtttctgtacaaccacaaaagaatcatatatgctaaagtcaagacataaaagaatattagtcggcctataaatctcacaatattatcaatgcacaaactaactattatcactggatgcctttgctcccttggcaacctttatgaagacatcctccaaggtggtatcaaccaggccccaggcatgcacggtgaaccgtttcttcgcatcctcaactgcgcgaaatacctcggctattttcacctcttgctttggcagctcgaactttaaagaatcatatatgctaaagtcaagacataaaagaatattagtcggcctataaatctcacaatattatcaatgcacaaactaactattaacactggatgcctttgctcccttggcaacctttatgaagacatcctccaaggtggtatcaaccaggccccaggcatgcacggtgaaccgtttcttcgcatcctcaactgcgcgaaatacctcggctattttcacctcttgctttggcagctcgaacttttgagttccagataggtggtagatcttatttgcgctcggagacaagtcatgaactagccgttcaacctcttgttcttggtctggagatgttgtcattgtgaatatgtatgctcccccatatctcgcctttagctgcattgtgcaaatgaggttttagatctggtcataaagcacacagtgtgattcaagaaggcaataaaatgtacctccttaggatttccaagacattggaaatcgccatcgacaaagatgccaagtcgatcacaaagtacttcagcctcctccatcgagtgcgctgcgagaatcacatttgatcaacactatttgatactcttgtaaattttaaaatcaataagtgacgcgttaggaatctaagaattggacgcgaaagtagaaagggaaaaggataagtactagtaagaacgatcgcacggtttcgcttggcctccttcacaacattccacaagttatttcttgatgcggggtctagcccagtgcttggttcatccatgaaaacgacctacagaatgtgttgtcaggttgcataacacattaacaaaagaacaaaaggacatcctatggaagggttaaaaaaatatacagaaaagtactttggggtctccaatcaatgatattgccacactgagccttcttttcatgcctccgctgtactttcccacttgcttatcaccaacaccaccatggaacagatttacgctcttcagagcatcctcaacagcctaacagtggaaaaatcccagacatggttcaaatacaagatgtacatatgctgagatagctgagcagtatagtttatgaaatacgtgacaaaacaacttcatatggtcaacaatgaaatgtggatattaaatttaaaaataagtgaggcagagtagaggtaccttcaccaacacagcacctttaagattcttcagcctgccataaaagaacagatgttcttttccagtcaatggttcccaaagtaagctgcatttcagattaaaacgtattactataaaaaaaataatctggtctgggaaagattctttttggtcagataagtgctagttgtagcaaatactcatgctgtgggcacacccccatgtttgtatatatgtgatccatatccatattgatatccattccatgaacataggaagtaccagatgtaggtttaacaagcccaatcatctggtaaaataacaaaacaaggttaataaaggtgagctgccacaactaagcaattttcacaaaaaatggtaccacgtgccattttagtactataccatactaatgaaggatgttttcccagctccatttgggccaagcattccaaagcactgcccttttggtacggcaagagataatcctcgaaccgccagcttatcagggtttccatcccttccaggatagatcttcttgaggttgtgacatataatagcttgatttgcattgcggcctaccaaaagttgctcaactacttctctctggatagaatttgtataatgaataaatttagaacatatgtactccattaaatctggactggcaaagtatagcaggtaacctacttcttgagcaacatctggcttctccatatcgacaattactttagaaccctgttgcacaaagctaggcttctgcaatgacggtgtgtgcttcttctgtaaacacctgaagaagaataagggccttttcctgacaccaccacctactggagagacttgatccaaatagaatgctaacataaggagaaatgcccattctactgtcatgatgataaatataccacacattccattgattgggtctctcaaatttccccatgtcatgccagaggctcccatagcacttccagagaaagcatattggccaagttcatatagtcctcgatagagggaaaatcctgggacaatctccattactaacaaccaaccatctgagtagaaaacaaaaatgcttgttacccatattatgtaaattaagttgaaaaatacaacagatataataacttactgggaaaggtcctgtcctcaacaaagaaacgaaaaagaaatgcccctagcaagccagagccaaatacataaatgtatccaatcactgcaggaggaaatatgtaatttgtgacttccagtaagaaacattttggacttataacttacaaggttgaatcactaaccagtggctgtcttgacagatgaaaagaaagatgccacaaaaaatgcaagtgcaatctgcaaatttatataaatgaagaagaaagcaaactgtatgctgtagtcattgagtctgaagaaatttagacctacaaaaaaaatctattgaaatatctagatttatttgtcagaacagcaccttcgtgaaaatagattggaagaaaattaccaattaaggagccaaaaatcacaaaaaatgtcatatagataaccgatagagcaaagaaataagcataagaaattagccagtaaggcccatccttcagaccatgcatcttcatcataatttttagcttttgttccttctcatacaccagatatgtcaacataacctggaaaagagagtcaatttgcaagctgtacaaatcctgaccataacacactcaacactccctttttcttttgcatctgaacttgttaaatcacatcatactcactgggaaaagtagttcaactatccatgtgaagaatagcacactgagaagagaagagagatcaagcctaaaccttgttccaactttgggcatctcttttacatattcaagcagcatatccaccccacttcctctgataaattttaggtatgcattggatatctgcaggaaacaaagcataaattgctgaattgtcagatggttctgtaatacaccgaaattactcaggacgaagttatgaaaaggaaaacatactgcattcaccaatcgtggaactcgtaatgctgcgataaatgaatatgcagtgttatcattataagtagagttgtaccaaacatttatattgaggtcatatcctgtcgtgttcaagaagtcataacctgcagagaacaattaaactatacagcacacatcattgcaaataaccaccaccatttatacgaaaaactacatttgttatgttttgaagcaattatttggagatggggccatggaattatctgtactatgtgtggcattcaaaagcagtctgttggaaggtattcaaattcaaaatgtgaaaaaaaaccactgttacacaaactcattctggttgcaaattgaccacaaaatggtcacattgagatagaaagataacctgcaacaaactcatttgtttctcctcctctttgtacgtaacccttaaacagttcatagttgataactgatgcactttcacgccacaacatctgaacttcaatacactgtatatctggttcattcaacaggacatcagaatacaatctaggcagccctacgaaagagtctaaatgaacgatgaacatattgtatttattgttgtcaaacagactgcataaatagttaggaaaagctacactacacaacgtactagacatgtacaagtctcaccacacaactactatattccattatctaaaaaaactagttgtcttgtttctgtttgattgtattgaaagtagaaaccatgcaaaatgaataacagaacaggaaaatattttttagtcccttcaaatgtaaatgaatttgtacaggaaaagttttgaattgcatatttgcatccctagcctgacttactagcaaagtaacttaagtttttcaacacaagtcacaaattcaacattgcaaagaaggaagctttaacttaccgatatgtaagggtacgccccctgcattgtatggaatggtcccaaacatgaagggcatgcaacgaggctggagaagatgcaaagttttaccagaggaaaaagcgggctctagcaattgggtataccatggctgtgtgtctgaaccctatgacaaatcagtccaaccaataactccataagctatttttcaagaaaaaagcgtgatctacaagatgtatactcatgcagccatcgaaggaactcacaacaactatcctggagaggatatcaagatagtctgtcacttgagagggagaaaagggaggaggcatcaggtagtctgtcacattaggcaacggataaagggcaggaaacacccgacctgaaacacctgtcaattggaagtactcaagaactatgaacacattcacctaattttttgaaatatgaaaagttcaagtattcattttagcaatcgatcagcaatatggaaaatatgacacatacgctcagctaatgtttggttctctccagtgacgaggagagtgacagggcaagacccgtcgccacggcacaatgggttaggcaaatcgtcgaacggctgcgatgcggtcccgacagcccggaaccctggccaggggacctgaatcagggccggccaccgtggtgggctgggcacctcgcagctccatacctgctccagcgtcgagtgctggatgccgcactccttccgcaggcaggtcccatccaggtcactctcggtgcattcgcagccgcactggtacttgggcttgtcgagctccccgttgatcacgttctgaagcacgacgagcagcacgcagatgaggatcgggaagacggtgatgccgacgttcgtcttcaggttccgcctctgcacccgcagccaaagagacaagaatcagatgccaccaccaaaaaccatcaaccatatgcctcccaccctcccaagaacacagatgaaatcgatggctgcccatcatccatccaaaagccccaaaccagagcagcatgattaaaccataagaaccgggcaggcatatccacaaacacgtcgcgggcagcaaggcagacacagagaagggatcaatcggtgcggctttcctggaagcagaggttcttgcggaggagggcggaggcctgggtggagaagctggcggggctcctccccctcctcctcgcggaatcgtcatcatccatgggagaggcggaggcggaggcagatggggagtagccgctacgcttcggcggcggtgaggagaagaagaggcgttcggagttgggattttgagttaaaccgattgattgggtttggtttaacttgtcgcggtttatatatgccgtcgatttctcggctcggctcggctcccgccaaatccgctttctccgtcggtgcttagggactagggactgtctatgctatcgattaaattgcacgtacggtccctatactcgtatactactgtcctgtttggagaactaactaagttattttgaaagctactattttttatacaagaaaaaaacctttaataaaatatccctaagttgtttggatccaaggattattttgagagctatttgacctttaatgcactttcctatgatttagatttatgaactactccctccgtttcgaaatgtttgacaccgttgtctttttagcacatgtttgactgttcgtcttattcaaaaacttttgtgaaatatgtaaaattatatgcctacataaaaatatatttaataatgaaacaaatgataggaaaagaattaataattacttaaattttttgaataagacgaacggtcaaacatgtttaaaaaagtcaacggcgtcaaatatttcgaaacggagggagtattaaaatatatttttgggtttctgaatttatcatggtgagtgctatatatgtctaaatagggttcactccgcttcgtgcagtgacgcaacatgtcatgtcgatacgtatcatccagggtttgcgaaaccagcggtaatcgctctgccaaggtcaaaatcgtggtaacaccgctaaattcaaataaatttaaaaataatttaaaattttgataaattttatatgttttcttgtgatttgccaaggtaaccgcgtgcttatcactagggtgcgctaagcttgctcccgttgataagggaaaacccgcgcagtcacatataaaaagaactaaaaatatattttcttctctctgttttttaattttatttttctatgtaactgacacgtgggttccactaatatatagatgccaccatggcatgccacgacatgttaaaaaactaaatatgtgttttgagagcttaaggaaatagatgacatatctacacaagcctatagaccacccgtgcacttccctctgaaatttatatgtagtacgcttagtgtgtaattatattgtaatttctataagataaaactatagtactaactttcaaaacccagtaataacgcattatttccgtcaagtgaaggtcgtggggccaaacccattcatcccgatggcgtgcgctgtaattttttcatttccctcctgcattaatcttgaagcaaatataacgattcaaaattatgtaaaagtcgcatacaagttaaatagcaattgtgtataaattacaatgtaaaattattaggagaaatttatcgacaagcaaaattgtgttgcttattgacatgaagtactgaccatagcggtagtatattgcattattgttgttaccctcgtactccctccgtctcaaatcaaatgcgagattgatttatttttttgacggagggattatttaggtcatagcagtagtagatctacaggatgggccgggtaagggttggagttgggccaatcaaaagcacaactttcatgggccgagcatatttgtccggttctggcccattaaggatatcgggccgatgatttgtgccagcccgattaattcgggtgaagttgatgctattggaccttttttgggcctgtttttctctctctctctctggtttaacttgcaagaagccattgagacggtgtagggcaaactgaattttatgacggctgggatgtgacttgtgagaattatcgtgattcaaaagggtacggatgattaaaaatcaaacggagttttatgggaattaagttgatatacataaaaatacgttcttttatcatttgaataaagatgattaaaattctcatagtaaaatgggaaaaaatatttgcttcaaaccagtgcagatggtatattgattagtgaaactaccatagtactctgcatttttcttgacagataatgtcattaaattttgatataatattcgaccattcatcttattaaaaaatgtataaacgttattattagagaaacttttaaacttgacttatcgttttgcgtgcgcacccgcacacatatatttttttttaaaacaacatgcccaaagttaacggtgtcatctattataaagaaatatataggttcaccctatccgtgtcacgaaaatttcttgcgcttcaaaggggtcagtagcatactcatgatgggctcgtcctaatgttcttcttctgagtttgaaagatttgtggaggaaaagtggagggttcaacttgctataggaattgataccagctattcactcattcgaaatggacgattggggtataggacaaatagaggaaatatatctttgctacagatttcaaaggaaaaacttagacatccactacaacgtactaccaattcttttttccttccctaagttcaagacaaatcaattaatgctcaaaacatcctgtgactataattttttcaaaaaaaatcataaacaagcttgattgatttaggctgtgttcggaagtatctcttcccaacacgcgcagtacacacggaaaacagagcggtccattagcgcgtgattaattaggtattagctaatttttttaaaaaagtttgatcactatgattttttaagcaatttttgtatagaaacttttttttttataaaaaacgtaccatttagcagtttgaaaagcgtgcgagtggaatacgatggagtggggttgggaaccctgggttccgaacaaagccttactatgattctatgaaatatttatgtgtttaactaatcccttcaaacaccatgttttactttttttctatcctgcatttcaaataaaccctcaataactagttgaatcaagctttatatcttttaaaaagttatgttttcactgtactgttgtcgctggcggcgtgatcaaccatccacagatgaaatcgtgttaaggccgccagcgatggatatatgaccctattcgtaatagtgccagttgctcttgaatgctagtagacgcaagcttagctacgcggagcatatgcacgaacacgttccggcccatatctgcacctattcaagtatgggctctcacgttctcggcagttactcttattattctacagtggacttagatgcatggccagaatgaggttcttgacaacatttgcagatggcatacacaatccaattgtccaagaggacacgttcaggtaggttaagctatgcagcatttactggttttgcatcatggcaacaaccaacggcttgtgcataggggtggtaatatgtgcccaacattttagcctacaaaatatgatggctgaaaccaaaaaagagttaggctgaggtttaatgagctaaaaatatttaagaactgaaatgggttgtgaaaaggtccatgagccttaacctattaccacccgctacgtgcacttttggagactttgttttggaagggccagtcgaagttagggcagaggtagagtatgggagggggagggtgcccacgaacccgtccaaaaaaaattttttagcctcacctatttttcatcatgcatgtgtgcacccctcaatataaactttagcacccgcatcagtttacacttgatctaaaatagaacaaattaagctttactccgtttcgttctagcgtggaccccggtcctgttacggtggtcaatagaggtggaaataatatgtgcatgtgttgtagctcgttgtattatgaaacttgttgtcatgtcgttcttttaaaaaataattgtaggttgtgtgcatatcgttatcatatcctatttatatatacatagaccgatcgagcgtgattttagattaattacatcaacttaatatagtagtatgatatgaacaaatcttactttatcttttaaaatacttcacacattcttcttcagtccattaaaactttgtttaacttacgcctccaaattggcatcgtatcttagcactcgatccgtaacttggaggcataagtttacttctaaagaagtactcccttcgtcctaaaatatttatgaatgaatatgatattctgaaacggaggtaatacttaatagaagaccgacaatgcggtaacacggttgaggcatgcatgtaaaacatacgtagtattatattacggttggccgtctttattacatacacatcgtgtattgtttctatacatttgatgcgaaaaactattttgagctctaaatagcacgtgccctcattttttatatccagcggaaatgattacaaaatatttcggaaaagttaattattgagccgcagcatatacaaacaatcatgtcgtatacatccatgttcgcttgttttcagctatagattttcctcgatccatggggcccagttgatctaaattaaagcaaccactgatgcacatgcagcttcagtcactactacacactactacaggaatgattttcctaggcaggagtcattttaaattgcagacggaccttaagtggtcgcatctgcgaaaatcgtgctacattttcgtgtgcggctctctaagacgaccgcacggaaaaatcaattttcctagacgggccacttaacagggcttattttctcgtgcggacctgttaagtggcccgcacacgaaaatagccaccgaccttttagatcgccctacacccaactatctcctcccctcgccctctcagatcgccccacacccattctctcctcccatctccctctcagcccccacacccactcctccctccctatccgcctcctcctcccactccttcctccccctatccgcctcctcctcccacttctcccatctccggcgacggcggcggtggtctcggctagggcggcggaggcgaccattggctatggtggtggcggcggagcggatccatcaccggccgccacggggaggcctgatccgttgccggccaccgggagggggggggggatccgtcgccggcgaccgtagggggggggatccgtcgccggccaccgcggggaggccgaatccgtcgctggcgactgcgcggacgacgacgacggtgacggtgtttttgattttttttttgtttccatttgttatttttccttgcgggcggcttaagcgcccgcacatggaaatcacgattttcgcgtgcggaaaatcagtattttctcagacacctcattctagacgggtggaacatccgcacgcaaaacccgattctaaccacacggaaaaatcgttattgtactagtgagtggagaagccaatcaattaattggagatttacaaggcaggcaaaataatgccgttccatttggtcatatgtcaaagaaagctgcaaactagtactagtacaagagaacaactcatcactgaacgaggtgtctgcgaaaatcattcactactctaatctgttcagttccgcaccattcactatactaaacgtacacgcgatcatatggtaaaaagagtactacaaactttttgtgtaattagtagagagaatataggagtacaccttgttagctgaacacttcttaaatttctttgctggcgacctgaatgcatgcatatggccggtcattaattaaaaggtgatcgatcgatcgattcatacacaatcacactgttggcttgattgagatcgattggttgcttggcttgattgcgattggtcattaatttggttgctactatatataactgattgggggcaaagcattccatgttcttgctcactgtacaacgacagaagaaagacaacctctgcatgttcatcaaatatgggttcagaaatttcagaatctacaaattaaaatgtccaactccaccgtaccggctggtcgcttggtcagtcctagatatgcatggacatatcatgaatctcacgatgtatatgcataataatttgaacaccaaaaacgtcgtacgtgcacaaccatcaaatcacgacaagctttcttataatcgttatcgtaatcacctcatcctgctagctttgatattgtcgtcgttatcctcctcctcctcctcctcgtcatcattctcaaccataaagcatcctcaatatatatgtttattaagtagtaaaagtgagacttacaaaactagatagtagttattttaattctcataatatatagtcagtaagctagacctcatatttataagagaaatagatgggtgaagaagagagaaggaatgagagagaagagagttttagtatttgtttattgcttattgcctggtagtagtgctactatcgaatgatactactacccactttactacatggtgacttataatcgtatggccacacctgccttgagccaaatttggatattaacacatgcccctcctacctttttggtaaacttgtgaaccaaaaagcactaagcacggggttatctaaggatgatatatatcctctaatatcggcaagacatgcctctaagaaatatgtgttcatgatgatacaagaatactacgagaggccccgtcttgttcagattgtgttttgttttgatttggcctccactctttcctcggcacttttttgtgttgattcctttgtaacctattcttttctctcaaccacctatgagaagaacacgattgattattaaaaatcggtctttgtggcaatgcccataatggataataatacaatatataagtgggcatcatccatgtaccattgaagctccatggtgcataccaaggctaataccatgaagaaggagaagtaggttgtcgtcggtggtacgctctcgcttgtctcctaccttgcttggtaaataacttgatttccttggttgctcatcttttggaatcttcgacttgtcatattgccccccctgagttttgaagtcttcaatgtggtcttgtcctttagcaatccaatggtgcgtataggaaaaggtagctcatccacttgcatttttgtaaaagtcaatcatccttcatcaatggccaattgaatttgtctacggaatacattgcaatgatttgtggcatgagaataagagttgcgccacatacaatatactcaccgcttcaattcctcaagtgttggtatgacacggccttgtgacaatttaatttgattcttttctaataagtagtaaaaaatcctatcgcatttggccatataaaatgtgaactttacctcctcttgccaattcttgcgaccaccgacttaagagaggaccaaacgaatggtttagatttggagttccaagcccatttggttgtggatacaacaattgtctcatcatccgaagatttttgttgatcaactatattaacatgagggtgatcagacctgacattctatgcgattttggcttctctaacgcggctttctttagctagagcttttcgaagtaattggcttatatctaagaaactatgaccatataacttttcttttaaatattcaagtaaaccagaataagacaaatctatcagaaagtgttaaactataacatcgttttcttctgtttctaaatcttctaatgtattcaggctcattatatttttgtttaaccgattttaagtgcgtcaaatttaattcgaactcaccattaaagtagtcatgaaaattttgttctagctgagaacaatcatgaatagagttgggtgcaagtgaaataaaccaagtaaatgcagcacgagataaaggcaatgaaaaaaaggcaaagtttcaaaatactactagcactagttttaatatttgtttattgcttattgcctagtagtagtgctactatcaaatgatgctactacccactttactacatgttgacatagaatctagttgccacactttgagcacgttatgtgcaaccctcggcggctcccaaagatgcgctgccgtagggagtgggtagatgcttccgaacgaacacccgggaggtacctcatcagggttgtcggtgacatggagccgggagtatcatgactagagacttgggcaggagcaatcacccacgaggcctgaccccctcgggggggtcgggcccgagggtgaagtgcccgcccccctctttgtctccccgaggggtcggaccgcttccgtttcggccccgagggctgaggcgccccgaccccttgtgggtttggcgccgcgtgtataggttaggtgaacgcagcggggctcacctaaccacatttattgcggtttggacgagtccgtcatgccgcatgtaacgcagtgcagcacgctcgtttatccggtctgtgaccagtcacggaccgatcagatcgtgggttaggtggcgacaagcggtctgacacacgcctcgccccatcccgtcaggatgagcgcctccaagcactcgtccttagccggagccagcgtgttatctcctgaagatggcacgttgatcccggtcagatatatgccaggcttcatcctaaccattacaatcaagatattgtatgaagaagggcgaacatgcagattgctaaactgacgcgtggtggacaagaatgaccgatttatgaccggtctgacactggtcatgtcgtcagcagacagccatgatcccacgtcgcgcctgcttccggcggaagtggaggtaggtatgggccgtcccatcagaaggtgattcggacggcaaccatgcaaatctccgtccattcatgaagagaaggcaagtcaagttggtaaaaagagagataagtccccacacaaaaaagagagatggtgcatgtggtatccccttgagatataaaaggaggaccttgcccacttagaaaaaaaggaagaaaaaaacggacgaaaggagagaggaaggagggagtttgagttcttgagctctccagctctttgtagcttcttcatacacagatccaccaaatcacaggagtagggtattacgcttctcagcggcccgaacctgtatacatcacccgtgtcttgtgtatttccactctcgcgaaccttccacaaagaaggagcttagaatctcacccagggtccccggccgaaccggcaaaggggggcctgcgcggtctcccggtgaggagcccccaagctccgtcaagggtgaacgcgcgccgatttgtcctaggctcggcaagctagctaggatgtcctttggcgccatagagacgagagacgacaagcaattggggatttaaggagaatagacttaggataggtagcaagaaggagggaaatgtagaatataaagggtttggatactaaattgatttggacgattgtttggtggttgtctcaatcaactttagcccccttatatttttaaggagaggtggacttgctttcgaggtctttttgacgtccaattaggtgtagaaaccaattagaactctaaaatcttaggctttagcaaggaaactcgaaaaccgacaaatcgaacttagagttggactctgccgctctgaacagccacaagctgctggtcagaccgacctcacgtgacgtgacaagtctgaggtctttccaagtttgtctatgatttcctatttcttaccttagaaggtaaatttggatattaacatttaacactacgacctacttccacaatggtgaatcaggcgataggacttcttactacttactgtctccatcccaaaatataagggattataccgttcaaatttgtcctggaatatgaaggattttgtaatcccaaaacgatactttatttctcacatactagctaccacttttatactatcttatttttcacccatcacattttttactggttatttctctcatcccctttgctattttattctcccaaccattaccatttgaacctttgttttctatcattttttaaatttgtttcattaaaaaatatattcccttatattcaccgagggagagagtactttttaacacattgcggataccttattgctatagctagcggccaggagttaagtgggcctatctttctctcctggtagtgcttaggcagcacgagtagctcacaaataacgtgaagccattggacatggaactcgcagtgattgctccagcagcagcagcatgcagcagcggcggataagagcaggtacaatagcaggctataagctagctgtaaatatattttaaacagataaataagaaaagagaaagtcagcgggctatagatttatagccagctgtatcacggactccaagatatagtgtgtgtatgacaggtgggaccagatattaatagtgtagtatgtaactattgtatgaataagctattagattgactatagatgaattggaggtagtggttggctatactattaaacttgctctaatagattcagctgtagctagcgctgcatgatctgcatgcagtagtagtagtagtggtctgcactctgcacaacgaacgcgtacgcggcgcacgcattgatcgcgcatcacatgatcgatctgtcgctagctgtagatcgagtgcagaatcatgatctcctcttgcccctcattccctctcccaattattggctgtgtttagttcacgctaaaattgaaagtttgattgaaattggaacgatgtaacgaaaaattgcaagtttatgtgtgtaggaaaaaaattgaaatgtgatgaaaaagttggaagtttgaagaatcattttagaactaaacatggctattatcttcccccattgtcaataaaacaaatcctctacggattccggctagctagctcgagcatttcattttcactttttcatacagacctgccaactgtgagtttgctaatagtcccactgttgatccaatggtcttctacattcaactgaagagagagcgagaacaccaaggctgggatgactcaccatggatggcggcgttgatggcgacttccctaatgagcccttgaaactccgttaggtttcggctgtgtttagttcaacatcaaaattgtaagtttgattaaaattgaaagttaaaagaaaaaagttgaaagtttatgtatatagaaaggttttaatgtgatagaaaagttgaaagtttaaagaaaaagttaggaactaaaccaaacattcactcgattagattttcagattggaggcggtgggaagaggtagaatttgagagcggcttaatttaaagaaatggctagggtggtgccatttacacgtgtatgatggaaatgggtagaatgagatggagacggcgcctctggagccattggaatggaggatgatagtggacagggtaaagtgttagataatttattgaatatatatatatatatatatatatatatatatatattatcgataataaattaggacatggagttgataggtcttaggataaaaatatagtcagactcttatcttagtggtaattgcatgatggcagtaggcgagagaacgacttgttggtaggggtaaaaatcggtcgggtacggttcggatcttacccttcccatatcctaacccacattttataatcggaatcgggtcgggcatggatagtgccaaatacagatacaaactcggataatgtcgggcaaaaatacggaacgaatgcttaccaaaatggattagtacactatcgattacggat

SEQ ID NO: 79689 - DNA, 35083 bp, Oryza sativa
ccaattttcccacagaaggtctatgatctcgaacaaagcatacgcatccaaacacctttggtggaacaataaattcattacatccaaataccatctcatatggagccttcatcccaagtattctcgatggtgtacgattgataagatatgtagctgtcatgaccgccgcactccagaggaactttggtacattcatagtatacatgagtgaacgtgccacctccaagatatggcgattctttctctcagccaccccattctgcggtggtgtgtcaggacaagaagtttgatgtagtatcccttctatcgaaagaaaactaccaaattcgttgttcacatactctttcccattatcagttctgataattttgacacatgtgttgaattggtttctaacaaatgcgtagaagtccttgaagcattttagtactttatttttatgtttcataagatatatccaggtcattcgggagtaacaatcaataaaagtcacaaagtacttcattccactcaccgagacaataggggaagtccacacatcagagtggattaacataaagggtgatatgctccgaagtcctctgcttatatatgtagctcttgtatgctttccatattcacatgcatcacatactagtttgcttctgtccaccttactcatctcatcaggatatatcttcctcatagtttcaaaacacatatggcccaatcgacaatgctggagaatcaatctagcttcctcttcacttgtaccaactgccaatgcactacatagtgctttatttgttccgcttctatctaagtaccacaatccgttctgcctaatgccaatcccaagcttccttcctgttcttctctcttctattaggcaattttctcgatcaagagtaacccgacaatccatatggtcaaccaaagaacttattgataccaaattaactggaaaggagggagcatataacactgatgataatgtaatggatggagtgcactgtactcttcccacacctttgataggctgtgaagtaccatcggcagtctgaacagtttctttatatgtgggtggatatggagtaaatgacacaaactcacttggcatacctgttacatgtctagatgctccagagtctaatatccaggttgagtgaggtacctgcatctgcatgggatgcgcgaggttgacaaggttgccaagaactgttgttttctccctctccttccgtattctttcccttatttcttgtatttctacagccattttcgcaagcagttgttcaattccttgacttccctccattccttttttttttttttttttttacaaactcactctattctaacaccttgaagacaacgtcccctggttttctttcctcctgatcagggaactcgacacagcagcacccctctccctctctgtgactgccgaggcttggactgtgttctcgcatacacgaattttggttggttgcctgccaatctgaagcactaacttcacattcaccttgcacaacctgttgccttacttcttgacaataattaatttccaacaccaaagccgcttcttcccttctagatgaagctagctacagctttcctcacctgctattgctctctgcacctgtaatcttcagcacacacgacaccaccaacagatccagcagcaatactcccttctttttcttcctttctcaaccacacacagcagtacaatactcacaagctcacctccttgccgcagcacacacaagccacaccaatagcacaaccggcaaacaattcctctgctcgctcaacagcaacagcaacaacacacttaccaaatttgtgttccccttttcctttcagcagcaacagcacactaccaaatcctcagctcgatcttctctgcctcagcaacagaacagcaatagcagctcaccaaatcctcacaccagcaccagcagtgccgtcctcacaaccagcagctccctccgcgcgcggccgccgttggctctgcctgccgccgttgacgccgctgcgtcctcgccgggagctccagcaccagcgtttccttcctcacctggagctccacacgctcctgcgccgcgtacacgcgcagctctgccagcgcagctccctcagcacctctctgcacgcctcgacaagctccggcgaggctagggtttagccgtcgcccgtcgccagccaccagccgattggctctgataccatgaagttttgggaatttttctctagaagcttcactacttttttcatttctctaactctgctatatacatgtacatatgagtagtatatgggcctcatgggccaacacatacataactcaacattatccatacatgcaaaattcagcaacaaaatgataaattttgctatgatgaattgctgacccttttttttttgttgcaggaccagtttttattagatggatcctctgattctggcatgtggattgtccctattactttaggatgcaattcacatgatatgcagaaaagattcttactgaaacataaattcagcgacataaagggcatcaattcacagtacgatgaccaagaccgacagaatagtggaaacttctggattaagctgaatattgatgaaacaggattttatagagtcaaatatgatgatgaacttacaactgcacttcgaaatgcattgcagatgaagaagctctccctaatggacaaaatcggtagacacaaacacaacatggcacaattagtctcgattacaatttacagtgatttggtaactggtattataacactattattacaggcatcgtggaagatgcacatgctctttctattgctggcaagcaaacattgtcgtcgttactacatttactgtatgcttgccgtgacgaggatgatttcagtgttctttcacacataaattctgtatgtgtatttcatgaccaattgattattccacgatgtccggttattctttggcgcttatttgtctacatattttattttggcttgtcaggtaacttctagtgtagctaaaatatcaattgatgctactcctgaattggctggtgaaatcaaacaactttttatcaagcttcttctccctactgctgagtattttcctgccctttaactctcaatatattatttcccaagatacattccttttgtatgggtatgtttgtttagatatgcttcttgtatggccatgtttatttgcagaaaattagggtgggaccctaagaacagtgaaagccacctggatgcaatgcttagaccagtgctcttggttggcctagttcagcttgggcatgataagactataagtgagggagttaggcgtttccaaatcttctttgatgatcgcaatacttcccttcctccagatactagaaaggtactaccttttagccatattattttacctggtcttctgcccttttaatagactcatctatctgtagtttttgcattgatcaggctgcatacctctctgtgatgcataatgttagtagcacaaacagatctggctatgatgctcttctaaagatatatagggaatcaactgaagtggaggaaaggttaaatgtattaggttcgtacttttcaatcttcttaggttaacaaagaatgatattttgggtttcttccctgaaggttttgtgtccctttttataggcatactatcttcttgccaggataaggatattgttcttgaatcgttgaattttattttcacagatgaggtataagctattgattgtttcttctttcatgattccattggaaggtcatggacgaatttgtagttctatgctaactacctgtaagttatatacatatctcatttgcttatcttgcttgtcaggtgcgcaatcaagatgcatatcttgtccttcgaagtgttattattgacgcacgtgaaactgcatggtcctggttgaaggtatcagtgtgttgcattatatattattgttgatattataaatattaaagttttaactatatatattaaaatcagataaaaataaaagtccatgttagaaacaactttctaactattaatttcgaatttcagaaataaataaaaatcgagagtccaagataagtacagcttcgtatttattaattctaaattctggaaaaactagagagtccacaattttataagtgttcttatctaacatgaactctcctataatctagggttatgataataggatccacctaatcaatgaccgtctttttggttaacatagaagctcccttggaggctcagtgcccaatttagtataggggtagggatagatgtgttatcgccacataaaaattgtgacgtgattcacttaagaattttgcatgtttattcttctataaatcatcaaatattatgcatgcttctacattccaaattatagtaaatagctaaattcattgcgcacttcaatgctgaaataatactccatagatacgtacgctaaggtggtgattatatttgtaaaggaaaaaaaaatacttccctactatccgctgaagcacttaatttttgttctcatcaatttaccccccaaccacactagtagggaatatctactatctgctgaagtgcttcattatattgaatctctgtttgctctcttgttatacaagctaagtgaaattgtgtgtgccctcctctgatcataattacttgatattttggacaagatctggttaatatttatgtcaaaatatcgatgtcttcagaagtatttcataatctcgtaaacctattggattttaagaacttgttctgttacagaaaattgtggccaaagtcgtaactcaaataccgtgaaaaactcaaacttcaagtactttgaccagagggaatatgataatagatgatcgcttaccgtatgtatgaaatacttttgaaaaataaatcatgactttttaaaagtcagtcttagttactatgaaactatacgcaagttgcctcttaaagaaaaacctttgaatgaaaaatcgagtgggatgcccttgttcaggaattaaatttcacgttttgttaacctcgtgttctttctatttccttacaaagagctattatactataagccaacagtgggatattcaaaacattttgcttacatgccctattatgtgaatgcaggaaaactgggatcgtatcacgaagacatttgcagcaagcgcaatcttatcggattatgtcaaatctattgtcacattggtatcatacatctgcacttttctattccccaattccgtatatgttattctgatcgggccattgctgatccttgtttcttggcagttcacctctaaagagaaggaagcagagatctcccagttcttcgcaacccgcactaagcccgggtttaagagggcactaaagcagagcctggagaatgtgcggatcagcgcaaggtgggttgatggcatcaggggtgaagctgagcttgctcagactgtgcatgatcttctcatcaaactctgatttgatgcctccagaatttgatgcatttgctgtgatgccaactttcgccaaagcatacattgtcatagcagctcattgtgagaaaaacatgtaggagtatgccgtcagcttgagttcaaataattcctcctggatgcaaggttttcttaccatttattctttatcaataatggatgctaagtctttccttagtatcccacatgcttctttttttttttttgagaaaatcccacatgcttctttcaacatagcagctcattgttgccctgtttatgaagtcataattcaagaagtgtcgttatgtattgtcaatctctcgtatgtatgttcaggcatatgtacagacatttataattcttacaaagtcttggacacgcacacgcttccggtggtgttattttaatgtgatttgtagataagcattttttatttaattactatttcctttttaaatatatcgttaagtacaacttctttttgggcataaaaagttttatgctcaaatcagactctatcatatggattttatcataatctaaactaacaaggattgtttctgtagttacctttaaggctcctttggttttaaggaaacaacataggaattttataggattctaatcctataaacttttttctatatagtcatttgaaacaaatgattggatactattgaatcctatgaaatgtcttattccatgcaagtttcaaaagaaatttaacatgaggcccaacctcatggaaagtttcttttgagtcttcatctctccttaaatccctgtgttttttcttgccgtccaattaaaacgaccatttttgtatttttgtatgttttataataatttgttttacactgtattctattaaaattatgtgtttttcatataatcatattgtctgttttctcaattttgtgttttaaagaggacctaaagattctatatcaagagctaatccctctctttgtattgttgactgaaacaactgttaggtgtaaatcaccttgaatagtggtagagccaaaaggttcatacagcttgggtaagcataatatgcatgcaggctattccactgtttctagtggacatgagtgactacaagtgatggacactccattgttgcacccacgagtatctgcgagaatcctattcagcccgacgcgccagctccattgttagtgtctgcgcccacatgcgactttttttcacgagcccacacgcacttgattttttttgtgattttttgtaatttacaatttgaatttttcatttcaaattttaaaatattctattgaaaactttcaacttgatttttgagatgaaagtttctttaagttttagttgaaagttttgaattttgagttgaaagtttttgaattttgagtcgaatgttttaaattttgagattaaagcttccgaatttgggttgaaagttttcaaatcttgactttatagttttcaagtctaaattgaaagttccaatgttaagttgaaagtttacaaatttgagttgaaaactttaaatcttgatttaaaagtttttaaatctgagttgaaagtttttatcagtgttaaagataaggcatagttcctatacatggatttatggaatacgtcaataccatatactatacgagtaggtatactttaattaaggaaatacgacaaataaagaaggaaattatcttcctggaatataaggtgttaaagtcctgttcaggaaagataaagtaacctggggcttgtatccggtcttatctctttgagatctacttgcagaagaagatgatctacgctataaatataagtcccccaccctcagtacaaggagggaggggcatcgagttgcaagtcggaaatccgagggagccaaagatagatctcgtcggacctttttctcaacagcgtctagtcaggtgagtccaatcttcttattccctattgtacctattgtactcttttgtgctattttcgtctataattcatataaactggactagggttattactcatcttgaaggctcaaaccggtataaatttgtctgttgtatcgtatataccttggttctaatgatccccatactctataaataccgtggtcgggatatccaccctcgacaatttcaaatctttgactagaaattttttaaatcaagttaaaattaaaagttctcaacgagagaaaagacagatcgaataagttccataggtatgtaagtgactttatctactagcgcacgcgcacgtgataagtttccccaagtgtctgccatcgtagggccctagtttgaagttcggccgctgcagttggataaaaccacctcacataacaagtgcaaaaaattcttatatatatgtgacaaatgaaaactagaagaatccaaacaagacgttaaagagagttggcgtggtgtcaccaaccaaaacttatctcctgaaaaacagctcggtataattattgctatactgtgcaagcaccagctgaaaaaaatgataattgttattcagttgataaattttgttggtgacaccacgccaaccaccatctgaccaacaaagtaattcctatcaataagccactatataaaaccaaatcatcacccctttttttacagtgttggattatactttgatgcctcgtattattactatctaattttttaaacccatactccctccgttaaaaaaaaaagataaatcctggatataaatcttgaaaatacattatgtccatatttatattcggggtttatctttttttttttggacggaggacgaattaagcacttcctaaaagccatgactttccatctacgtatcgcataaatttaccattaatatattaatcatgttccgcttcacttgatagcgaatgcgttgtacctagctgtttgccttccgtggctatagtgcatccgcaactagcagttgtaccacacagctaaacatgcccattatatgctctataataatacgcccaattacacaacagccaatgttttccctaaatttatttctgacaataaattactataactactgtcttccatgactgtggcgcatccgcagctagcagctgtatcaccccgccaaatatctataataaataaagcatccaatgccaccatagccaatgttttgtttccaagtttatttaagattaaaaatttccacaaacatcacaagggactaactcacaaaagggagaaaacattcaactgccccacccatttccactcgaaggaaagtaaaaaaaaaaaaaaaaaaaacaaatccacaaatccctcccaaatatacacgcggcgaccagatcagtccctgtagcccccaccgtcccgaatccacgggggcggattcaacattcgagactcgagcgagaggaagagcagaagagccgaagagagagagacggcctatttttagcaacccccacacgcggcggccacacgcccagtccgaggtctgcgcgcggagcagcagagcacacccagccgactcatccgccctgcctaccacatttcgatcccctcaccgtcgccgccgccgcccgtctccgccgcggaggtgagctcctcgtccctccccctcttcgtcgccgcggtagcgccgtttcggattttacggtttgggggtggggaattttgttttgggggaggggagggggattggatttgtagttcctcggtttggtttgatttggtgaggcgggcggtgtgcgcgtggtggtctgattccgatctgtactatgtttgtagggtttgtattttttttgtggtgttggtggtgatgggtggcgtggaaccgccgccgccaccggctccggcgccggcggggctggcggcgtggctggtggcgcgtggggtgaagcggagggcggtctccgccaagcgctcctggccccccctctgcggccgcttccccgccccgccgccgccgccgccgactgctcccgtggccggtgacgatggaagtaagggcgtcgagggcgttgtcgccaaccagggcggagcggagggggtggctgtctcacctgaccgttccgtgccgctatcaggcggcccaaccgccgcttcttcgctgccgccgccgccgccgtctatcatagcaggtaatgttggggataacagtgtcgagggcagaggagatgttggagataagggtgtccatggtgtcaccgagggcaatgaggaggagcaggttgcctcggctgtggtttcctcggccgcatgcattggtgccctctcgcacggcccgtctcagccggaggcagagaggatggaggtggatgagggagaggggcgggagaccggagaggcgcagctacctaatgatacagatgctcggttgtcagatgatcagggaatgggcgaggtgcttgatgtgatgcctttggcagtagctgcaccagttagttgtggtgctaatgtctctaacggttctgcggagaatgttagggatgtggccagtttgttgatggacagggagggaggcaagtggggctgtgaattcgagagaaaggaagttactagcgatcgggatggccgagagacggaaagtagagtaggtgttggtcaattagagaggacaaatgatgtacatgatggtggcagaaaaaagaggtggttgatgtcagttctgaatcctccacccaaaagaagggcgatctcagccatacgcaaatttccacgtgactgtgggagggctgcttctactcttgcggaaagtggtgcctctatggaggagttgcctttagaagcaacacctattagtgtagctaccggtggtgcctctatggaggattccttggcgagaacccctatttcagtccagggtgcttctttggtgtgcggtctagaccattctagtgaggcaatagatggcaagacaattgaagatgatgaatctagcaaggtagaaaataggatccaagagttccaagttgccacaaatgttgccctagatgattttgaaggagccaagaatggtagtacacacccaaatgattctattgccaaaccttctcctagccatggttttgttgagagggtgaatggaaagggatcacaacaagaaaagaagcttgtagcacgaagtgctggggatggcaagatggtaagcaaatatgaagagagattacaaaaaggtactcccgagactcgtatgagagatcttgtcgatgtaaaggcaaaaaagaagatattaaagagtgataagatgaatggggcattgcaaaatgacgctagatcctctggagatggtaagatgaaaacgaaggcttcaagcactcagagaggtgtggtgcgctcggatatgagcttgaagcaaggtgatattgctcgtaaggttgatgccacaggcaaatgcaagggcggcgtgaatagcctcataaaggaggctacatctgggaagcatgctacgactaatggaattgaagaaaatgatgatagagaccttgtcagtgacaggataattgtacaagcactaatggccccagacaaatgcccgtggacacgaagaaggaagtctattggtggttcctccgagtctcgtactcctaagcttaagaaaaagtttggtaggccaaggaaagaattgaaagatactactccaagggaagaagtttccccggaagttgcctcttgtaaagcgatcaagcatgaggccatagaggacaaggaggattcttactttgaggatgaaggcaactctaaggcttcttactcggatgttgaaggcaactctaaggagctagtgcgtggaggaaaggcactagttgtttgtggaggaaagaaggagttatgtgttacactccctccttcggctccttttggcacagatccccgaagcaaaataaggaatttactcataaaattccatgcggcatgccgaaagcttgtgcaagttgaggaacaacataaaggtaatattggaagaattgacatcgaggctggtaaagccctaaaacaaaacggttttattaagcccggacctattgttggcaatgttgcgggagttgaagttggagatgagtttaattttagaatcgaattgtcatttgttggactccatcgcccatatcaaggaggtattgacagtacaaaggtgaatggaatcctcgttgctataagtattgttgcttccggaggttatcatgatgaattgtctagctccgatgaactcatatatacgggttctggaggaaaggccatcgggaataaggcagctggagatcaaaagcttgagcgtggtaatctagctttgaagaattctattgaaactaagactccggtccgagtgattcatggattcaaaggtcatagtaaaggtgaagctagccattctaaatccaagcaaatctcaacatatatttatgatgggctgtacatggtggtggattattggaaagaaggcccagagggctcgatggtctacaagtacaagttgcaaaggatcccaggtcaacccgagttagcattacacataatcaaggcaacgaggaagtccaaagttcgcgaaggtgtttgtgtgcctgatatatctcaaggaagggagaggattcccatacctgcgatcaacacaattgacgatacgcagccaacagcatttaagtacactacggaagtcatatatccacattcctatgcaaaagaacctctgaaaggctgtgattgcacgaatggttgctcagactctaatagatgtgcctgtgcagtgaagaatggaggtgaaatccctttcaattccaatggtgctattgttgaggcaaaacctctcgtatatgagtgtggcccatcatgcaggtatgacgtgcaaaagcttagcaatccaaaataataacaataactaaataggagtaacatttgcatcatattctgataataccaaagtagattcacagaaccaggaaatatttctcattgcttctgaaatttttaccctttcaacaagggctgacatttggttgcagattcatttgtcagtgaaacaccctgcaacacacaaggaacataaaattgttggtggcatagtttaaaatttctcataaaaccaaccattttcaccttaagtctgtaggttttcacaccagaactattcatttacagcagatcattaggttgaagggaataataaaatatattctcaatcagagagctagacatattatcataacagcgaaattggttcattcaccttaaattggtaggtttgcatatcagaactactcattcacattgcacaattaggttaatttgaaactacaagttctgttccgatgctttgagctaactaatgctaatatgcattgtttgcctgaagttaattgtttttcgcgccagaattattattagattaaacccaaattgtaaattctgtttgaaagctgtgaaataccaaatgctcaaaccaacatattgattacagaagcaaccaattcacgtcaagttaattagtttttacaatagaatttatttgtttgtattggaatatcaagttaaaccggaagtagaagttctgttctaaagcagggagctaatctagctaatctaatgttcaaaactatgtgcaggtgccctccaacatgccacaacagggtgagtcagcatggtatcaaaattccgctggaaatattcaagacggggaacaaaggttggggtgtaagatctctgagctctatctcttcaggcagtttcgtatgtgagtatgcaggtgaggtgctgcaagaaaatggagatgaacatgtagagactgatgagtacctttttgatattggtcatcactatcatgatgaagtttgggaggatcctaaatttgaaggcattttgggtctagaatcttctacgtccaagacaacggaggatactgaaggcagtaaaacaacggaggatactgaaggcagtactatcgatgcatcaaagtgcagcaatgttggaagattcatcaaccacagctgctcgcctaatctgtatgctcaaaatgttctctgggatcatgatgacatgaagaaaccgcacatcatgttctttgccaccgagaacataccgccgctgcaagagcttacttacgattacaattacggtaaagtcgaggataagaatggcaaggagaaggttaaaccttgcttctgtggttcgcctgattgctctcgcaggctgtactgagatgctgttggttgatgatgatgatggcgacaatggtgcccatttttcagtggaacactgttctgtcgtgctattgatactttgttttacctcctttatttttttactcgttcatcttgcacagttgcagtcatgggtagcatgtaatgttctcttctttgtctttatctcctgaattgaactcttaccgcatcttttggagcaccgactaaattgcaatggaattgatgttaggccattcccatcccaatgactaggatagtgtccatagtattaaataagttgcgacctaggataaaaaatgatatggcaagtgaataaatgaggaaagagaagaaaaccatgtcttgccacctaggatgaaaaatgatatggcaagtgaataaatgaggaaagagaaggaaaacatatcttgcatgagatatgatttctacacaacatcgaagacattatgtgagataagtagcactaaatttaagtatggaatagtgatgtttgcattggaagagtagtgactagtactagtttattgatttggagtttatggaaactatattagtgttttgggttgggaatggtcacaacccacaagttccttcactgctggcaaagaacggatataaatttatttcgtattattcgtctattatacagtacaatgcagactacccctatgagcatcttcgaagactggaccgattgacgaagtcaccacgactggaagagtagtgactagtaagtttacggaaactatatctagtgttttgggttgggaatggtcacaacccgcgtgactacccctatgagcatctctacccctatgagcatcttcgaagactggaccgattgacgaagtcaccacgactggaagagtagtgactagtaagtttatggaaactatatctaatgttttgggttgggaatggtcacaaccttcgaagactggaccgattgacgaagtcaccacgactggaagagtagtgactagtaagtttatggaaactatatctaatgttttgggttgggaatggtcacaacccatatctaatgttttgggttgggaatggtcacaacccgcaagttccttcactgctggcaaagaacggatgtactgtgactacccctatgagcatctcttcgctgtcgatgggtacgtcgtctaccactgaaagcacaacgccgttaaatcctggaaaattcgctcccatggggagtcgaagccaggacctcaggtactactgagcctcttgtaaccactaggttacaggccctttcgctcaatcactatatatttattcgtctgtcatattcaatctacagtttttttttcatttgaccaacattttctgtgttttgcaataggctagtcctgatttgataaaagcaatttatatatatctatatttttcacaaatgaatggtacgccatttataactgaccggatgaaaagacaaaaaaaaccaaaaaaaaaaagaagtaaactgtattcatgggacatcaacttgatatactgtgcaatttagttcacttacaaagtgagcgtgctaatgcaataattaacttagcaaatggatatcttgcaaggtgatatgaatgcaattcacgaatttactaagcgagtaacgaagcgagtaacgtactgggtgaatgacttgcaaggtgatatgtgagtgcaatttagtttaagaacttacaaagtgagcgtgctaatacaataacttagttcaagaacttacaaagtgagcgtgctaatataataacttagcatgtggatgacttgcaaggtgggtacaattttggtatattgatacaacaacatattgtgtcaacacacttgcgcagatttatataagcatacttattttttaaaatatagtcactaaaagtcaattagattttaccatgtagaaaattgtgtatttctgttgagatatgagaatgtgaagataaattctaaaccggtgatgcaaattgattcaattctttatagatttaatccaagattgtagggtaatatttgcatgattgttacgtcgcattgacaatttgacatcatgagaaaactcatctagcactcgttaaccaaacaacatgtaactagtcaagttgttacacacattttcttgtactggaatatactcactaacttattatacttagacattcaatttctaaatttttttaactaaattacacctacataccaagtttttttttaccaggagtgtactttttacttaaaaaaagaatgttataactttggactctcaactacgaaacctagctaactttgaaaaccactcacattttatcatgggtcttatgttattcgatgaactggcgtctacatggagtcaacgtgattgaagagtaacgacagcaaaatacaatgaataataaatgtcaatcttgttttttttcctttgtcttttcccctaaccctatatataatttatttaaaattgctaactatgatgccacatgctgccaagtcatccagagccatccaaatttaggtcgaagaagatatttttagaagttccttttatagtaacaacaattttaacttttaaggcccttcatttttttttagataatgttaaggcccttcatttgaaggaaaaacataaaaaaattgtagaattccaatcttatatgatttttcacatatatgaccgtttgaaacaaatgattgaaaattatagaatcctatgaaattcctaagtaatgttgctatagaacccctttgattccaagaaaagttgtaggaattttggaggatttcatttctaaaggatttcctagatagccctttgaatcaaatgaatagacacaattaaatcttaagaaatttatgtggaatgtctcatgttatgcaaatttttgaggagatttaacatagggtagaaattcatgaaaagtttcctttgaatctttatctcttctcaaattcctatatttttttcgcggtctaatcaaacggttattcatatggttatcttgtgttttgcaatcatatacttgcattcctgtcagatcttgtctttttcctatttctacgcttcaaaggaacacgtggcaagttttgggtgtttttaacatgagtccaacctactggaaagtttactttgaatgtatcttcgtcattcaattcaattcatacgggtttttccgcggtccatcaaacgttcatttatgtattttttccaatgttttacaattctctattttatatttgtattattgtctaaatcttatatttttcttatttctctgttttctcaatctaatatttaggaaatcacaagtggatgtcttaagaaaagaaactagcggccactagttagcaatatcagcaggctatatacatgccatgtcagatctttggatgagttggaagataaagaagaggagagagaatcagagtgggcgactaaattagcgtcgacagcaggcgcacagtacgatgcagggtggaccccacctgcattctctcccaatcaatacatgaaagaaggagatggtgggcccaatatggtaaataaaataaagttcatctctagtacatggctgtggattagagctaatctattgtacacgccgcgagcgaatctcgtgcaaccccatgctaagcctacgtaactagcaataatcctacttcttactgtttttactgattcttaatagtaaaataataataataatatacaaattgatttgaaaattctaaaatataggttgaaagtttttagtttggatttgaaagttttaaatttcaactgaaagatttacatgagttgaaagtttttaaaatggttgaaagtttttagtttggaataggatgtttcaaaatttgagttgagagttttcacatataagttgaaagttttaaatttgaaatagaaagttttaaaatttataagttgaatgttttaataaactagaaaaatgcccgtgcgctgcaatgggtgaatgctattttaatattattattgttattgggtttagttagggtaaaattcactgtgggaattcgcttggattttgtttttagaaaatcatgaggtggaattaggagtccgtcatctcaagttagcatgagagttttttaaaagtaatttcttatacgactcctttgtattttcaaaagcaaacgtgtttaaaatccaacttttatacgactcctgtatttccaaaagcaaaagagcttaaaatctaacttttatacgacttttttttatttccaaaagcaaacaagcttaaaatataactcaaacacggatatgtacttccaaaagcaatcaatcttaaaacctacttaaacacggacgacgtaccaaaataccggcaaaaacatatttaatatttataatagtagagaagagatgagttaaaagtttccaaaattatgataaagtgtaaaatttgaggggaaagttttaaattttgtgttaaaattttttaaatttgagttataaattttaaattaaaaatagaaacgtacacgtgcgccagcaacaagctagcgcatgcgcgaggtagcgatctcgaagaaacttgccgatgacatcatttcgtttgctgtgggcccaaggcgattgtgagccgaagccaaaagcccaaaaacaaccgtgggcacaaaagccgagcccatataaatatggaaaaagtacaccggaggtccctcatcttgtcactgaattacaaaatcatccctcaacccaaaatccagatatataacatctcttaacttacaaaaccgagtcactttaggtctttaggtgattttgaacccggttttatcttacgtggcaactgagtcagcgtgggacccacatgggtcccacatgtcaatgactactttctttcccctctctctacctctttcctctctctcttcttctctacctctcttcctctctctcttcttggcaaccggccatgcgggaggactgaggagcgcggctgacgacgggcggggagaggagcggaggtggagacggatgcggcggggcgccaccggcgatggcctcgccgtcgcctcgctctccgctctgcttgacgagaagcaactccagcgctcgcccaaacccaccctcgccgagtacgctgtccggcttgaagttcctcgtcgccgccctgagctctgcgaacatgaagattcagaggttggggacctccaggatcctcccctccggctccgggtagagcgccccggcgacgccgatgactgcgccgcctgctgctcccaggggcatattgttgctgctactgctgctgcttggtgatgctgctcatggacgagctcgaccttccgacgtgatgcccggtggcgctgcttatggaagcaaacacgttgtgtagtgccatgatgggactacgcctatttgctggagcggctgcttctgctgcgaggtttgaaatttgattagaatatgttgtcaagaaccaagggagaagaaatgccacaagcatttgaataccttgccagcgtccatggtggccttatgttggtgccctcacggtcgcagcagcttcagcctcctcggagccgaaacagtcccccatgggatcagctgggagcgaagctcgatcaaatcgagttgattattgttcgttacctcgctgcgtactgaaacttggcaagtaacacgcgagacgctagttgattctttcttgtcaatcagtagcagctctcgactcagcatcccgccaatgagagccgccgccgccgggttgggagcggtggagggcgcagcacccagggggacgcgtggccgagcgctggagtcgcctcccgtcaagcagagggagagcgaggcgacggcgagggcgaggccgtcgcctcgcccttgccggtggcaccgccgccgcgtccatctccccctccgctcctctccccgcccgtcgtcagccgcgctcctcagtccttccgcgcggccggttgccaagaagagagaggaagagaggtagagagagaaaaggaagtagtcattgacacgtgggtcccacgtgggccccacgctgactcatctgccacgtatgacaaaaccggggcaaaaaccgcctagggacctagagtgaccaggttttataagttaagggatgttatatatctggtttttaggttgagggatgattttataatttggtgataagatgagggacctctggtgtactttttcctataaatattgtgggtgcagacccaaacattaaagcccaaaactaaaagattgacggcccaagaactagcccagagaaaaattatggcccaaggcccacttctcatggccgctcatatctcctcgaccatcatctcccacctctctcatcggagctcctctcctcgcctccaatggcgctgctcttcccaccaccaccccacgcgctctcccccaaaccccccttcccctccactctccgctccacgaggtcactgcgtctccgccgcgccaccgccgccgccgccgccgccggggccggagtctcctcctcttccccctcgacctcctcgccggagaaggccccggcgctggacgtcgccagcgggaagaggggtggtaagaagaggaggtccctgaagccgagcttcgagaagcaggccatccgccgctggtccgcgagggcgccgtcccagcgcgcctccttcccctggcagcagcagcagcagcagcagcagccgggcggaggtgagggtgaggccgcgggcgatcaggaatccggttggagtgggagctccacgctgcagtccatcgtggattacttcgacttcgactacgattcctcggatggtgatggcgatggcgatggcgatggcgtcgtggtcggcggcgaagcggccgaggcccaggaggatgggccgcgtcccgagccgagcttccttctcgggagccggccggtgtcagcgccgtggatgcacggggaagaagagcccatgacgaaccaattggtttctgacgaggaagggttggatggggatggtgcttccgaggatgagatgggtttagttgatggagacggagacgaagacgaagatttggggagtgaggaggagacgctaagtgagagctcagacggggaattctccgaggattatgcagcaccggccgcaaattcttcttctatgatggattcggtactggaccatgtttcttcaggtggtgggttttatagaggtactaggcggagtagcgtaaattcaattgttaacacaatgaggaattcgatggaggaaagtagtagaaatgctgcgattgagtgtcccgagaccgaggattttgtccagaagctcggtcctgtgctcctcccatgggagagggagggggatgtcgataggccgagaaagcgcagcaacacggagctggctgagaggactatcccagagcacgagctgcggaggcttagagatgtggcattgaggatgaaggagaggatgagggttggtccaggaggggtcactcagctcattgtggagagcattcatcagaaatggagggtggaagaggtggtcaagctgagatttgaaggacctccaagcctgaacatgaagagaactcatgatatactagaggtgcggttaccttttgctgtctcatgttttgttcattcacaattttttcgtggcgtgaaatctgatagttactttgttatcttgctcttatctatcaggagaggactggaggaattgtaatatggaggtcagggagatcagttgttttatataggggaatgaactacaaccttcgatgtgtgcagtcgtatacacaaactacagaggttaattttgataaaagagttagtagtaatagtgttgaacctatccatgttgaacataaatttcagaagtcaggtgcagatggactgaatcgctcagcatatattgtcaattcctctgaaaaacctacagagacatttgatatcgatagcttcttggatcagttgggaccgcggtataaagattggtctggtcgtggccctattcctgtggatgctgacttgcttcctggtgttgttcctggttacaagacaccatttagactacttccttacatggttaaaagtacccttcggaataaggaaatgacggctctgcgtagacttgcaaggcaaactgctcctcattttgctctaggtatttcagtgaacttatctgagtagcttttcatctaccgcatagtattcaatttgtcaattaatttccttcttttcacacttcatgcgtaccgtgtggtttagggagaaacagggaacaccaaggattagctactgctatcgttaaattgtgggagaaaagttctattgcaaagattgccatcaagaggggggttccaaatacatgcaatgacagaatggcagaagaaatcagggtaaaagatcatgataactattatcagtagtttgcctgtttgcattcctgtctccacagtgttatgtatgtgttgaatcaaataaacatggcattgcttgataagtagctattttgctgccttaattagttcttttgcttaattcacactttttgaatccttgaaatgtcaaatttctgagaaagctgagagtaacaatctgacaaagaacgcttaagaaatccactaatggactttgctttcttctcctctgcacttccatactaatttacctcttcgcctgcttgttcttgtgacgtattgaatgccttcttttcttgattcgatgcatgactgatggttaaccttgaaatatgatcattgtattagtttctcttgcacactgcagcctatgcatgttttgaatctgtgtaacggaacacttgcagaaattaacaggaggagtgcttctatcgaggaacaaggagtacattgtcttctacaggggcaatgatttcataacacctaaagtaaggcaagtcttggtggagaagcaagagcaagcaatcacttggcaggatgaggaagaattggctcggcttaaagcatcagcctcgatcagtgtcaaacccaaagtatttaaaaatcccccagttgctggcactctcgcggaaactagagaggcaaaatctcgatggggagattccattaatgctgagctcaggaaaaaggagaagaatcacatgattcttacaaaacatacctctcttttgaggaacttgaagagaaaattgattttggtatgctcttcaaaatgcatctctagaaacaaaagtttagtattttaatttcattactcatttgtaagtagcattttagctactttttcctccattgcacaaagatatctttgtgattatttgtgtaatatctactcctgtgcaggcaaaaacaaaggtcataaaagcagaaaaggccttggctaaagttcaagaatttctctctccagcagagcttccaactgatttggaaactgttacagatgaggaacgcttcttacttcgcagaattggcctgaaaatgaaggcctttctaatgcttggtacaactggcacttctcacttaacagttgtgatataaaatgcatgtggtgttttatgacttgtctatatgcattaaaattttctcaggaagacgagaagtttttgatggaacagtacagaacatgcacttgcattggaagcatcgagaattagtcaaggttcttgtaaaggggaagagctttccacaagtaaaacatattgcaatatctctggaagctgaaagtggaggagtgctcatttcagttgataagacgacaaaaggatatgcaatcattttgtaccggggtaagaactacaagacgccccaaattttgaagcctcgaaacctattgtcaaggagaaaagcattggcacggtctatagagctccaaaggcgggaggtaattcaagtgcaaaatctgattttctttttccattattttattttttgaactctatgtaagttgtatatgtatttaatcaattacatggtctaaaataatctagggattaaatcatcatatctcaaatctgcgagacaagatctggaagctgaagtctcaacttgtaagtcatttatacacgagttctctatgacagtatgacttatattttcttatagtagtaaacatttcttgatgatgttctcttcctatgtcatgaccatcaggtacgaatgcaagttgctggggaaaaaccagatgcggagttacttcaaacagttgaggctgatttgtctaaagatgacgataaaatagaggtaatcatgcatgaaaaatgctgagttcaaaagcactgctgcaaattacattttgttaatacacacttatagctcgcggtgtttggtggtgttgtgatcaccttcaaatgccggcacatcgctagtggttgacaggtagcttctgttgttgcaggatgaaggagaggaggcctacctgcaaacttacatcagtgaggatgaagaggaacctgaggatgatcagaatgaatatctctgaatcttaactggcgaaacttcggtgagtccgggagaaaagtcagtagtaaagcattgcatgttcatattgtgaaatttctgcagtgttactcaagaggcaggcagttttaagattcatctatggattattgccaacacaaattgacctgcaacagcattagtggcctttgtccattgcgagatcaacgacaaaggatgtagcttgagtgtgtgtggattgtggtgcatggtctgcagttgctgccattcctttttttttttttttttaccttggctacttccatagctccatccatgcctgatgccctgatggccttctacatcctgcagatttgaaaaggtttctgtcaacacacgatcaagttgtctgctgtgcagaagtttgcaaagtggcagtgtataaatcaggctcgtgtgagttcgtttcattttgcagaagctgtaattatatcatgccattttagaagaatcctccggtccacgttagattcatatttacaacatgaacatgtgaacctttcgttgatacggaattttgaacggttttctgcggaatctctcaaagctgagagcgcgattgctaatccgcgcgcgcacgtttccggcccgccgccggcgcgcgcctcccactcttttttttttcgtttttctttacccattttttttcgctttttccttttttctgattatttttttaatttttagcatgttttgagtttgaaagttttaaattttgagttgaaaattttcaaatttgaacttgaaagtttttaaatcttaacttgaaagttttcaaatctcgatttgaaagttttaaaaattttcaaatctggacttgaaagtttttgaatctcgagttgaaagttttcaaatctcaatttgaaagttttcaaaatttcaaatctggactgaaagttttcgaatatcgagttgaaagttttcaaatctcgatttgaaaattttcaaatctggacttgaaagttttcgaatctcgagttaaaagttttcaaatctcaaattgaaagttttcaaaattttcaaatctgtacttgaaagttttcgaatctcgacttgaaagttttcgaatttgagttgaaagttttcaaatctgagttgaaagtttttaaaatttgactttaaaatttaaatcgaaaattttcaaatctaacttaaaatttttttaatctgttagtaaaaaaaatctccataatctttcctaattactattattagtgttaagtatattaattaatagagatagttaagtatattaactaatagtgttaacagaggtagttaataggggaggagtgctcgctagcagcgagcacgcgctagctaggagtccccagctgagagcacacgcagctaccaaaaccaagaatttttttcggttttagattttttttaaatatttacataaataatctatcggccaaaaaaattacaaaaataaaccctgtcgcccacctctggggcggcaagctaacgtggcaaacgggggaggaacaggcgttgatggagggagggttttttgcaggaaaacccttgccgccctctggtggggcagcaaggggcccgaatgcaaaaaagccagtcggggctggccattctgcaggcggtcccttgccgccctctagccgggtggcaggcctcgctgcctataaaaggcttgccgcccagcccccagccctcattcctcccccctcaaatccagtgaaaaaaaaaagaagagaggggaggagaagagaagaaggggcgaagccctgtcggattcagacgccgatttcaggtaatattcatagatcctatatgtgactattgagataaatagtgtgtattttttaaaaatttgtttgaataaatgcattatatttttagggttttagttgtactaatctagaagtgcgtattgtagatatcggtaactacgtagatctactagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttttataaaaggatggttaatgaggggcttgagagttgatccacagacaagtgacataacaatcaatgttatagtaagtcgggcaactgagggtttttattgggaattaatgccaattcaaaactctcgagtgtggagatggtatttggaaaatgcattgcaacgcgggtggcctctagctttggttctgtttgttcacccgaaggatccaggtgtgcagatgaacatggatgatggcgagggaccaagtgctgaagtaaatgagacttctgtggaggaggtcaatgcacgagaggacgggggcgtagtagctccactgggcattcaaccaggtggagtggccgacgagggggaggctgtcggtgccattgtggatgaaatggagagggaggattctgacaatgagcgtgtagaggaaggtgattcgtcagacgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcattaccaagcatacatgttttctacctggtgttcagaaataccacaggaacattacatgtgcatttgttgcatgtgagatgtatgtgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcatagggcgttcttagctctacatgcatgcaagatgacattcgtgaactgtcgtcctgttctctgcattgatgggacattcttgacaggaaagtatcggggccagatactaacagcaataggggtagatgggaacaatcaggtattgcccttggtatttgcttttgttgagagtgagaataccgacagctggtactggttcctgaaattggttaaaacaaaagttgttggtatgagggcaaatgtgtgcctgatacatgataggcacgctggcattctgcaagcgatagaagagttgcagtttgggagtatggaatgaggataccctggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaatggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccatggactgccactagttggcatagtggagttcattttacatgggacatgcaggtattttagggatcggttctaggcagttcttccctctatgccgaacaacaacattttgtttggaactttcatgcagaaaaagctagaggagttgcgtaaaaaggccatgaaacatcgagctctagtgcaaagtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcagagtgtggcataccagatgcagtatatgtgtcacagtacttcagtaagcaagcaatatatcatacatggagcggcgagatttatgggttcggcatagctggggagttcacagagactaacgatgaagtactgtaacgccccgattttcgttcgggattaaaaatcattaaataatgcattttctaaaaattaaataaaagttaatcaatttaatcaagtgaattattgggaaaattaaaattttcccttaaaaatcattggccgagaatattttgtaatattctttttgccctaaaacactctccggatttttccatgaattttcggaactcaagaaataattttaaaagcacaaagttcattttaaccaattacataaaaagaaaaacaattaaaaatctcccctccttcactttgggccactttcggcccaaagccctccttctctcccttcctcggccggcctcccctctcctctcttgggccgtcggcccgtttccccttcccctcacgcaaagtttaaataaccccctaggttctcctccctctcttcctccccgacaggtgggcccggcgaccctacccgtcaggccctcctcctaccttcggcttcccaggccgaagccgccatggccggcggttgccgcccatgtcccgccaaatccggcgccctcccgctcgcgccctcgcgcccaaaccgagtaaaatcggttccccaccacctcctccaccaaatcccccacttttccccaatttttggcgtcaaatcgagccctactttgcccacgatgtcgcccacgttgccggccgttgccgcttcaaatccgccacgcccggccacgattcctcctccccgagcctataaaaagcaccctcgtgctctcctcttccgtttccccctcctccccgagctcctcgtgccctctcccgtgctccccacgccgctccgcgcgacgccgcccgccggcgaactccggctacacgccgccgtcgccgtagccaccgccacgccacgccacgccgttggttccttcggcttcgcctcgccctgccgcaccccggcctccgctccgtttccccatcccatcgctgcagccatcctcccaccgcgaacccgagccgccattgccatccgccggctccagccgccgcttctcgccgcttcagccaccgccgtgccgtgccgtcgccaccgtcggcatagccgcgccgagctccaccccgtcctacacctcttttccccaatctcgcaccgaaattccacctccactgtccacccgagccgcctcaactataccacctccagccgccacctctcgccgctctagccgtcgccgcgcagcgtcgccgcgctccaccgcaccctggctgccgctccactccgtccagaacctcacgggagccgcttttccaaaatcaaggtcttgccggccctcggccgcggcttcgttgtggtcgggcgtcgtcggaacgccgttcccgtcgcctcccgcgccggccgccgccatcctttccgccgccggtcgcctccctgtggttgtctcgccgccgcagccctcggtgagctctccctccgcctcctcctttttcccctcctccgccgctccgcgtgcccgctgtcgcgacgcgctgccgtcgccggcggtcgtctggccgcacgccgccacgcgccgtcgttcgatcgggtcggctttgtgtcgtgcccgtgtcccggctgcgccgcctcgtggccgcccgatcggctttgggccgatccgggccgtcggttcccgtggaccggcggtggaccacctcggtggtcccggtccacggtggaccgacgcccttgtgtcgctgaccgatggggcccacatgtcggcgccagccgccccttgctgacgtcagcgatgatcttttcctttgtaaaaataaataataattacacaataattcgttaataattctagaaattcatttaaatggctcaaaacttctaaaattcatatctaattcattagaactccgaattgagccattcaacttgcaaaattcatctaaaattgagctctacatgtttgtttagtttttatgtactgttttcttggtttttattagagtttttcctcgttttgcgtgccagcgtgtagaatccgtcgtttcggaagtccgcggtcgcgaggaaaagagttcggaagatcaaagtgaagaagcaaggcaagtaacacattccccttgagcatgttgatcccaatttataaatgttttactgtttgcaaataaatatgcatgttttgctaattacatggggtcagggttttacctatctgctcgcttgtgccatgtttacttgatatctgtcctttgtcaagtttgggttataaatcgactagctcgtgttacttatgtgacctagctagaactatatgcttagccatgcttaattaccactagctcagatgatgggataattacagtattagacctttttagtatcagaatgagctgcgtgcttgagacatctggccatgcttcatggtcgtaattatccaactaaaatgcgagtgaatggtgggctgtgggtgcatggttttgctagtcgctcccatggcaattaaggaccggttcacgggaaaccctgaaagaattcctcgtacttaccacaagccagcgtgggcaacggctgggcttgtagtgtagcttttctctagccgacgtacccaggcgagggtgggcgtgatggagttgggtcggccggggtgtccggttgatcggcttccggattcactgcggcacgaaaggggggctgcccgttgcctgctggggacgggggcgaaccctaaggtgtggtgcgatctgttagagggggttatgcgaagggtcctgtcacggcctctttccggtatgtcgtggtggcatatcggcgcacggaaacatgtcgtggggctgtgtcttgtgggtacagttgtacacctctgatcagagtaaaactattcgaatagccgtgcccgcggttatgggcggtcgactagattcaccgtgattagtcctaccttaataaatcgacccagtacactgtagttcaggtgggttggttgggcctgttcaacgtggtgtagcgttgatcagtggagatttaatgttactttaattactcaacagttttactgttttgctcaataaaatgttttgcaaccgcctttatgcaaatagccacaaaccatccttgtatccccttgcacgtctgcatcgttggtgtggcttgctgagtacggtggttgtactcagctttgctattattcccccttttcagaagtgtagtgcttctgagctgaagacgaagttagaagaccaaggctcagaccccagttgagttttgcctgtggagtggagctgaagccccgctaggatcgtctttttccgctgctgctgctttcgtttcggtgcgaggactaagtgcttcttctgtaagtattttacgctttatttacgtttggaactgtatattacttgtcgttttgtgtaccctggctggtcatggacagggatttaatacacaaaatagtctagaaatttgggctaaatttatgggcgtgacaagtactcaatattcctgaccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctatgtggtgtagttcttatgttctatgttggcatgtggctttgcttgtaattcgtttcgaacttatcgatgtgtttatgtttcgtcgtgtaatgtcagacttcggcatgtcatgtctttaggtctcgtgatgtaacatcagactaaggcgcctaacatctttaggtatgctgatgtatgttggacttcgacacgtaatgttatgttatattatcgaactctacatatatgttaaattgcacgtcatcgttatgtaccattagtaacgtttgctatatttaaatagcctgtactcttgttgtacataattattctcatgattttattaatatttcataattttgcaagttatcttttgttttatattactactttttgaattgttctaacacgaaacactatatttttcagagatggcacgtcaggatacacctcagttgttggacccggcgatagatcaccgacaccggtctcaccttactgcggtgcagggggctcagcttgggacgttccaggcactgcgcccaggacttcgctcgtgctgtgagtaccttgcatcgcatcattcctttatgttttcatgtctttctcttcgtgaaattttacgaatatgtacgaacaaattaaccatgcaggtcgacgacatcaaccgggtcgtcgttgacggttcaacgacaatccaacgtttaggcgcggggattccggtacccgtagtgcagttctggcagtacaccgggacttcgtcacaggcacccggcatgtcgagtcagggtccaccactggaccatgctaggaccttatcggaccgcttgctgccttccaccttgctcttcgacatcactgacttcgacttcgcttcaggctcgacagaggacgtcatcggcccctcacagctgggaggcgcaccgccggtgcatacgcaggaccaggcgcaggcctctcctccgccagacactcgtgctacccgtgctgtgccaccggatcgtttcacctactcccaggaccacgtgcgagcacaggcccggaggaccaagcgtggtcgcggcgcggggcagggccagtagagcagtcttctctttttttatttgcttcactttccagtactgtatacttgtgtaatgactacgttgttgttatatgtgcacgatacctttcggcgcatgcacgactactttctgccgcaccgatgcagcctcctttattcgcgtgcgatacgagtatttgcccgccatttggcgcatacgaccaatgtaactttcggcgccgatcaggctgtaactttcggcgccaatcaggcgtacccaccataccccaccatgttcacatgtcaggggtatcactcgattttttgcgcctatataagtcgccttaacgagtgaggcctcacaatctttcagaactcagtcacattcagtactctcttccccacttgcttcattacaaatcctaccggcttttgtcaatggctagacgtcggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccattctcgacctaaccacttgtttacaagaaggtcgctggtatttcgcatccgaaaatactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtctaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaattactagagcaatatagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatttaaccacaatgtaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtactttttacatctgggtccctattggggcggcaagggatccagatgcaaaaagtacggccgcaagctctttatgggcggccaaaattgcgat

SEQ ID NO: 79690 - DNA, 25694 bp, Oryza sativa
ccccctccccctcccccctcacctacctttctcgccttctcctcaagttgaggtgtctttgctccgttgttttccccatctccagcagctccccgcgatcgaatccgccatcacctactgttggcaccacgccgttcatctgtatccaccatccacggttgaccatcacctcccacagttaatcagctatccctccaagcgcgatgatcccctcctctttcttacccctacctagtaccctaaatcctaactgcgctgccttcgtcaaggtcaccgagaggaggagctgggtcactagagtagaatcacgaaacaaatataagggcatgtttggtttatttcaactcctagattcacctcaaatcaagctagagcccaccaaatagtctagctccaaaaaagaaaaatggaacggagcagactagatcgctccacaaaattgtactagcggcgtggagcagcattcccgtagctccacaactccaacttcaactcaatttcagaagtaacccgaaactggaaccaaaattacccgcaaatgcatgtaccgcttcccccacgaagaggagcgcacggtgcgggcgaaaaaagcggtacatcgcactactacaaaattgattttttatggcatcaccttattattttctctagcggttatatgtggaaaccgccagcgaaaatataacaagggatggggggttacaaaccgccagtgaaaataaatcttcactggtggcgagttaaaagagccgctagcaaaaacatagctattttcgctagcggactacttaaatagccgccagcaatttttgctagcaaatgtttaggaacgccgcctgagaaaataaattcaacatataaatacacccacctcagcctccctcctctctctctctctccgcctttctctggaaaacaagaattttcagaatataccaccgattacgcaccgttttcaggataggccactcaattcgcactacttttagaatatgccatttggatgcgaattttcttcgttccgtgacactcccgtccttccaccgtcacttcttaccggcgccagcaattccgtgacggagaaggaggagatgtcacctccggctcaccggccacctcctccgtagacacgcccgttcgccccaccggccattgccggtgagccccaccgtcgacggcggcggcttgtagccgagaggatctggtcgccgaggtcctccacgcgccgctccccgcacgcgcatctggagctcgctggcatgggggaggaggagcttgccgttgcatgaagaagctcgctggtgtgggggaggaggagctcgccggtgtgtgagaggaggagctcgctggtgtgggggagggggagcttgccggtgtgtgggaggaggagctcgccggtgtgtgggagggggagctcgccggtgtgggggaggaggagctcgccggcgtgggtgggggagttcaccgctgtgggggaggaggagcttgcccgcgtggggaacaggagctcgccgatgtgggggaggaggagctcgccagcaggggtacaagagctcgccggcggtgcccagatgagcgcttgaaaatggcgcaagaggaggaactgacgccacgccggttcgggagacggagtgtcacgaactgaagaaaatttgcgtccaaatgacatgttctgaaagtagtgcgaattgagtggcctatcctgaaaactatgcgtattcggtggcatattctgaaaattctcctctctccctactcctctctctccggccttcctctaccactgccggctgccgtggcttccatcgccgccgccgcatccgtcctagggaaagcaagggcgagggggatggatccgctgccggcggcacgcggggagcgcggggcagccactgcccgccgcagggtctcgtcgtcacggtcgtcgccgccgggccgctgggaggacggatccgccgccgtcgagccgcggggagcgcggatccagcgctgccgggccgcggggtggatggatccgccaccgttgacgccgggcaacggggtggatggatccgccgccgtcgagccacggagagcgcgggatccaccgccgccagcacacggggagagcggagccaccaccggccgtggggcctcgtcgttggctgcgtcgcggatctcgttgtcaccgtcgggctgtggggagcgcggatccgccgcccgggctgcgagcggtggtgctcggtcgacgacggcgacaacaggtggtagcggcttaaaatttatgtggatttgtgtttggatttctgtgaatttctatggactcgtgcaacgatccgatccggttagtgtgtttggagatgggaacggaaatttgtgtgattgtgaatggaaatttgtgactgtaaattggtgatgtaaatttatgtggatttgtggatcgatgagtggatttgggattaatttgaactggcgttgacggaggcggacggagcggtgttgctccgtcattttttttagcctcggcaagtattaacattggcagctggtatagtctaccgcctgtgaaaattcattttcactggtggctagcttacaaaaacagctagagaaaatggattggtgctggcggttggctaccgccagcgaaaacactgtattatcactggcctttactcactggcggtggcgttggccgtcagcaaaaactcattttggccgccagcaaaaatagtttttctagtagtgtcggcagcacagcggctgtagtgcaggttccttcccctctctttccctcttctttctcttctcccctcatgtctcttccctctcctgtccatgagattttgaccaccggtggctcttgctacagacaagggtgacggtggaggcgtgaggaagcaagcccccatccctccccccctcccccaagccccaaacggtgtcccctcctcaaacacctagaaatcccccaattttttctttcaaaggtgcatgatttctgtgggatggatttatttttcggggtacattgaatcacagcaggtgttttgttctctatttctctttcaaggtgagatgataatgtctgtaggtgggttgggttgtatgcttgatttattacaagttgtttccacggttctatgacattatttcagattgatgcatatacttgtatttaaggaaaacatgatgtatccaaggatgtattttgtgatgacctagtcgttcgtattacaggataatgtattttgtggtcctgctacccgttattatttctaaacatttttattattacatatatgtcatgcaacaactaaaattttatcaattttactttaatagaaaaaatacccatgtgttgcaacgggtaaaaatattttttcagtgatacaacaactattaagaattgagcaataaattgcatgcctctctttgacttagcccacaagtgaagccacaggcccagctcgcacatacggtgcgtagctcgcacatatggcatcttcaacctacgagagacaatcacgtgcccgtatgccagagccgatcctccctatcaaattgggctgaatctttctcgatattccaaaattggctgagggtgtttgatccgctcgatccctttttatattttttttctcaaaatcggagtaaatccataacactcgggataaaaatggttaggggaagtcaccggtcggccatcattggcgaattgagattaaatctgaataatttaaagtccaattgaaagggaaaacgcgaggaaaataatgaaagataagtgtggaatcgattttttaattaattgaaggagaaaacatacggtgatacaaaccgacgggacagcgggacggaaaaaataatacggcggtaaaaaaacaacgaaaaaatggcgatgagaaaaaccggaggaaggctgatcgggaaaccagcgacaaaaaaataatacgagacagaaaaaaaaacaaaagttttatgtattttttaattagttatatatagatatgaattataaaaaaccaactaaaaatcgactcagaaacggatgacgtacgaagatcctgataaaaatattttcaatttttataatagtagagattaaattttaaccttccatacttatagcgttcaaatcattaataacaataacaactattaatcctacatcaaataaatagaaaaataacaagggtagcattttccatcaccctgggctagccaaacacttttagggctcctttggcagcccgggatcccaccgggatcccagcccattccctgggagaaaggcccgcgggggaaattgtcacgggttttattccatgtccatttggaagcccacgaggcagggatttcccggcccaatccgctaggaaaccctagggaaaggtccccgacctccggaggtcaggaatttttcctctctcgatccgccgctgcttctcgctcgcgcaaccggagtcgcttctctctcgcgcgaacaacagcgggcgccgccgcgcctccttctccggcgagacggccaccgccgggactcctcctccggcgagaagggtaagcccttctccttattcccctcctctcctcctcctgggtttccattctcctcctcctctagggtttccgcctcctctagttagctcccaatctcgctctccggtctcagcgcttgcatcgcaggcaccgacgcgtgggcgcggcgggtggcaccacggcagccggtgcaacgacgacgaagcggcgagccgacagcgcgggcacacggctccaagcaggcggggacaggggggatccaaggcagcgcgactcaccagcagaggaggcgctgaggcgcagatccgcctcctcctcctcgctgcgcgacgcccgccggtggttgcccggctaggtttgtgcgtgcccttgtagctgctgcttgattcttgggggttcgttcagtacttcagttttcttggtgtatgtatggcatgtttcttgatttggtttgggagagttataatctgttctcctattctttctaatacattgtagtattgtaccctgcagtagcatttcattttgttatggaagcgattcagaaggggatatgggtgggcgtgtggtgctcttgttttagatcatgaatgagttttggtaagatgatgttctaatttgatggagtaggttgtgctctggttttttctgcagtgtaattatcatgcttagtgcagtctaaatatgtgagatcaatgtgccagtcccaagaaatgaggaattatcacacatgcagtgaggatcattcaactagtgaggtatatgagaaattttagtctgcaaaccagtaacagtttttttctagttaattagagatgcagttcttttagttagatgctgtcagctctgttaacctagaggtagatctcagtactggttgagctgctagcatcaagttttttgttttttctggaggtattttttagtctgatccattcttgtagtctctgtcagggaactgtagaattagtggtcaatttagcatgcatgttgggactaaataaatggtaacaatcatatttttgataggaactcatacttactacaaaataaagtcttttatgctctatacttatacattagtccaaactttagtttcatgtcatgtatcaccagcagaaaatgagcaaggtggcattgtgcattcaaaaaacacaagctttggcagcaacctatatacaaagacacgcacacacagatgtttcaatctcctctctctcactcgctgcacaatacactggccaaacaaagtgacctagtagtactgattaattaaaacaacaactactactactactttttttccttatcatgtccataatgataattcataattgtgctcttgcattcttcctcttgccaggattcaatttgaattgcatgctcaacttactttcaaatatggacttgaaatagagtattgttggaaaactatcaatacaaaaacatggacttcaaatgcgtttgatttaaaaataatggtgtgtatctgcatgtagggtgtttgataccaagagtttgtttacgctgatgtagctgacaattgcaatatgttggttgatgtgcatgcatttttttacctaagctagtatcaatggccgtccttcaaatttgattgctgaagtatcactattttatatttattacttaaatttcagattatctttttcatcctggcagatttattagaatatatgaagatttgttgaagagatgatgaagaagatagaagagataaagatttaaatggacccatgtctcattcttgatcaagacatttgtggatataaatatgatgtacagttctatatttgtggatgcaaggatgattccaaagattttaaattttgtatgatatggatgattctaaagtttaacttatgtcatgtcacgaagttggtttccacataaactcacctatatttctttgtatttttctgaatttctaatacttgttgattttttatgtttttatatttttttctggaatttttgtaggttgtttcctatttatatggattttctatattctttctatttttcttgaaatttctataatatttctagagacatattttgttgttcaaacactgtttagcagtttgcctgtctaaatcccccttcccccatcaaccccctcaccctactcccaaatggtatcagggaaaattcccctaacaggagtgattcccctggaggtggaaggggatcggttagtgcaggggaaaatctctgtacgggactttttcccgggggtttcctccccctgcatccaaaggagcccttagggataaagctagctcccactagagctagtgtttgaggggaattaactatttgccacttatccaaatggtatttttagatttgccttttttttttgcccttttaaggtgatggcttcttaacaattttaccacttttgtttacgtggcgtgccaacgtggcttgcaaccttaaaaagcagagcgggacccacaaatcagcctctcccctagctttatcttccttctcgttcatcctccagcttgccgacagggaggagctcgctcccaatccggcatccctccctgcctccctccgagcccagcaccggcgagctccctacccccctccaagcctggtgccaacaagctcccttcctccctccaagcctggctccggcgcgtcggaccagttgtgcaagtctacgaagatcgggaccgtcgggttcgtggctcatcgcgcggcggcccttggggcatgctgccatgaggttgcagagcgcggcgagcacgtggtccaccgccataggcgatggagaggttcgacggcgacaagcgacggcgctggcccgatggatagcaggtgtgacgcgcccgctggcgcgatggagaggttcaggagcgtgcgcagcggcgcagggcgtcgtgccgcgcttgctccgtcggcacggcctcgcccaccggagctacgcacgggtggccctccccttagcggcatatctcctcggtggcgggcgtgtggaggtgggcggccgtcctctcagcggcggtgccggagctcggggacaccgggcatggagcgggcttgtccccattggcaagctggaggatgagtgaggaggaagatgaagtgaaggggagagactggcttgtgggtcccactctgctttttaggttacaagtcacgttggcacgccacgtaggtaaaaatggcaaattgttaagaactcatcatcttataagggcaagaaaataagagcaaatttaagaggggtatttggataaatggcaaatgcaatagtgacaaatagttaaattcccaagagtttgaagctagaatttgagttcgagcccttccaaacatgctactccttccatcccaaaataagtgcagttttagcactgttcatgttcaacatttgaccgttcgtcttatttgaaaaacaattatgattagtatttttattattgttagatgataatacatgaatagtactttatgtgactaatatttttaattttttataaattttttaaataagacagatggtcaaaacgctggagacgaatatctatagctgcacttattttgggactggagatagtaggagctatctgaaggagactacgtcgagacagagacaaaacgattacgtaaagcttgatttccgccttcaggggtttctgaacgagagagagacagacggcggcgggcggcggcggcggcggcgagggagccgaagcctgagaggatggtgtttggccggagcaagtcgtcctcgtcgacggcgtctcctccccctgctgcggcggcttcctcggcggccgcggcggcgtgctcggagctgcgtgcggcgtaccacgagtgcttcaaccgctggtacgcggagaagttcgccaaggggcaatggcacaaggacgactgcgtcggcgagtggcacaagtaccgcgcctgcctcgaggtcactcccttctcgccgcctccgaattcgatcacagcatcactgatttattaccgatcccctcaatttgttgcaaagacgactgccctagggattgctcttgtgttttcgcagtttaggatggggtttcatttaagtaggtttttagtttatatggcaagaaatcgagttgttttctagtgtgttggttgctagatcaagttgataaagtggcttatgtaatggtgatggctaaagcctaaaggggattcttctttgaagaatcatctgatttggagctcctagttagacctctgtctgtttgttggtcatgattcaggctaggcggcgcatgcgctgcgctggcctgttgaattcctccgttacaaatgtgtgagattagtgctgcttgattcgctggtgctgattgttcatttttttcgcacttgaagtatggaaacacacacggatctttagggatttagtccaaatcgactatgcaactgtttgggtgagaagtggggctctttgacattcagacattcagagtggagttgtactatatggcagcatagtggctgcaatagagttttgagggaatcgcctttccgtcacttgacagcccttttgtagattgtctatactgtctctttgttatttgatctcataaatcttgatgaaattcatcaggtcaatctttgggctggcctgtcttaagaaaaaaattttgtgctgctgtgtgcaattagaaattcagaaacctttctgaaactagcaatacaggcatctattttccattcttgaacagaagttacacaacggtgtagttgtccttgcatttggtttattggtttatggaaaacagttggggaagaatattctggtattgttgtattgctaactggcatctgaatgctttccaaaccattttcctacatggtgaattcgcaccattgtatcagcttctagccaattgtagttagtgtattgctgactgagaatttgcactagggctagcccagtgtgttggaggttggcaacccagcctgaagatagcccatttgtagcaaaattcaatgttcttgatgagttttgtttcttatagtactaagttatcagaataacgtgaatattcatgttttggggattgagcgcatcaattttctgaaatctgacaaaagagtgatcatgttgtggtattcatcataacatatttgtctgagtatttcccaggatttcttcaatttaacataaatcatgcctcccatcaccattgtttcacttgtgacaggcctctgggtaaattatgttcctcctatgaatatgatgcttgtttttcgctaaacgaatctatggatgttccatgtttttattacttgcaggaacatctggaagacaagaatctcaggcaaatcctattggaatcagaaacatctgcctactatgcccagtttgatgctgattcttcttctcgaaaaggtggcacctcgacgaagtgacaacctagggctaaccacatatgatcaagtttcgcttgactcaacctggattaggagaccctcatagatgaacgaaaaaggtgtttgtattttacatattagatgcatgttcatgctgttgcatcgcgctgcagttcagcagctgagatgtaagcttttccaagatcatattgaactcaaacctacaactttgatgtaccctgaaatttgcagcagtttctcttcctgaatctgggagaacagcttcagctatatgtaaacttaaaaaatattctccaacccaccaattttgtgctgcatcgatgcaaattttcaatacctcctatatgccatcttccaaagtcctttgagcatagttctggtagcgtgacagtgacttgcagtcttggaggctcttgtgttgtccgaatcagatgccttgactttgttgtctattatgatggattcattcaacaaagcttattgtttgtcacataggcctgatcctctctgatgtggtggcaaacaagcagtgaaagctaccagtctaccactcactcagggaagcttcgtagcaaagcaaagcatcagccttcaccttgtccagagcccagagaaaagggatccccttcaagctgctgttcttcatggccaagaaaggcaagaacaactctaccagaagagcctctgcttcttcttcttcttcctctgccgcagccgatggcgatggatcgccatggctgcggctgacggccttcgccgtgctcaccctccactcggctttctctgcatatctggctagagatgacgcgaggctggtcgccctcgtcgtcgtcggctacctcctgatgctggtgctgctgttctatggcctggccgtgcctgtccaacagaagagagactaaggtgaggcttcagcaatcagtcctcaagcatgaacctgccttgtttttttttcctttttgctggtttggttttcttgcatggtttgatcttggtattgaactatggatgttatgtacaaccctgtacatgctgatcaaatgtgtatctgtatgtttaattattgatgttaccaaagaatcacatgtataatataagtaattcgaaagagccacacactatggagttcagtgtacacttgcacaactgcactgagctgttagagttattgtacatatactgatctagatcaatgcttttatttgaatacttgtaccatttgcaactttgatcaggattgtctgctcgagtttgtactttagcggttgcatatattggaggcgtgtgattgatcagaaatgtctagttttgtatacaaatacaagcacttgaacaagaaaatcctttgaagttcacgtcagggaaaaaaaaaagcaatcttcttcacatcaaacaaaaactccctggaaacagtgtaaaagacaatagcatgaaagtcggggatatgcttctgaccatcatcacaccggcagtaaaaaatatcagaaattttgtgttgtagattttcttagtatatgacaatgaagttttttttttttgaacgaaccattcagatgctacattgattattattttaaaaatattcccaccagatcctaaaaaatatgaaaattcaattaaacaaaccaatgatttttaaaaataatctctgaaatctcaattcaaatcaccgtccccatgttttaagcctcttgcaagcaaatatgtagttcttcatactgtaaaaactttgcgatcgaactaataatagttggaaatgggatgcgttaggattttaaaccaaaatacagtacatcgcagcaaatcatcataagttaaatcagatgcctgagatgatttggcgcaagctcgtcccattcaaaagacttgggctgtgtttagatccaaagtttggatccaaacttcagtccttttccatcacatcaacttgtcatacacacacaacttttcagtcacatcattttcaattttaaccaaaatccaaactttggatccaactaaacacagccttggtaacttcaacaatactgtccctagaataaaataaaatgatatgacactagaacagagaatagcttagtactaactacccggctcttaggataaatcgtattgactatacatgtttttcttacttttccaacaagtgctgacctaatcccaacagcaaactcactttcaggctttcagctattcccaaataaattttctgaataaagtcatagacatgacaagataacgttcacagatcaccacaaataaactttcatttcaaccaaaaagaatgcataaatcccatttgtatatgttaccatgaaagagaacataatgatagtactggtaacagatactatgattttgtatgaactgacatgcctcttctcttcagtgggcaatgtcagtcaggctgcaatggtcaacacagagaatcaatgatttgtggtcaatcacaaacaaagagaataatccaagaaccaaatcctaaatcctgcagctaaaactgaacttactagttattacaggtgtaattaagtttccaaagggccttgctgggacaatcatctcatcacagatcatctgtaaatcagaacatcctccttggttgaatagagctgcattagacatgttttcctttcccacaaaaatgttctgtcaagcaagcactatgaacagaaacaaactagtctgtcaggaaggatcaggatcatgcagcaaaagaccaaaagtagttattccggtgaaacagttgcttcggctattcagaacatttgcataagatgaacattagcgatgtaagatacaatgtgtctctcaacttacaaaaacgatatacgagaggttttatgacagtaataatgcccaattttaactattatagcgagttgactgtagtcaacccagccgagtcaacgtagaactcacgcaggatccacactttggcagccaacctttcttcttcctcttttcccctcctccatctctctaggccgggaggcaggcggcatgcctaatttagatgggtctaatttgggccgctaccattggtagagtccaaaaatataggtgggccggatttagtagtcgcgaagtaaattttagcgggcctacatggactaggcttggctagctatctgtctgatagattagatattttgctaggtgggtgctgacgtgttcacctttctctcaaccacacgatatctcatagtcttttactccgaaagttggaggttacacgtgtgctacaaaaaagtttcgagtcacctgtatgccatgacacaaattttcgtttacctatgtgtcattccatccaccttctgttagagaatgagctctgatatatgagacccacatatgaaaatgaccaaattacccttgaagcattttcatctctactactcctctcccgtgcaatgccctagcctagccgccgcctctcctcgccggcacgccaccgcctctctagccgccgccgccgccggtcgtcgccggcacgccgccggtcgcagccgccgccgatttctcttccaaatgttccaaatagagcaagggcaaaatagatctttcaaacctccgttagtctccgttagtgttattccatccaaagtggcgcacaggtaaacgaaagtttatgtaatggcatacagatgactcgaaacttttttgtggcacacgcgtaaccttcaattttattaatggcgtaggggtaaaagactcacgatctcaaattcccaatcgaacggcggacacgaaaccaacgatccagtttaccctcgccgtcgccgccgccgccgccgccggagattccgccggcgttcacgcgtggaagctgcggacctgctcctccgcccccatccgatctccctggagcgaccgccacctccagagtccagaagctcagcttcgccgcccgagctcgatcgccgtcgcgcagcgtcgcagctcgagtgcccccccccccccccccccccgcctccgcttcgtcggcggcgaggggcgacgagctaccggatgcattaccagaatcagcagccaatcgagctcgccgtcgcccgcccacatccacaccagaatctgcagccagccatgtatcagaggtagtattatcttacctgcaatcctgcattatatttttgtatggttttcccgcacgatttgatctttggtactccctccgtttcacagtgtaagtcattctagcattttccacattcatattgatgttaaaagatctatccatctagatttattaacatcaatataaatataggaaatgttagaatgacttacatcgtgaaacggaggaagtatatgtgtagtaacaatcagtctgtatgctcataaaatggtgtgtttatatatatttatttattttaagaatcaaatgtataagcgattcgaaagaagctaacaaactatgaggttcaatatatacttgcacaactgcactaactgaataattaacaatttattgtacatatagcctttgtactcttcgcaacttttatcttcgtcgccttcttggatttatgcttcagcggctgcgtatgtaggaggtgtttgattgatcggaaacataattggtatgcaagcacttgaacaagacaatcctttgaagttcatggcaggaaaaaaaaaagcaaatcttcttcacaacaaaacaaaaactccctgcaaaaaattgtgcacaagacgtcaggaccttcagtggaaaggatatacttttgaaaatcgtcatacttgtagtaactagtaagtataaaaaaaatgcttgttctgaataccaaaaatatcagaaattttatgttctttgagatgatttttttcctgaactaaccgttcagatgctgcattgattaataaccttaaaacttctgcgtccgtgtttcaaaaaatatgaaaattttcaactgaataaaccatgggatataaacaagtgtttgtttgagaagtagattactgtcaaatggataagaaagaactagaaaagtaatctatgaatatgtgatgacttactagttacaattcaaatcactgttcccatattttcagcctcttgcaagcaaatatgttgttcttgatactgcagtaactttgcaaactgaaaataattggaaatgggatgcattagcatttaaaaaaaaagaaatatagcagtaatccatcatgagttagaccaataatacctgagatgctttgaggtcaagctcatcccattcaaaggatggatttgtaccttcaacaattccggcaccagcataaactaaagtgctatgaccctagaacaaacaacagcttggtaactaattggcccttaggatatggtaacaacatggacatatttgacaaaaaaacatcacatcccaattatatgatcaatcgtactgactacatttttttcttacttttcctagtagtgctgatctaatcccaacagcgaactcactttcagctcctccaaaccaaccaacaggtccagcatacattccacggtcaaaaatttctgatggacataacaatagaacattcactgatcaccataaataaaccttactttcatcaaaaaatcttttatcgtcaattttatttgtaattatgaaaataacaatatagttgcaatagattatagaggcacataccataatcttgtatgaattggcgtgcctcttcagtgggcagaccacaaacggctgggctcggatgaagagtatttaggatgtcaaactgcaatggccaggccaacacaaagaatcagatcgggtgtggtcatttttttgacaatatggtaaattaaaatccaaaattcttcttgcaagtaaacccccaaaaattctgaaaattccaatataaaagactgaagaaagccctgaatcatagactacctcatcgtcttcattcctcattcttgcagctaactgagctgacaggtgttgtactcttggaagtttccgaagggccttgctgggatggacaaccacatcatcgcagatcatctgtaaaatataataaattccttggttgaataaaactgcactggccatgttttcccccaataatattcttgcaactaggaacaaaacaaactatgtcagtatcatactaaaaaaaatcagtcagtgtaaaactcaacttgcctccagcttcttctttatgctgtcccgtactatagtaaattcattatcctctttgctactgcaagaaagttttatattaggacctccttttattttcttcacggacggtgttgatatcgccttaaatcatctggagataggttcattatatgtttatgaatcgaagaagggaaaggtaccttagtagcaaatcttgaccaatttgaaagtcatcagcccttgttttcccccttgctcgtgtaccagctaaagcctcgctggaaatgtttaagtatttccgatgaaataattgctctggctattcagaatatttgcataaaatgaacattagttagaacttaggtcattgttatttaacatgagaaggccaaaataagaaaaaacatccaagttcatgtaaatatagtaagagatattctaataaatcatttggagtaaaatcgatacaagagatcacacagaagatgtgatgaaggaatttgtttttcagaatagaattgacatacactatttccaacaaatgcaggagcatcaggtggctgtatacagaactgataagcattttggccctcaacctgtatattcagtgtcagaaagatctaattgttttaacagcaatacaagagatgcaatatacctttaaacatgccaacagttcaacagggtcaatgcaagtatcagtaatatatctgctacaccttgccagtacgacctgcagaaaatatcgatgcaagcttatttcaaaataatgatcacaacatgacttgtctagatttttttttcttttggggaataaacttgtctagattttttctttagcaaacagtaaatgaaatgaataatttacctttactaattctctttgcttccctttaatcatctggagagctttagtaacggcaagatcccaggatgcctttgtggggacatgattaagatttagtatggttgtttgcagggtggaattgttcactttaattggactggatgatatctgcagaaagcacaacaaggttactatcttccacagttccacatgactgacagaattggaagaaagagaaatgcataccttctgcaaagttgattggagctccttcacagcattttgccatgtccaagaaagtgaatcatcccatgcaatcgtcgttgcgagaaccgagctctcttcaagctcattgtactcaacctacaccaagtatcagaaacacttcaaaggagtcagtatcacattccatctattccaatccataactggggtgatcctggtaattaagtaaggacttacttgaggaacaatgaagtaaaatgatccaaattcctcccattcaactgaatgatcgctcgtggcatcgaagcggatagcaccataagcacgaatcagtgggcaatcccttggaagaaatctttatggacataaatcaagtcattgggtcagcaccagcatgaacctcattggaataaaaaaaaataaaagcaatcatgaagcaacaatcaagaaattcaaagataataaaggatcatgtgaatagttcaccatcaccaacaacacagtaggagaccatgtgaagtgttcactgacacagtatgggccaagaccagcatgaagctcattgaaataaataaataaataaatttataaaaacaatcaaggaattcaaagataattcaagatcatataaagaattcactaacacagtgcaagatcatgtggtttttttttctcttgaacacacgcaaaagttttgtgcttcatgataaaggagcaccagagaaaagtgtcttaaaccaatacacaaagcacttccaagtgagcatttatcccttctatttatttttcaggaagaaatcgccgtaaatttcttattaatccaactgaaatttatcaaaaaaattactagcaactagctgttcatttacttcttaaatttgctacgcatggttagtttctactattgtaatctctctatttttttaaaaaaagttaataacatcatatactaccccatcctaaaatataagtatttttattttttgaatagtgtaaatcaaacatttttaactttgactcttaatagcaaaagaataaaaagaaatatgttcaaaatcaataaacggagtatggtgagaaacgtccagggtctacagctaactctatagagtggtgagttagacaacctaagtttgaagcttcaccccttctaataatttgatattaggtcatttcctaatattcatgtctttttagtaggaacatatcctatgcatacaaactttttgtgcacactccgtgcacaataactagcaaatgtcacgaaaaattctataaaaaattgtacacatacttcaaacagtattacatctatatgtaaaattttatcttcaaatttattatattttagccgtaataaaaaatataaaattctgacagatttttacccttaaaactgtcagatttttcatcttttgttactgctaaaatttaatgaatttgaatacgaaactttgcatatatgtgtaatactaataggagtaaatgtctaattttttgtagaacttttcgtgaaatttgctagttagtgagcacgagaagcttatgtgcgtaggatatgtttttagtatagtcaaagttcaaaatcaacatttatcatcatgtattaaaaaatgtagtagtagatggcaccatcgattacctcttgatggcgcgccagtcgcggagggagaacggctcggtcccgcggaagaacacggcggacccgacgccggcgacgctcaccggccgctgccgctgctcccctccgacgccgcctgctccgttgccgttgccgttgccggcggaggcgatggcgagggccgggcactcgggcaagggagcggcggcacgcgcggagaagaagcagcgcgcgcgcaggtcgccctgcgcgtgcagccactccacggcgtcccctcgctgccggacgggcacctcgatgcggatgatgccggagggcgacgccggcgggtcggcggcctccagcgccgccaccgcctccctgagctgccccacggcgtcccccgccgcgcccgccgccggcaacgcccgcgtctcccgcaccgccaccgcccccgcccccgccaccgccgcgccgcacccattcatcgacagcgagcacgacggccgctgcacccatcttcccacctataccaagcaaaagccaagaaatgcgtcaccgatcagctcccggaggaagcagaagcgaaaagaaaccgtgggagagagagagagagtacgtacgagtctcgccgacgggagcgggcggcggccggaggagcgcagggacggcgacgaagacgacggcgacagcgtccgcggtggcggcgccattggctggtttgcgaggtcactgagcggtgtgaggcgtgaggaggaagaagagggtgagtgagagtgaggtgaggggtgccccacgcgcgcgcggaggggagttcgcgtcgcgagggaaagcgcgaagagataagaggagattctctctatttctcagggggataagtggcacaaccgtaattttccacgcccctagctgccagcctgccacgtggcagggggattcctacaggtcagcactgtggtcatttacctttcaccttaaaggcctgtttggaggagcttctagctgctgcagcttttcccagaataaaaacctaggaaacctaatttttgtagattctggttcttagaaagcggctaccaaccagctgcatctcagaatcttaaactcccctaaacatgtcatctagtttccatatcattaaatacattgtaacataagcaaaagtctaatgtagcaagagttaatggtgagagaggtaaaaagataaagaaattatttctcatgcaagaaattatctctacacaagaattaagaatgaaaagatactatctatataagaataaataggtggataaaaagagaaaagagaggtgattggatgggaatttaatttgaaggcacccaacccaggtcatccccaaccctttattatcagtaatatgtttcctcctttggaagaagaaagtagtgttgaataatttaagaaagtagtgttgaataattttgttatcttttgtctcgtctctattatataggagtatatctgaagtccgcatggtacacgaaatcaatcaatcaaacttatctgaaaccattttttttcttttccgacagattttaaacaaatttgcatgcctacgtcacttttatgttccaaaggatattataaacaattcacgcgactattcttttacttttccgacagattttaaacaaattcacatgcctgcgtcgcttttattttcaaaaggatattataaacaattcacgtgcctacgtggtgtagccacagaatgattttttacgtctaagagtacgtgtaattgtacaggtatttagacagggactgaatatgttaatagtactcatttgctcagcatttaaaaccactttactagacaccttgacaagcatataaacagttagtttaattggagcaccataaccacaagcacagtgtggacaatgacagtgtgaaaatagtaacaaaaaattgtcacctagaagcaagttcataattttgccgagcttgaattattggggtgcaagggttgctcattgaacaagtgctaacaccgataacagaaaaaaaaaatcctcaaattaaacatggcagttcttggaatctaatagactgcaacaaccaaaagatgcgcatgcgccaagatgtttttcaactcatctcaatttcatctttgaaatgtaagtacaccctgagaaaaatcaaggcttgagggccaccgcaatgccgacctttgagctcttgtcaatggccttggtgtcaacttctgctgagatggtccacacagactttggcctccactcgtgctggagcagcgcgctggccttgccggaattgttgaagcgggccttcacgacggtaagcgggtcgagagtgtgctgggtaccgaaggtgagggagttctcgttgctcgagaagctgtgggtcagctcagctccaacagctgtggccgaatggttcacaatgtggtaataagatgcagtgagactatctcccttgttgttcctgcaagacagtttcaaatcaattatggattttggatttttggtaaacaatacaatcaactagcaagtcctacatatgggatcagttatatctatctaaagatgaggataatagagattgatgattagttgatatgagatgcaagccaagatacttatttctagattcaacatatttgtttgattttaataaaagaatgtaacaccaaacgtcagttttcaatgttgataaggtgtgtattgtgcaaagtatcttgatcgtatatggtcaactaaaatagtagcggcttttgaatggagatcacaaacatggcttgtaaacattatcttgctctctgtagttaacgagaacaaggaaacatgtcaactacaataagatattaacattgataagtttactctattttatctcatgtttcctaccattattgaaagaggtagatcatgaaacctgataaaaatatatatatataaactctatttgggctataagttgttcagatggcaagaacagacacattgcttctagcgggacagatggaatggtcaataggatgtacaaatgtggatttcacaataacttaaagagttatgaagttagaagatgatgaaggtaacaattcactgtaagcccaagacacttacaggttcaatgacgcgataagatcatcattactgaagctcaatccagcattatatttggtcaagttccccgtggcggtatcaagtgagacatcagcaccaacagcaagagccttggttccaaaaacactggagagattgactacaggactggcagtcaaaccaatacttgcactaacaccagcataatcatgcgagtattgaagctcaaactgaaaccaaaaagagggagagtgaggacaaccaaccaagaaggtttcattgaaaataagcagtaatgtggtgcatgagcaaattacctttccagatctttgatccggaacagcaaagctcaagatggacttcaatcctggtgttagctcatcaacggttacagtagtaacaacctggccaaagatagaagcagtcaatacaaaaaagggagagcatggcataacagctaatcacagaacatattgctcaatgcaatcaaaactagtagcatattcggtacgaattcgtcagatggcaacgtaaaatcatttcatatagaacaaggattcaaaccattgcaatgtagcaggcaaccacaaaatctaaataagttgtgtgcaagtttatttgggtgtgtctgtgtatttcatatagaacaaggatttcagaccattgcaatgtagaaggcaatcacaaaatgtaaattagttgtgtgcacgtttatctgtgtgtatgtgtgcgcaagcgtgtgcacacgatgtgtgtgcgtgagagaaagagtcatacatttgagtctgagtttgctttcacatctacagtgatgttcttgttctttatctgtgattggatctcaccaaaaatcagatcagccttctttgtactggtagcagtgattgcctgcatcaaggaataacaagtcaaagagctaaacaaataacatcatagctgccacaacaggcatgattgtatcaaaatttacaatcatacaggaaaagcaacactaagataaccctcaaatatacaccccaaccagtcaccacctttacaagctatcattacgaacatgtaattgattagtacagcctttagtagtttaggttattccaacaatacaagacagttttgtgtttattatgcacaaaattcactttcatcaatgcttctcttagcaggagcacacttcaactattccacttacaagcacttgcatgaagggatttctcccataacttttagttttctttaaaaaccgtaagcataccaagggcaaagtataataattgcataatgtaccaaacaagagtcctccctgcttcagtaatagacttgctttcttaaataaagaagactaattaaactaatgttctgcaaccaacaagttcatgttcaaccctctttcaaaacaatcaaaccaccaatcagttgccaagcatgctgttgttttaacccaactccctacctatcattatcaataacaaaaaagacctacctaggatatagattactcctaaatcattttaccactatccaagagataatctctcgaacaatcttttagcttacaaatcccgcgtctcactaagcaacaggtacattgctaatcctcctaaacaagcgaaacaaaccaaggcacaagcgagacctggcaaatctcccggcattcatatacctcctacaatccactaactatggactataaataaactaatccatcgcaaagatcacacatcacacattaacaacagcaggtaggggcagtaaatcacacaaataaatcaagaaagcctcttacatacaacaagtcaacaacaaaaaaaactcgagagcacttacgacgccattgctggtgtaggtggtgagggtgaacttgtggtcggtctggtagtccctgtacagcagatctgcagcaaaaacaaacaactcatcatcaacaacaaacaaacaaacaaacaaacaaacaaaaagaaaatcaaatccaagaaccaccaaagctctaatcccacaagagaaggggacgcggccgctcacccctggccttcttgccgatctccgggtacaggcctggccccaccatctcctcgtcgacgacgcgatgcggcggcggatagcttgcgcgggtgggaggaggaagaagaaggcggcggcggataggaggtggaggttgcgggagaggagaggagaggagaaaataaaggcggaggaaaaaaaaaacacggcgcggcgaggctgcgtgtgggccctgataaaccctagatttttatttcgtttctggttttatctttttttttcttcggtttttttctttattttatcctttgcttctgttatatcttgagttcaaatgacgttgttatctctagatgtctcaagtatctaacccgtcctttggtatcatcttggtatcggatttttttttgttgttcaaaattcaaatggtttataaatttgtgatgatatcaggtgcagaatgggttagttcaataatattttaaccatttattgcaaataaatgtaaatactatttcattgaatctaaatttcacattttcataattcacaattgaaagtatattgtatgcctcttatcatctacttgttaacttatcagctacaatattttaaaacttaattttgatgtgttttcatcacaatctaattttcagcactgtcttttacacccaacataatatagatataaaacttttttcaaaatttattataattgtttcgtttattttgtcacgacttgtcagttataactcaaaaggtcaaagcctatgtcaactaataacctggttgtgcagctataattatgtgttgcttttgttgtgccccatagcattttcattttttcagagtagctgaatacacaggctggagatgtggctgtctagcctgctgagacttgagagctagagcatcaaacgggtttattcttttccaaaccatgtgattgaatgtaaggattctaaggcatatattctctattcaacaagatgtacatgattgagcgatgtataatcaaatagtccttttgatattgtgtctaaacttttgatcaaaatcttgtctagctagattcatatgttcttatgttccaaatcacgaatgcattgcaattgtatacagagtgcatatcggtataatggaaaatattgaaaatgcgacaaaggtccatgatatatacatatcttgatccaatggtccaaatggccaatggataataaatacataataccgtgtgtgggtttttatttccattgcagcttaaatgtaactaaggctgtattcttttctttaaaaccaggaaatagagaaataaaatagttcttctgctagattcttatattttcatggaacccaccgtattgcctgcttatacatatatattgtgagattttcaataacaaatacttacttttgccctaactccaaactgtaacttctttattttccattaacacgttttttttcaatctgttaaatggtgtgcgtgtgttttttttgcaaaatcttttatatagaagtttattttaaaaatcaaataaacttatatttaaattttataatcattaatattcaattaattatactctaatggcttacttcgttttagctgtcgtaaaaaagctaaaccaaatatatccaaactaggcctaactcttcatcagccaatgagtgaatgtaccgtgaaagtatagcacgaatgtcatttgaggttccattagaaaaaaaaatggaaaagcaaaataaaaagggcaagttagggatgacttaggataaagaaagagttggatgttgatttacaagccatggtacattaggcaattaaaattcgactaaggtgacattcttataaagctgtctccatagcaaacacggcaattttagttaaaaaaataaa

SEQ ID NO: 79691 - DNA, 35734 bp, Oryza sativa
  unsure (1)..(35734): unsure at all n locations
ccgaccccctatggtgttggcgccacgtgtgtgggttaggtgagcacagcggcgctcacctaaccgcacttattgcgggttggacgagcgcgccacgccgcatttaatgcaagcgcagcgcgctcgcttatccggtccgtgaccggtcgcagtatgtgaccggtcacagaccggtcagatcgcgggttaggtggcaacaggcggcctgacactcgtctcgccccgtcccgtcggaatgatgagagcctccaggcactcgtccctagccggagccggcgtggtaactcctggagttggcacgtcagtcccggccagattcatgccaggcttcatcgcaaccattgcaaggaagtcattgtatgaagaaggacagatgtgcggcatgctaaactgacgcgtggtggacaagaatgaccggtctgtgactggtctgacgccggtcacgtcatcggcagacaaaccgtgctcccatgttgtatttgcttccagcgaagtggaggtaggtatgacccatcccatcggagggtcattcggagcagccattgtaaatcctcacccaaaagaaggggaggtagaagtggtgcatgtggtatccccttgagatataaaaggaggaccttacccaccgaagaaagggatccgggatccgggatccgggaggaggagaacttagagaatacctgagctgatagaggagagaaagagaaagaggggttctagagcctgtactctcttgctttccagttctctgtaaccccttcacacacagatccaccagaacacaggagtagggtattacgcttctcagcggcccgaacctgtctacatcgcccgtgtctcgtgcattttctctctcgcgtacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgccccaagcttctcctgttcagcccaatggccgaacgggcagtggcacacaacctctctccgagcactagcggtgacgacggggagcaaaacccgcgccgtcgagctcgtactccaccgcccccctctcgctgaagtcttgggctggaggaggcgctcgagggggtcgaaagatccgcgacttcgccacctacgggcgatggagaaggacggctagacggggagcgtcgcctcctcgtctacggcgatggcagcacgccccagggcgcgctccaggctgcgggcgcgctcctgcgtcacccgcccgtcgtccccgatccagagactccagcccgacgttggctggatgacgtggccgacttggtcatgacggcgcagcagcgcctagacgccggcgggcggtcctccgccaccaaggcctctggcgctgctaccgccggctccgtgtcgtcgaggcggagggcgcggcgagcggcggccgtcaactgccgtttgtccgccattccctcgtcaacgcctccgacccaagaagatgtgcgtggggggctggatgcccgcctcaatatcgagcgccggcgcaatggtcgtcgtgctgcccatgcaacggagggcgcttcctcgtccggagcgccacttcggcccgggcacgggggccacccccccgtgtccccggttggcggtgtcggctgtcgagcctttgtggcgagtcttcggaacatccgttggcccccaaggttccggcctaccatcaccgaaaaatacgacgggagcgtcaaccccgccatgtttctccaggtctacacgaccgggatcgaggccgccgggggtgacgacagggtcatggcgaatttcttccccatggccctgaaaggtcaggcgcggggttggctaatgaacttgccacccgcgtcggtccactcttgggaggatttgtgccagcagttcactatgaacttccagggcacatatccacgcccgggtgaagaagccgacttgcatgcggtacagcgaagggacgatgagtctcttcgctcgtacattcagcggttctgtcaagtccgcaacaccataccatgcatcctcgcacacacggtgatctacgcgttcagggggggtgtgcggcataaccgcatgctcgagaagattgcctccaaggagccccagaccaccgcggagctttttcagctcgcggaccgtgtggctcgcaaggaggaggcctggacctggaactcctccggttccggtgtggcagctccggccgcccccggatccgccgctcggtcagggcgacgggacaggaggaggaagaagaggtcggcccattccgacgacgagggtcacgtcctcgccgttgagggcgcttcgcgggccacccgaaaggggaggcctgcgagcgacaaaaagaaggaggccggcgctcccagcagggagcgcccgaccggcaagtggtgttccgtgcacaacacctccctccatgacctcgcggattgccgcgcggtcaaaagtttggctgagcggacgaggaagtgggaggaggagaggaggcaggagcgccgtgagggcaaggccccggcggctcccgccggcaaccggcgaggtgaggccaagcagaaggccaccgccgaggacgtcgacgatggtgacgatgacctggggttccaggagcctagggccaccgtcgccaccgtcgatgggggagcgtgcgctcacgcttctcgccggagcctcaaggccttgaagcgagagcttctggccgcggcccccacccatgaggcgacgtggcgggcgcgatggtcggaggtggccctcaccttcgaccagaccgaccacccgccgtgcgttgcccggggaggacagatcgcgatggtggtttcccccaccgtttccaatgtgaagttggggcgtgtcctcatagatgggggtgcagccctcaacatcctttcccctgcagcctttgacgccatcaaggccccggggatggtgctccggccatcccagccgatcatcggtgtgacgccggggcacacttggccgctgggtcatatcgaccttccggtcactttcggtggttccgccaacttctgcacggagcgggtgaacttcgatgtggcggacctcagtctgccctacaacgtggtcctggggaggcccgcgttggtgaagttcatggcggcggtccactacgcctatcttcagatgaagatgccgggccccggtggccccatcaccgtccatggcgacctcaaagtcgcgcttgcttgtatggagcagcgcgcggaccacctcgccgcagcgtccaagcccgcgggtggcgacgagaggctcagcccctccgtcccagccaccccgaggcagcggatgatcacatgcgacgaggtcccggtcaaggaggttgccttaggcgacggcccgtccaagaccacacgaatcagtggtcttctggacgacaaataggaagacgcgctcgtctctttcctgtgggcaaacgcagacgtcttcgcctggagaccggcggacatgcccggggtccccagggaggtgattgagcaccgtctcgccgtgcggccgggcgcaaggccggtccggcagaaagtgcggcggcaggccccggaacgacaagccttcatccgcgaggaggtggcgcgacttctggaggccggattcatccgcgaggtcatccatccggagtggctggcgaacccggtcgtcgtccccaaggcgaacggcaagcttcggatgtgcatcgactacaccgacctcaacaagtcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagttaggacgcaatgttgaggcctatgttgatgacttggttgtgaagacgcacaaccaagagaccttactctcagacctagcggaaactttcgaaagtctccgctccgcccgcataaagttgaaccccgataagtgcgtgttcggtgtgcccgcgggcaagcttctcgggttcttggtctctgcccgaggcatcgaggccaaccccgagaagatacgagctatagagcggatgcgcccccccagtaagcttagggatgtgcagtgcatcaccggctgcatggccgccctaagtcggttcatatcgaggctgggagagaaggcgctacccctatttaagctcctcaaatgctccgggccgtttacctggacggaggaggctgagcgggccctcactcagttgaaggcgtacctcagttctcccccggtcctagtcgccccgaagccagatgagccgttgctactttacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccgaggcccccgacggccggagctggccctccgcccgcttgtccaacggtaccaggcgcccccgacccccaggaaggccccggggccactgcgggaaggccgcgcctgtcgccctctgaccccgaggtcatcggcacagaagccgagtgcgccccgcgtggcctctcgggcgaagagcgccctcgagatgcggcccctagcgacgaggatcggccccgccgaaaggtgcagcggcccgtctacttcgttagcgaggccctccaggacgccaagacccgataccctcaggcccagaagatgctttacgctattttgatggcttcgaggaagttgcgccattatttccaggcgcatcgggtcacggtggttacgtcttacccctcggccaaatcttgcataaccgagaaggtactggacgagtggtgaaatgagcaatcgaactctctgagttcgatttgcactttgaaccacgccacacgatcaagagccaggccctcgccgactttgtggcagagtggaccccagctcccgagcccgtctccgtccccgaggctagctctggccccgcacagctgcctcacaccacctactgggtgatgcagttcgacggctccctgtctcttcagggcgccggtgcgggggtcacgttgacctcgccgagcggagacgtcctcagatacctggttcgcctcgactttcgggcaaccaataatatggcggagtacgagggactccttgcaggactcagggtggcagctggactggggatccgccgcctcctggtgttaggcgactcccagctggtcgttaaccaggtctgtaaggagtaccggtgctctgacccgcagatggatgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgctttcctcggaaacaaggcgtcgagcttctcgccgatatccatgaaggcgagtgcggagcccattccgcctcacgcaccttggttggcaaggcctttcgccagggtttctattggtcgacggctctcaatgatgcggtcgacctggtccggcgatgcagggcgtgccagttccacgccaggcaaacccatcagccggcctaggccctgcagaccatacctctttcgtggccgtttgctgtctgggggctcgatatcctgggtccgtttaggcgggccccgggcgggttcgagtatctgtatgtcgctatcgacaagttcactaagtggcccgaggcttatccggtcatcaagatcgataagcactccgcgctttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgtaagggagtacaaggggataataatataggggttaagttttgcagaaatccgcatttaaaagtcacttagttgcccaaagccattttataaggacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattcgacattttagttattgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccacaataatccaacaattccctactgtccaaatgatatgagatttcccaaagtctaaagttataaaaccacctaatgttgcctaattaaccagcgaagcttctacctaagttcatactagtggaaccataaatagagtacccactagttggggttttattttcctggggtgaacaaggtaataataacaatagcaataataatgtcttaacaatgataaataggcatggctaaataaaacagtgataacgcgggaatttagataaagcggtaatgcattaatttaaatcaaaataattttataaactgggattcaatatgctcaaggatgatgtgacttgccttgctcgctttcccaaacttcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagctcaaatggccaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctctcggtccacggtggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcgacgcgcccgcgccccgatggtcgccgctggcgaccaccggcgcgacggagcggcgcccgagagaggggagggaagggggaagcgaaatgggcggtccacggctcaccccgggtcaacggcgacgacggaaacggcgaccgaagcggagagaggcggcggcgcggttcgggtcgacgaggacggcggcgttccggcggtcggcgggcgaaacgaaggggtggacgaggtcggcgaggacgcggcgaagccgaaggaggcgatgccgaagcgggaggaggtccgaggcgacgacggcggcggaccgaagctcggcggcgacggcggagagagaggacgacggcgcgagctcgattccgacggggagagagagcggcgagcggcggaaacggaggagggaggcacggggagcgtttatatagtgttgggagggggagagagcgaccggatgagggggaatcggccgcggaagatccggccgccattgatgcgccggcgaagtttgcgggagggtttccgaacgaatccgagggagagagagagggaaaagtggggggaaagggagagggaatcacggggagtgatttccccctctttattgcacgcggggacggcgggatgcggcggaatccgcggcggcggcggcgctagggcacggacgaggcggcgggtgcggcgcgaggacagggatgacaggtgggccccacccatcagcgagggtggcgggcgggcccgcccgtcagcggtgcgcgcgaggggagaggccggatgggccgcgggggagaggagggagagggagagagatgggccgagccggcccaagagggggagggaggggggaaaaagactttttagtgtttttctttttataaaattattttaactttgtttatttcttaataattattatttgtgctctgaaaattccactaaaatttgagggctcctttttgaccaaggagaatttaacaaaaattctccgggccacatttgaatttttcttgcacgtattttaatgtttgccaatttcttttcgaattttaattaattctattattccttttagagaatgatttttatttcgggatgaatttatcaggacgtgacacgcttaaattgatcaggggcatcactgctccgtttggggtgcctaaccgtatcattacggataacggcacccagttcactagtgaactcttcggtgactactgcgaagacatgggcatcaagctctgcttcacctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctaaggtcccctcgggccaccatgtattgcgagactgatcaagatcagcttcgcagagacgacctcgactacttggaggagcgaaggcggcgcgcggccctccgagccgcgcgctaccagcagagcctgcggcgctaccatcagcgccacgtccgggcccgatcactctgcatcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgacgcttctacccctagtcggagtcgggtgtcaggtctcgggctcgggccaaccccgcactcccccggacgtgcagggttggccgggggctaccacatgcatatatacttaccttttttctcttccatatttcaataaaagcattttcgatttcctaaggaatgtgtctgtgccattgtttccttttgaagaatcttggcttgaattagcacgctcgtgctcgatcctgccctcggtggcccgggccggctaaaatcgccaaaaggggcccagaaccgagccgtgccccggggcgtggtgaactccgggggggaatcggcaaaggcccacaatcgggtcacccataaccctcggtcaccacgttcccggcctggccagtctcgacacgtggatcttcccaggcactagccccgacccgcgccatttgaggctgggacctgggcacgagcccttgttcaagccaagatgcagaaggaccgcggcacagaccatcctcgtctcatacacgcaacaaatagaattgacacagaaatttcatctttatttgattgcagattaaattagtctatacaagaagggagcccgaaggcctcagaagaaaaaggaaaaagctattaagattggcgggggccctaggggctcacttcgacgcacccgggtcgccagcctcgtcgtcgctgtcatccgcaccaccgtcaccgccctcctcgtcggagtcgagggcgaacgcgagccgaggggccgtaccctcgaagctgtggacgatgtagtcggcggcgtcccggacctgcgcgcgcgcgccgtcctcggttccgggagggaactcgtccagcgctgcccacggggagaagtcggggtccctggcctggtagcttgccagtacgagctccactgccccccgggcgaggtctctcgaggatgacttgatcgtcttctcgagctcctcgaggagccgctggagggtcccagccatctctgagaggcgctgggcgaggcccccctggttggcggcgtacttcgcggtccgctcgccccagaggcccgcctgccccccggcgtggtctaaacgggagacggcgtcccgaagcatgccgggccctacctcgcccgccaagcggagggcctcgacctccccggcggacgagtccagcgcgccctgcagctcggcgatggtgtgttcggcagctgcgaggcgggcggctaagtcgctgtcgcccgcggccgccccaccgctgcgcgctctcgcgtccagctccttagcccgcgcctcgagctcagcggcccgccgagccagtgcggccctctcggcgcgggcgccttccagattgcggcgcgcctgctcctcctgcgctgcctcgcggaagaacaggttgtccgccagccgctgcgccgcggcctcggcctcctcgagagctcgctcccgctcggtgagcgtatcctcgcagaggcagagtgcggactcctcttcggcgcaggcggcctcgtgcgccgccagtgtggcctcccagatggcgagggcggcctcgcggtccgccaggtccctctcctttgcgcgggcacgctcttccagcgccgtggagcgagcttcaagggcctcttcgcgccgccgggacgccgcctcgttctccgccgcccgccgttcccgggcagcggcggcgtcaaggactccccgggcggcgtcgagcttcttctctagctccaccgcccggctcccgtattggagacggaggtcgtcccgcacctcgtcgagcacggcggtggcgatgagggcagtctcccgctcctcctccacctccctggcgatctccgccagctccctccgacgggcctcgagctctgaggcgtgccggcggtgtgccttgcggcccgcctccaccatggcctccaccgagcgtcgcccctcttcgacgcgtgcccacgccgcgtcgagctccacccgctccgcctgcaggacctccatctgggcgcttaacccgtccaacaccgtggtgttcgcggcggctaaggcctgcaggaggggctccgcgctcggtagggcagcagaaggcagaggagagagccgcctcggtgtgggcgccgcgcggctcggcccgccgatcgacgtgccggactcgggggcgtcccccgaagttggctcgttccgaacgtcgtccgaggggtcggacccgagcggtgcgcccgcggcctcgtcgtgggtggcctcggaagtcgccgtcgcctcgggcggagtcgggtcgggggattggcagaccgcctggtgtgcgcgtgccgcctccacctcccggacggactcctcggcccggcggagtctggcctcctcccgagcgacttcctcagcctggcgaaccgggacggcctcctgggcagcttcctcggcttcccggagacggtctgcggcttctcgccggtcagcttcccgcctccgggcctccgcggtcgccgcctcctcggcctcagatcggccggacttggaatggcgaggggggcgcgacgggatctcgctgaagcagaagaaaaaccagaagacaaaaagaaacgggtaagtgaaaactcgccttgggagataggagaatgagtacggccgcggtgggcgcggggacgaacctgcggggaggtcggctaaacgaccaccttgggggtgagatgaggtttccccggcatgtttcggtctcccccatcttgcggagccgcttcttctttcgctccccctcgggccgcggcgtcggcacggcactctccgggcgcctgctgctggcacgcaccgccccgccccctcggggaggagatggggaaggggtaccctcctgcttcctcttcccccgggcgtcggcagggcggctgcccctcgggcccccgtcgcggggcccagaagcacgaccccctcccggggtagattgttcccccctgcggctcccacccgcgccatcgtggcctcgaggagcccgctcctccgacgccccgaccgcctgcatgatggtcaggatgttggcgcgatctggatcgctgcagagggggaggactccttgggggatgagggatgcctccacggagctgagattcaacacccgttggaccaccatcttgaagtcctcaggggcccagtcccatctgcccccctggtgggtcctcatgtaatcctcggacccggtgtactcccaggcgccccgggcacgccgctggagcggcgcgatccggcgacgaaggtagtcgccgtacaccatggcccctctgagcccctgggatcgcagacccgccaggcggtcaagaacgacgtcgtagccgtctcccagatctaccggcgcccgccagctggaggcctgcgccaggggctggctcggaagtcggaggcgcgcttcgtcggcgagggggtgtagaaccagtcgctcttccagtcgtcccacttcttgcggaggacgcagggaatgtagcggctcagcaccggcccccgcggctggaagtagcagccaccgactaccgacggcggcgacaccggctgtgcggtgaagaaccaccggaacagccgaagagatgggcgcaccccgataaacatctcgcacaggtgcgcgaagatggccaacatcattaccacgttgggggtgaggtgcgccatctggagattataaaactccataacatccatgaagaaagaagagaatggcgggaccagccctgccattgcgaaagagagaaagaagacggaccgccccgggtagtgtggcgccgggcgtccctcgcccagctcgaccacctcccggccggtggcagattccggcatgaatcggcgcagcagcccggcctgcctctcgctcacgatgcgagaaggcggcagcatgcttccgtcgagcagtgcggagccccgtgccatgacgccggcggaggaaaaagcttgagagcgagcgagagcggcaagggtagggcacaggaaatgaagagttagagcgcaagcggcgaaagcaaggggaatagtggcgagaggaaggaaacaaatctcttcctcggcgcctttatacccttgccaacgctatgcccggctcctcgtttcccgcgcccactatctcgccccctcgtttctcgcgcccacgcctccactaatcccactcgcccgtttgcggcgcacgaggcggatgtgcggccgtggcagtcgagatgggacagatcgagcacgcgttaactacactcgccgaccgaagcgccatcatcatgtctccaggcgaaacgaatcagcacgattcgcacgctgctcgactaatgtagcggtcgcgaagagaccgctcattattgtcagtcggttttcccttaccgatgcgcacgatttgcgatcgctggctttctgcccgccagtagagaccggccccacctgtcaccaaggagtggcgtcacgcccgagcgcttccctcgaggggggcgatcgccctggcataacgccgggggctactgtcggtgacatgggaccgggagtatcgtgactagaggcttgggcagccgcgctcacccacgtggcctgaccccctcgggggggtcgggcccgagggtgacgtggccacccctccctctgtctccccgaggggtcgggccgctcccgtctcagccccgagggctggggcgccccgaccccctatggtgttggcgccacgtgtgtgggttaggtgagcacagcggcgctcacctaaccgcacttattgcgggttggacgagcgcgccacgccgcatttaatacaagcgcagcgcgctcgcttatccggtccgtgaccggtcgcagtatgtgaccggtcacagaccggtcagatcgcgggttaggtggcaacaggcggcctgacactcgtctcgccccgtcccgtcggaatgatgagagcctccaggcactcgtccctagccggagccggcgtggtaactcctggagttggcacgtcagtcccggccagattcatgccaggcttcatcgcaaccattgcaaggaagtcattgtatgaagaaggacagatgtgcggcatgctaaactgacgcgtggtggacaagaatgaccggtctgtgactggtctgacgccggtcacgtcatcggcagacaaaccgtgctcccatgttgtatttgcttccggcgaagtggaggtaggtatgacccatcccatcggagggtcattcggagcagccattgtaaatcctcacccaaaagaaggggaggtagaagtggtgcatgtggtatccccttgagatataaaaggaggaccttacccaccgaagaaagggatccgggatccgggatccgggaggaggagaacttagagaatacctgagctgatagaggagagaaagagaaagaggggttctagagcctgtactctcttgctttccagttctctgtaaccccttcacacacagatccaccagaacacaggagtagggtattacgcttctcagcggcccgaacctgtctacatcgcccgtgtctcgtgcattttctctctcgcgtacattccacagatcgagggtgaagaacctcacttagcgcccccggccgaaccggcaaaggggggcctgcgcggtctcccggtgaggagccccatgctccgtcaccatgcaagtgtatcgagagagaagaggaatggcttaactcatgcacaattggtacgggctaatttcagtgaaatagacctagctagtgaataatcggaaaatattacagagaacggaaggtaatagtggggcttactatgcattccccgttcaccaaatatggaagatacgatgccaaaaataggagggacgacaagctatctttgacaggtttgaacgaagaacatggttccattttgccttgtaccgatttggtttgctacctgtagtgttgtgtgcttgttggtacaattttaagtgcgatggttcgatttatttcatacaccgatgatgccctaattagtagtgaggcataacaaatttaaactaaaatatacgaccttctggaccgtaaaatcgctcatattgtacacgacatgaacatactgtgccctggcctttgtgccactagcaaaaaaaaaaaagagaaatgaaatgagtcaaatgctaacgaaaaaaaaatcgaaaaagacgtacatgaagtacagaatgctagttcagatttagtgtgttaggcatcatttctgtatactttacataatgagctttttaacatatcatttgatgctgcttaattacaaccgatgcgcgcgctaatgtgggttgatttccgagttagttgatggcgacgctggcgaattcgtcgccgtcgatcgaggagtagaaggagtgctcgtcgttggcgtcctcctccttcccccccttgagctcctcgatgctctccaccgccgtcttgagctcccaccggctgtccacggcggcctcgcagcacgccatcccgatcttgatcagcttcaccatctcccccttgctctcctcgtcctcccacttcctgatcatgtccgcgtccaccaccttctccagccactccccctccggcgtcgacgccaccgctccgacgaggtcgccgttcgccgtcgccgcctccggctgcggcggcgggtcgtaggacggcggccggccggtgaggatctcgaggatgaggatgccgaggcaccagacgtcgctcttcttggaggagcggccgaactgcctccgctccggcgacttgaaggccaccatgagctgcgccgagtgcgactggttcatcaccgggaccagcgagtagtcggtgagcagcggttcgaagcggtcgttgaggaggatgttggacgacttgaggtggccgtgcggcaccgtcagcatcggcagctcgtcgtacaggtattggagcgctcgcgccacccccttcaccagcttcagcctcgccggccagtgcaccagcttcttcaccctccgaccctcacctacaaatccacacccccccccccccaaaagaaaattagcttcaatgatgaaaaattatagaaaagtaaatgaaacaacttaaaacaataatttacgagtcaaaacttttattatacctaagttatcatttgttggggttgaaaaataggtaaatttgatccatgccattacaaatttaccgtattaaaaatattattaatattctgaaacatgttgtgggggcattgaaattttctaaaactcgaatcatcctcatggcagaaaatttgacggcgatgccatggtttgaaaatttagaaaattctggtggcacgcaacaagttccacgaataataatgttatatttctaatacggtaaatttataatggcattgatccaatctaccaaaaaaaactaggataaaaggaatactccaaaacaaactttaaaaatcaagtttgaaacctggaactctgattgtggcttaaaattaaaatttaaacattaaatttgagtgtggattataataagccaacaaggaagctaataaaaagaaagaaatgtggtgtgtgtggattaccgtggaggaggtgagcaaggctcttgttggggacgtagtcgtggatgaggagcttctcctccttgcggtagtagtaggagatgagcgggaggaggttggggtgggagaggcggccgagccgccgcatgtgctcctcgaagtcctccttccccacgcggttcatctccttgaaccgcttcaccaccacggagtggccgccggtgagcgtagcgcggtagcacacgccgaggttggcggcgccgagcacctccgccgacgccttcagcaggtcctgcagctcgaagaacctccccctgtcgtcgtcccgcacgaacgtcagccgcccttgctcccccgccttcccgccgccgcccctcgccgtgctcccgctcacgctgctgcttcgcgcgccgcctcctccggtggtggcggctgcggcggtggcggcggcggcggcgtgcgtgggcttggttgctggtgacgcgggagctgatggcaatgtgggcttggttgaagctgcagggccgaagttctgggtgttgtactctcgccgcctctggagctcgaccaccgcgaagccgatgatggccagcgtgccgaggaacgcggcgaggacgccgaacgacgtcgatcccttggtgggcttcgtcgcgccctgcgtcccctcctcggctggcactgtgcccgttgtggttgtctcggcggcggccgtgggagacggcgaggtcccgatcttgccggatgtcgccgccggcggcgacgtcgttgccgctggggatggcgcctcgcatttcgcgtcgactggcgcgccgcagagcttcttgttgccctcgaacatctgtggatcgattgatttgaggctcgccgggatctccccatccagctcgttgttggagacgtcgaacaccttgagatccttctgggggaagtcggggatcttgcccgtgaacttgttgtcgttgagctggaggtcgaggagcctcggcacggcggcgagcgaggccgggatggcgccggtgaagccgttccgcgacagggacaccttcttgagccagcccatcccggcgaacgcgtcggcggggatctcgccggagaacttgttcccggacaggaagatggcgcggagcccgccgaggcccttcacgtcgggcatggcgccggcgaactcgttgtccatgaagctgagcgtgcggaggccggtgaggctcttgagcggggcgaggtcgagctcgccggacaggccctccttctccagctgcaggccgagcacgctgcccttgctgcacaccacgccggcccacgccgaggtgccgccatcgcaggggctcgtgccggcggcccaggtgtccagcgcgccgccgccgtccacgatgccggccttgagcttgagcagcgcgtcggcttcctccgccggcgccgccgccaggaggcgcgcggcgtcggcgaggaggcagaggcaggaggagacggctagcacgcgcaggaggcacggcgctccggccatgtccagcccgccggcgccagcgcctcgacgacggcggggcggggtggtgggggtggcgcacgtagctttctccggagaggaaaagtaggagagatcgcggggaagagagctgattcaggagagagctctcttccgcgcgcgcgcgcgttggagagagagagagagagagagagagagagagagagagagagagagagagagagagagagagagagagatggggcgtcgagctagctggccgcatggccatggccatggctgtggccgttgctgttgctgcctaactatagcaaattcaaccatctctctctctcagctacgactaacctggacttactacctcaattagcaaattcaacctgtcaatttcagaattgccacattactaatccaaccacatgatctgaatctttttttttacatttatacaccagaagttcagaatgatactccctccgttttagattataagtcgttttgactttggttaaaatcaaactaatttaaatttatagataaatatattaatatttacaacaccaaattagatcaattaaatgataatggaacatattttcataatatatttatcttggattaaaaatattattactttttctatacaaacttgatcaaatttgaaataatttgattttgaccgaagtcaaacgacctataatatgaaacggagggagtagacgattatatgtacatcgtccaattgctgaaacataccacactcataaacatttactgacacattgcataattgcgttcttgcaaactggtgaggaaattttaacaattaacacgagctaataattaattaagagaggactttgcttagaatccatagcacgagagtcatctcgaaggcgaagatggtgtggagcaatcccctgtccagcgtgaacccgaacagtgtgatcccgccgctgttgtggcacaggtacgtcactgcaacgacaaaaaatggcgcgagcgagtgaatttaaatctcagaaaaaaaatggcgcgagtgggggttcatctggtgttaccgagggcgtgtctgcttctgtaggcgcacgccgccgtcgtcgtcgtcccgagctccggttggtgcggcgcgtccacgtcgctggccgacgagctgggcgccgccggcaatggcgccgacttggcgtggtgcgccacggcctccatgctcatgtgccactggctcgcgatggacacgatcctttgcgctctgtgcgtgatcctcgccgcgccgaagaggcacatgaagaagccgctgagctgcaccgacgagccgacctgcgagacggcgagggtataagcatcgtgtcgtgattgctacgcctgcggcggcggcggagtggctgtgtggtgttaccaggaggtcgccggagttggcgaagctcttgccgtccttggaggagagggcgacgacgagggcgccgagctggctgacggtgatggtgacgaggcaggagaggatgaatgccctgtagcggtggctggtggcgagaagctgcgtgcggatgcggcggtgctcggcgaagatctcggcggcggcggcgcgcgcctcgacgtcgaacatgtggtagatcccctcgaagcggaggatctggagctcgcacgtgaggcggaacagcacgcacaccaggaggaacacgcccgtgcggtacacccacgacgccaccgtggccaccagcgccaccgcgcgccacggcacgccgacgccggggagggggagcggcggctcgacgcgtacggtggcgaagaagaatacggcctgtgcgcggcctcgacgcagagcgacggtagaagcagcgcgtcgaggagcggtaacgcncggtccagctcccgcgcgtacccgcgccgcacgaacgcggtgtcgtcgcggagcccgccgtcgaggaacagcagctgccggagcccgccgccgcggcggaagaagcacgcgagcgcggcgaacgagatcgccgccagccccgtcgccggggcctgcgcgacgcggttgaacgtgatcgccgacgcggacacgggggacgccccggcgtcggcgcgcagcgagagcgacacggcggcggggacggcgagcgccagcgcgaggaacgccgcgtacgacgcggcccgcgcggcgcgggaggagtggtccagcgcgcaccactgcaggaacacccggaagctgcgcagctcgtcgtggatcaccgacttgctccgcgcgtacgccgggttcagcagcagcggctgcgacgacgccgccgccgacaacaacgacgacgaccacggcgacatggaagacgtctcctcctcctcggaatccattgccattggaacagttggataattcggtttgattcgtatgcatcgaaatatatagtcgtcgtgatcgagtgagcagtgtggggggtgtgcaagtgttcgacatgaggggaaaggagaggagggaggaggagatctcgtgatcgttcacaagggcggcgacgactgatgaatgcagaaaaaggcaaggggaagaaggcgactagctacgcgtgcatatgcacgaactgttcgatgatcttgatcgccatgcatgcattgtccatgatgttcttccttttctttttcgttgtcaaaggttgtcacctgttcagctcgatgcacactcttggctgagctatactgaactgaataacttgttttgttttttcttaaaaaaaaagctcgttccggtcataaatatttaactcctggaatgagattgtgatcaaaatttcaaaattcagaccatcgaaatttctttaaatgactaatttaaaagcacaaaaaagtggcaacaatagatttaccttgaaaagtactgtcataatatcataaacttatacacatatacagattggcagaattttaaacgattgataaatcttcttctaagcttcaaatatttataatcagagggggtaacttttctttttttgtgagtaaaaaaataaaatgaataagtattattaatgaactttggaaatcctagatcaaattccaaaagaataagtccacttctgagggactcaaagtagacttatacgaattccaaacaggcttagtaagcccatggtgagtttacagatgggccataacccggaagagattgccagctctgctaggtgaggtggagggcccacctagtgggcccaattgttttcgcgggggcatatacagcggaggacgcgtcgtcgtggagaagtggaaatcagtttccactttcttccaaagccgaaaaatcgagagagaaagagcaaaaccctaaccgcggcgctccgcccccttccgccgccggattcctcctcctccttcgtccgccttcgccggcgccgccctgctccgaaggagcccaggccttgtcgccgcgtcgcttgccccgccgccggtttcagcagcagccacccccaccaccatgtcttctcaggtacacgggtctctttcctcgccttgctctatttgtcgccgcggattggtcggggggctccgattgctgccgcgggaatccacccccgtcgccccgggatggtgcgtgcgggagtgggtgggcgtagaattaggttaggttggatttggacctgttgcttgtcgatcagccatgggatctcgccgcaaaagctcacgcttgcggtgtttgtttgtttacaggtcgacaaccgtagccaatctgctgaaagcgtgccgcaccacgtagggggggttttttcccgggggtttttttttttttttccccgggggcccccccccggngccgggggggggggcccccgaaaaattttttaaaaaaaacccactttttgggcgcggggggggccccttttttcccccctttttttaacctttggttttttaaaagggcctagaacaatgcttggaagggggggaaaatttcatttttggtatggatgacgactcacaggtgggcggcgtgaggacgactgggtttgccccagctgccagaacgtcaacttcgccttccgcaccacctgcaacatgcgcaattgcaaccaatccaggcccaccgactatacggtacatgtgattgccaccgatgcgcgctcatgtggttgattagttccgctcatcgtgatttttgcatttacctagtcgtgctgttgcctcctctccagaaggatatgcagaaacctatgcagacaccgccgccccatttccccatgtcagggggatacatgagcccagggacgccgccatccatgtacctcgggggtggtgctcccccttatggcacctccctctatggcggacctgctttaccacgttatggtattgctcagttccctgggggttctggatatccatatggctatggtggccgcctgccaatggggagcccctatgggccgccgatgcatatggcagggcctccatattctgctggatccatgatgggaccaggtaggggtgctacaacaatatagactctactaactgctgagtacttgatttactagatacaatgggcaaaatttttgagaccatttatgtccttttatgcaaaccttagtgtggccagaatgagattttacaggaaatatccttttgcctgacatttattttctatagctacaggatagaaatgctagtatgcgaagtatgtttctttgggaactaatttactcttctacgctctagcatgtaaacttttataggcaaattagttattaccatatattttttttgggtggttgttgcagtttatgaattaaatgcatacgagataaaaattaaaaagttaccaactctttgtgaatatgtgtcctgactcgtgtgagactattcctcacattttttctcttatccattttcctgtcctcaaaataggtggaatgtatgggatgcccatggacagatatagcttgggcttacctgctggtcctggtccaatggtaaacttttctggattattagtatttgctcatgcatattagcatgattcaattgtttttcccttgcataacaaactattgtgggatgttgtcagtggtcactctgtgctctgtgggtctaactgtcgaagggcttcctttaagtgtcctttgatattatagtgtgataaatcacgataggaaatgtttcaactctcatttatacaattctttgatgaagggcgcgagggctggttcatattccgaggaaggatcccagaagaagcctgcaggtatatattttcaaatgaattttgactgttcattgattttgttgtccattggtttatttttcttatgaactttattttaggagctgggcgtgataatgattggaaatgccctaattgcaacaacattaactttgcattccggacagtctgtaacatgagaaagtgcaatacaccaagacctgaaaaccaggtacaattctccacttcttgtacttgtgcaagttcccacctattgtattactactactaaattatgaaatatctttctttctataaatctaaaattggtcaaagtttatgtgcaaattctgataatgaataaatatttttgatttgcttactaaaaggtgtactgcaatatactaacatcgtaatcatgcttaaagttgaccttgttgccacaagattagcaatgtgacagccgtttatattcgatgctatagtaactggtctgaactgttcattaaaacctcatgccatgcaattcaacacaatttgcttgtgccatgtattaagttgcccattgtttgggcaccaggacctaaggtattaagttgcccatttcgtgtgaactgtcattgttttctcctcaaaacaagatgtactaaatttctctccatttggcaaatctggaacctatacttagcaatacatcgtccactcagccttagccattaatcaagtcacagctgacatgcagtaacaaaccggcgattttcagtactgctatattaactgtgttctgggaagtctgtagcgtgtcaaagtattctaaaatagtttgagctgttctcttcgtaatttcactttcatctatcttctgaaattgttcctcatgctttgacttctcttgtttttcctagagttaaaccatcatgcttactttgctgatagcttgtgtgtcaactcttatgcaggggtccaaacctgatggtgcaagaggtccaagtaagtttaacactaactatgcatacatgcggtgccttgtttgtaaaattttttagtgtacctttagtacctcgaaaccagtaaaattctgagatcaatgccatcttatttccacattgcataagttatgcgtgtcacttagcactagttcttgtaatggctttgtcctttttaattctatataatctttacatctaatatttcatggcagaaccaaagatgccagaaggtagttggaagtgcgagaagtgcaataacataaactatccattccgcacaaaatgtaaccgtccaagttgcgaggctgaaaagccatttcagacaaacaatgctaatgagtcatctgctgatcaggacaatcaggtgcataattagaacctccagtatgatcatcattatatgccatgcctttctttagaacaattcaatataaattgcatatcttatgttttctatcaacagtttcgtttatttgcttgtcttcatcatctcttgtgcatggcttgatatatcatgtccttactgttacagtgagtcctagaacagttatgagggtcaagaaggtccagcgtcgtcgtcaaggttcagtctgaatgtctggggtctatctgtgtcagtagtcgctgctgtatccccttgagaccttagttgagtcgtcgtcctaatggtaaacgttttggagtggcaactggagtcatggatttctttattgctacagattttggttaagaacatcccttgtgaatttgtcatatacttctgaagcttggttgctttgtcttggttactggtactctgggaaaatggcaatttatgatataaatttcaattagctatctgtgtcttagattgctacctgtgtgctatgaagtactattagactgttcattgcggtctcagttttgtcaattgtgtttgtggtctttgtttcaacgtaagggtttggtatctcagataagttggttcttgctgatgcctatatcttttttacccgttttaaaaattttcgagaggatcttggaaggtagattctcagtttctcactatatgtttgcgtggcatcctcttcacaagtttctctccacattttctttttgtactgaaaattgatttggagagcctctctggtgctattgtttgaagtagcaattgggtctaagaaacaagttagctcggtaccatggaattgatacctctgtgtcagtatatcactatttcatcaacggtatcagcctttggaataaataaaaaatgaacttgatctaggtttctgccacaaaatttttatatgtttgtaaaaagaggataacacccttctgtcctcccacaatgttggtatattggttaggagacctataaaaccattgtctgaggttaatcaggttcatttgaaccatggaccttagcttagtttccatcgttgtcaatggattgactcctacagccaatgtagaaattaattgaaaaactatgattatcccagtgctcagaagttctataagtccctattgtttgcttttacatgtgtacggcaaataggcatgcatgttactttctgccagactcgtagagctcatggaatcctgttatatgttatcatgttatctgtagcttagcattttcaagttaccccattctgatgtgcttgattcaaagagagggcccttgatgaaacaatgaatccatgtgcatcatcacattgtggagtggtagactgggtaccattgcatgcttggttcgactctgactactcgactgactggatgtcattaaaattagttgttgtcatgtaatattgtgaagcttttatcaaagctgcaactttcacatgactttcaagacaataatgagcaaacaaaggtggatcctcccggtggccctgctggagtaccgacaagttcgcacgccctgcgaatggcagctctcagtgagttgcagaacagtgttaagagctgatacccttttcattttccaaacaaggtgagaactttgatccatgtggatgtgcttctatcaggagcagctgacagtattgcatgcagtgatcttgctaaggaagttggagatgggaaacatcgtgtgatggccagccttgatgtaagaatgcaaatcagtcttactccgtaccatatctgtgtggagtgtgcacaccggaagcatagtcattttttgaatggtcgattgcttcttccacagtaaagtctataataccagtgtgcaggtgtttttttccctttctttcagtgtgaaggtgttttttaccccctttctttcgttcattcattctttttctttttccttgttgagacggtatcctggagcactttgtaatactctaatgtgcttcggaaagtagaatataagttgtgcttatgggcgggccaaaatgctttggccgttagttgcatgacagcctttccaacatgctgctgcctagccgtagttctcccaaaaatgaaaccatcttgagatccgtttgcggttgaactgaaattagacggtatctctggtttcaacatcatcctttaaaccctggatgaaagatttgcaatattcctgcggaaatctcaacgttcttgcctatttgtttgcggtttcgagtttcgagtatacgtagaaacggaagccggaacatgcaccacgctactcttcaactctatcaagttcatctgaaagtttacgcggcatgccgccatgttcttcgtgacgaggactcagcggccaacgcaaatcagtattcaggtgcttaggtaaagcttttttatctttgggtgcttcttgcaccgatcgatgagatgtgctaagaaccacatatatttgatggcattttgcggtactatgtttagtatgaacatccatctttcaccaaccgattgatttataaggagtaatagtttgcaaccaacaacatcagtagtagggaggccaaaggtgttgtcatgcaggaaagggaggcggtggagcggcgctcaacaatacacatggtgcagcaatgcgtcatgttgcactcgtgcaatggacacgcactaaaaatgtttcttatggctagtcaaaattctccaggaaaatacatttcaaccataatagaaaggtcctaaatgccacaaccaaaacaaggagtcaatgcatgtagattcaaaagaaaaggacgataaatttcatggccaaagtaggaatacttgttataacattaacaatatatttcaattagctacgatgacagtggattaaattataaaaaataaatctacaatttcgttagaaccctcttattactgacacacgaggcccacgagtcatacataacctacttgcaatgtgacacttctcatcatttcgcttccatctagtagagtttgtatggcatataagccaggtgtttaagtgacaagagggtctggagagttacagttttatgataattttattttgtattatcgtagctatctaaaatatgtcatttatattgcagcaagttgatagtttaatcattaaatatgtagtaatctgaaattttcccaataaataaataaataaaggggccctgtacctaacattgcacatgtggagatataacataggcaaacccataaaattgcataatagatggatgctcattaaataccctaagaaaaaagaataggtaataactaataatatcctcaagatgatatacatgtccagaagatacattgatagagtatgaagtaaccaatcttcaagatatttagtattgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacactccccctcaatctcaactctccaagattgagattgttacagaacaattgtaattgtctcacaggaagaggctttgtaaatccatcagcaatttgatcttgtgacggaacaaaccgaatttccaacattttctgcgccacctgttctctgacaaaatggtaatccacttctatgtgttttgttctagcatgaaacacaggatttgctgacaaataggtagctccaatattatcacaccataattgagaaggtcctggatgcaacaaaccaatctcttctagcaatttacgaacccacattacctcagcagttgcattagccaaggctttatattcggcttcagtactagagcgtgatacagaagcttgcttcctggcactccaggatatcaaatttgatcccagaaatactgcaaaacctccagtagatctcctgtcatctagacatcctgcccagtctgcatcagagaaagcactaacaatataagaaaaggatttgtcaatctttaatcctagaccaagagtaccttgcagatatctaagtattctctttactgctgcccaatgtacaatagtaggattctgtaagaactgacacactttattaactgagaaagatatgtctggtcttgtaagagttaagtactgtagagccccaacgatactcctgtactgactggcatcatttgcacccaaaaattcaccatcatttaaccacagtttttcagacacacagagaggagtactcacaggcttacaattactcattccagttctcttaataatatcacctgcatacctttcctgtgtcaacagcagacctttctcagttttctttacttcaattcccagaaagtagtgcagatccccaagatctttcagagcaaaatctttctcaagttccttgagtaaaactgtaactgcttgaccagaagagctagcaactataatatcatcaacatatacaagcagaaacataacaagtcccttcttattatagaagaacaaagatgtatcagccttagatgaaacaaaaccaagttcttgtagccttttactcaacctggagtaccaagctctaggtgcctgttttaagccatacagagccttatccaacttacagagatagtgtggcatctttttctcctcgtatcttggtggctgcctcatgtacacatcttcttcaagatagccatgcaagaaggcattctgtacatcaagctgtcgaagactccatccctgtgacacagccagtgacagaacaagtctaatagtagcagccttaactacaggactgaaggtatcctcataagcaataccataacgttgtttaaaaccctttgctactaacctagctttatatctatctatagttccatctgcctttcttttaatcttatagacccacttacaatctattacattcaccccctgctttggtggaactaggtgccaggttttatttctcactaaagcagcaaactcgctatccatagctgacttccaattagtattacttaaagcctcttggagattacctggttctcctgtatgtgtgagtcctgcataccttactgtgccatctgtgtacttctttggtttgtggataccacgctgtgctctggtcactggtcgagtcggctgagcggcaaactgagcactatcatcatcatgcgatgtggaagaagcaggagctgatgcagacgtgtcttgatcctcctgcgacgtgtcttgatcctcctgcgatggcccacgtgaacccggtcccacaatgtctcccgacagagacgaggctgccgcgtgtgacgacgcgattggcgcggttgccgcgtgtggcgcggccgagggactcgctgcgtgtcgcggcgtgaccggttctgcagatcgagatgacgccgagttctcctggtccgcctggttctccgtgccatgcatggtactgtgcgtcagagagtcatgatggccgccggtaggttgcccgccggaactctgcatgaaatcatgcccgtgctgcgcccctgattttgctccattgcctgcactgctgcctgcactattctcaataattggattagcaggattagaatcatcaatcagcggttgatcatgcatctgtacacccccgtgatcaagcagcggaagaagatgcgccgggaggagattgatctcagcccggaggcgagcaccggcgttgggatgaagtttttcaaagggatagatttgctcgtcaaagacaacatcacgggaaatatacacacgccctgtagagatgtctaggcacttaaaacctttgtgaagcgtgctataacccagaaaagcacactgtttagaacggaaagctaatttgcgggcgttgtagggacgcagattcggccagcaggcacagccgaaggtgcgaagcagagaataatctgggggcaggttaaacagacgttgtagaggggtctcaaagtttatcactttggttggggtcctgtttatgaggtaagcagcggtggtgaaggcctcatcccagaatttgagaggcatggaggcatgagctaacaacgagagcccgacctcaacgatgtgacggtgtttgcgctcggcagaaccgttctgctgatgcgcatagggacaggcaacgtagtgttcaatcccaatgcgctgaaagaaggaattaagacgttggtattccccgccccaatccgtctgcacagctttgatttttctattcgtcaagcgttcaacaaggttttgaaaatcctgaaacttggcaaaaacctcagatttgtgtttaaggagatagatccaagtgaatttgctaaagtcatcgatgaaactaacataataaactttattgccaacagagtttatagcaggaccccatacatcggaaaacacaagttgcaaaggttcaatagaaacactactggacttagggtagggtagctgatggctcttgcctttctggcaagcatcacacacaaactcttgactagaatccctaacaactgggagattattttggctaatgacgcgattgacaacagaaaaagaagggtgccctaatctactgtgccaccggaaaagagagggcttgacaacaccaaaagcctgcttgttggagatggtttggagcttgtctgttggcagaggatagaggccggatctacacctgcctcgaaggagtggcatcctcgttacctgatccttaaccaaaaagaagaaaggatgaagttcaacaaatgttttattgtcacgagtaaagcgatgggcagaaacaaggcttttgcatgcatcaggaacatggaggacgtttttcaacgttagatcacgagtaggggtacgaattgcagtatgaccaacatgatcgatattcatacctgcgccactagcattgtggacttgatcattgccggtgtatttgtccttcaccatgagcttctccatctctccagtgatgtggtcggtggcgccgctgtcgatgtaccagttcgtgtcgatgccgtaggagttcactgcagcagtgttggcgttcttctcttcaccggtgaaagagggatcaaacctcttccagcacttggcgacgatgtggccgatcttgccgcagagttggcacgtcggcttgggcttgccgtcattacgaccgcgcccgaagctgccgccacgtccagggttgccgccgccgcgccctctgccatcacgaccgcctccgcctcgtcctcctcgcgacgcggtgttggcagaaggattggccgcgttctggagaagttccagccgcgactcaaagccaaccaggagcgcatagacatcgctcacagagattggaccggtgcgtcccgtgactgacgagaccaccgagttgtagtcgaaatccagcccggcaagaatgtaggagatgagctcctcatcatcaactggttttcctgcagaagccatgtcatccgcaagagatttcatcttaccgacatactccgccatgctccggtttcctttcacggtggtggagagcgccatgcgagtgttgaggatgcgggcgcgagattgagatgcgaagaggctctcaattgcctccatctgccgccgttgtgagtgttgccacctgagtgagcacctcacgcgacagagacgacagcaggtagctgagaacctgctgttcctgcgccttccattgcaccagcgccggatttgccaccttctcggtggtcttgccatcgtccttggtgatgatgatcgttgcagccggtgcctgattgctcccgtcgaggaagccggccatctgtgcgccgcgcagcgcggcaagaacttgcgccttccacagcacgaagttgctcttggtgagcttctcagaaactgtctgcccattgagagcagatgggttggaggaagaagacgccatttgcgtcgggagttgggagattagattgaaagattgattggtggagggtggaaggctctgataccatgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacaagtatgatgataaaccaacgataataatggaaatcgatatacatactctggtacaagagtcaaactgcgccgatcgatgggagtgacgcggtagtaggcgtcaatacggagcgttggggttatacgtacgtgtatactacatatctgcaagcacataattaatcctcatatcttcaaacgcgagcaaagacagtactactcccttcatccgattcgatattcttaattttttggagaacgacataatttttgaagtatatctttaactatattgtctattatgacatatacaataaataaatacaaataagtatttactctaatagtaaagactaagagggactatatatatgttattctagtgctttcagtcgaaattttaaaagtttgaatacaaccttattcaaaacattaagagcaatggaaccggagagagtaatataattagagattatagtgtgtcgtatttgtgggttttacttaattaattaagccggcctgatcagtgtctacctacacactggcatggactcttgcaaagtcagatggatgctaatttgtacttttgtgcaggtatagagcggtcgcggcccagcctcgatcgctcacgtccgcaccgtcgccgcgcgcgcgtgtgacacacgcacgcacgtacgtacgctccgtgcatccgtccctcgccgccctcggtgctatactcccctcgcgttaagggggtgtatatccagggtttaaaattttaacgtgtcacatcagatattatatagaatatcgtatagggtgggcactaataaaaaactaattatagaattggttagtaaaccgtgaaacgaatttattaagcctaattaatctgtcattagcaaatgtttactgtagcaccacattgttaaatcatggagcaattaggcttaaaagattcgtctggccgcaagctgtataattagttatttttttaacctatatttaatacttcggatgtgtttagatctaaagtttggatccaaacttcagtccttttccatcatatcaacctgtcatatacacataacttttcagtcacatcatctccaatttcaaccaaaatccaaactttgcgctgaactaaacacagccttcatgcaagtgttcaaacgttcgagtgacagggtaaaaaattttgaagtgggatctagacaagaccttatttatacaacataaaaacactatatctatacttctttaaaataaaaacatcgatggtacaatctgacaagataggaccaccatccttcatccttcatccagtttcagacccagagatcaattgccacatctagcaacaatatgaatacccaatggataaagcgcgaggagagagttgcagacccagagcagattgcagccggactgacatggatagagattagtagatggtgtggcactttcgtttggtggtaaagtaagccatactgttagttactcctctaaattttttgcagtgtagcaagctaaaagatggagtgaacccataaataaattcaacctatagttatatggctagaaacataaatgtagctactttctctgtgcacgagacactagagatagaactacgtatgcacggaccggctcatcactagaggagtaggtgtcaaccggtttcaagataaatatccctatataataataaacaaataaataaaatgaaagaaaattaaaaaaaaacacttgcaattttgcaaacagatgcgccaggttgcatggacacgtggcatttctcccacgttactcctgcatgcgtgcatgccgccacgtgtccacccctccccgcctttaaaacccgcctccgatcccctctcccccaacaccatctcctcctcgtcatcgtcatcgtcttcctcctcgcgtcgccgatcacctcgccatggtgccgccggcggcgcacgcgccgaagaacctggggctgaggggggtgcgccgccggctg

SEQ ID NO: 79692 - DNA, 41060 bp, Oryza sativa
caattttggccgacggcggcagacggcgcgatcgacccaccgtctgccacgtcagcttgtcgcccaccattggggcggcagggtctattttagcaatttttttttgttgatagattatttctgtaaatattaaaaaaaatctaaaaacgaaaaaaactcccaaaaccaattcctgtgatttccgtatggcccacgatctagatgggcccagaattagtactgggccgggcttaccattccaggcccaaatcaagcccaataaatttcccctttgcagcttccctcttctctccattttcgaattctctccgcgaaaactcaattcccccacccatcgatcgagctcgccgtctccgatggcggcggaggcggaggcggagccgcggcggtgggcggcgacgtacacgaagcacgtgaagcagaagcgcaaggcgtaccaggacggcgccatcgtcctccaccgcgcctccgtcaacctcgtcctcctcgacgacgcgggcggcaccgtcgagtgcaggacgctccgcaccggcgaggaggtgttccccggcgcctcgctcgcgttccagcgccacctcgtcgacgtcggcgagcccgagccccaccccgggtcggggtcctcctccgccgccgcatcccccgcttcccgaggcgtccaccgcggcggcgcaagcgccagggcgcgtcccagcgcggtgaactcgcggcctccccgtgcgttcgcggaccctaacacgaaggggggtggcggtggcggtggcaaggatgaagccgtgggttcgagtttccaaggtttgcgagccgcctgctctgcgtatgctcacaaggtgtttgatcgctgaacagaatgggcgtaatctgatgaatgaatcgggtgtgcttttgattgcagagtggaccgcactgtacaccacccagctgactcagaaggcgaagaagttccatgatggtgtcgtcaggctcgcgcaggtcagttcgcacgcgaagcaggtaagcagaatgcgcatttcgtagttggtaatttggtatacggcatattctgattgttgggtagctaatggatgatagattggtggtaggttacttgatcctcatgagaccagtttatcttagaatgctgtggtagtggactggggaaaaatgatgtgatatgttgttttggattactcgtccagataattttgctggatgaagagggcggagtgctagccaccaggtacctcaagtcaggggaatctttggaaactgggaagaaatgtcatttccctaactatcttattgagatttgtgaggcgaagagtgtaaacaaaggttggttttgtgcattttccaatatattgacgatttctgtatctaatctttggacctgtgcgttgtgagacgtcaacatttttgctgtgcctaattggagttccttttttcctttgcccacatattgaaaggttgttatttctgcattgccaatacgcaggtttacaaactaattcctcggaggaacctatggtgcaaacaagaccaaggagtggggagaatacaagtaacaaaacaggatcaggtccaacgagtaaaccactcaaatttaccagtccacagaaatttcatggtacatgggtataatgtttttttttaagattgatttaatgaattaatgttaaacatcagttagctatgattgtccttgtccaacatatcacagtgcgaaatgtttgtctctacaagtatagatcttgaggacagtaaatcatcaaatactgctggttcaagtaagccagaaacttcaaagattggagttgtggatgctggtagctcaggaagcattatgggttcaacagactctgaatttaaaggttcatgtgttctctctgtatatgtcagatatttgcgatatgtacaaattgtaaattattgatatatttcaaagctaatagtgaatgtacattctttgtagaatggagtgccttatataccacccaactaacacagaaggcaaagaagtaccatgatggtgtgataaagcttgtgcaagttggttcgcatgcaaagcaggttagcaattagcattcaatccgttagtttcatgcttattaatatcaacactgagaagtttctagtgcaaggtttggcaatatatgattgctgttttcgatgtcactgctagatgctatgtaatgaaatgctgtgatattttgctagttgtagaatggtgttatagttttttaataattggatgttcagattgttctgctggatgaagatggtggagtgcttggcagcagatatctcaagtcaggtgaatctgttgaaagcgggatgaaataccagttgcctaattatcttatcgaagtttgtgagataagaaaacaaaagaatggttagttttcatttgtgtccactctgtagcttacgatactctgaaaatattcaaatgtagtttttaaacatatattccttttttttctatatcacatcttattttactgcattaattggtgtgcagatgtagagtctaaacacccttcagaggtggttttgagtcaaactggatcagcgaatggacataatacaactgacaggacagatgggagaaacaaatctccaaaatttgtcagtccactgaagttcaatcgtatgtgatcacagagttccacacattagtactttgctgcttatgacatactttaatgtaataattcatttgtctctacaaattttcagattttcaaaagagtagattacaaggtagtaatggtttcaacaggccaacggttgccaaatcaatacatactaacatgattgatacactaaaatttcatggtaattgaacatgatatcataaacacttagttctatgtcctactactccctatgtatctttaggtagtaaggctgctgtttgcctgtttgcagatactcagaaggctaaaccagattttactgttggctacaagacagaccttggcaaatcaacatttagtaacttggatgatccacatcaatttaatggtaattgggtttaactttatgcacaatatctgtcttccagtagttatatttttatatagttaaagtgctggttctttccccagtttttgcagataataagcaagataaaacagaatatgctgcaagctataatccacaagaagttggcaaatcaagttatgatagagtggacagtcctctaggattctgtggtaaacagacttgatgtagcatacttgcacctattttttaccctcctgctgttgacatactctaatccagaaatgcccatgttttatttattttctgcagatcttcaggatggtaaatcaggatcttccactagttttttgaggagagaggctggcagaacaacttttggtaacacggatgattctttgagaactggtatgtatactttacctactttctagtttgaataggtttgaccacgcaacagaaaaattatgttgcatgtttccttcatgtatgtcaactacacgaacagtagataagtaatctatgcacccacctggctactattatccctatacccaagcaccgaaagtaagacaatccaatcagccattgttttaacaaatttgtaatgcttttatttattgtattaaatagataattggtttgatatatgtgcacttcagaaaataaaatacaagacaagtctgctcaagtgaaacttttactggcacattctatcagtgttctctcttctgttgtgcaatgctaaggttgttgtgaccaatattggctttgttcattaagactagtttcagttaaggttgattatttcagaaactccatgatatggatttcaaaatagctttctggtaggtgccttttagcagcgtactttcaggacattctttatggtcagattagatatgtctctgttgcatgcatcttgcagtaattatttcatagttgtattactgataaggaaaatggtcgtcccttattcctgcgaatgtgtagcttaattattcaggtttatttactggtaagtagctatttaaatatgtgattttacatattacaagggatatttgaggtattctttatgacttcatcaaatttaaataaaagctgaaacagttctgtatgcttctatagtggtcgttctgctttaccctttcttgtttatcatcaaatatttctctttggcaatctgaagagcataaaataaaaataaaatgcaaagagttcctgcattgtgctcatacaataacaattcacgcagtagagtactttcaagaaattcattcatttttacaagtgtatgttagtgatcctttgtggattgcatggctaacttgaatgacttacgctacttacttattgatcatgtgcttcatattaataacactgctatgcttttttagcatcccaaatactgtctatcatgaggcccccatcggaaattaaatactcccaaagtgttccagcttcacaagtacactcctcagcatcctttggatcaaatatagctcgtgatgcggatcatagcaagacagcttctaacatttcagtgatcaacagttcaaacagaactattggtgttaatatgaactctcgaatgtctcattgtgctacacaacttcgtgcatcagtgctggcttgtttaaatttagaaactctgcagccaaggaactcaatatgcactactcttcagagtgagttatcagggagtgcccatccaacttatgatcatcagacagtcatgtaagattttgtgtgcatatcttcagttatatcctagaagattgccttctggacaataaagtagtaatatctaacatgacaagtcgaataagaaaatgggtttactcgaattatgctttataggagaccaacaacttttgatagtctggaattggacatggtggataccccaacatctgatgtatccaatgcaaaagagcagagtcaaggttcaacaaggaaccatcaaactgaaagttctaaaggtactggaagctgtttcaattaatttcctttttgtggagttagagcaaaattgtgctttacttttagggttttttgccatccaagagtaaacgtacatatattggtctatacatggcagattctgcaccagctatgtgtactactagctcagaccctccatcgggtaaaggtgaaactgcagaccaggtttgcatcctatataacctttcttggaaaaagactgccgtttgtgaatttaaggtagtttcagattcatgagagcaatcaaattacttggtttttataactgtccacagctgcatattgttttgcatcataagatcatgctgtgagtactagcacctactgtttgattatactatgctaatcaatgactagttgactacatatgcatttgcagctcagttcagattacagagtggtggaagaaaaatgtggcagttacccctttttatctgcaggcgacctgacgttaacagatgatgattgcccttcgtttgatcttggcttctagcggaaggtacaactctattttatatcccatggtagcattggataacaataacttaacctaggttgttaaccacataacatcatctatcgctttgaagaatgtatttatttatgcaatataaattcacagcatcacatcggaaatacctgctgcctttttccccaacttataaagctataactataagtctataagctgggtcattgctgcttatggtggggaaagaggggcatgtcctagtcgtggaccaaccactgccggagttatatgtggtttagtcaaaccattggccagtttgcctgaatctaaacattggccagtttgcctgaacctcgaataggaagcaaccgcgcacacagctcaagacaacgattattttgtcaagttcactaaagatcaacgtgcagaagtttcaaaaagaaaaatgaaagcaattatatgcagagaaatcattgattcctgtgggtcactgggttttcctttgcttgcaaacattaacattacttaagattgcatcttaataagtttgctttgctttgctttgcatccagggtttcgttgagggattccttggccttcttaaactcaatctgttcactgcttaaggagaatggatggcgtgaaggcgcactctgcgttgtaagttgcaacaaaacaatgggcaggtaaaaaaagactaattcttgattagtggacaggatctggttcagcttaaggtagcagttttgggagtaaagtagtagttaagacgagttaggcagataaagattacaccgtacagtttatctttcctttaccttttctttttctttttctccttttttttttaaaaaaaagatatcgtttgcctttgtttggcacggtaacgtgtaaaaggtggttgctgtagtagtgtagtgtaaagagaacatcgagaattagattcttgtgtgggataaactacaaacaaagcatgttccatgctcttttttatgatttattgaagcctgaaggaccaggatgtacgctgaaaatcttcacttcaccaacaactggaactgggagtagaattgtaagttcgtgcatcatggcagcatccggattgctgaaaaagttgggcacttcaccgacgtagctgtctaacccatgtggccatattggattggacagctgaaagagatgtggggtcgttccgttgatagaaataatcgagaaagttcgaatgaatttactatgtgctctataaaagaatttacaagagatgaagagaaaaatggtctaggttagttcttgtgaaaatctacataggagtgtgatactaatttgatcctcaagttttctacaggttcacatctatctttggcgtttcgttttgtccaattggtcaattgggctcgctctcaagtttgcattcaattcaaaatgtagcacttggcaacatccaaaggtgctacttggccagccagccagccaacttcccaaatgcttaatcatggtatagaaaaggtctgttatgcgctcacctctcatgcataagcccaaaccacacacaataaagaaaaaaagaggaacgccacgtaaacgtaaacatgaggcatcgtagatttttatgacttttaataccgtgaagaaattattactatatatttttaatttttatgagttactccctctatgtctcaaccactttttttctctgtctcatgatataatgcgtgcatgcatgtatacattaactagcacctcgtactctaaatttgctcctcgtactccaaatttgctctgttttaaatcctctaacatcaacccccctcacattacttgcatgcatcaatgtgatctaaccgaggaagtgattaaattatttttttggtctttgtgttagtgatagttgtgcttcatattttggaatatagtactttcctagtagtgtagttgcctcttatatcattgagagttattctattttttatagttatttccctataacaatatcgttccttttaatatcgtgaaaagttacttcttatatcaagaaaaataatatagtgattacttcaaataagaaaatccatgtatataattatgaatattctctacattttacttatgaatttacttcatatagtttcttatttccaacttatccctatgtaattactttagcattattttatgaaaagttacttctcaactgagttacttttataatgtgagcaaattactattaaatatttaaaaataattaatattaaagtcgttttatcataccttttaagtagagtaagatggtttaaatggaatttataaataatacatggtttgaaatatataaaccatcaaaggtttgtattaagaaaaaatagattagtgatgttggttctatgtatcaaacctttaatttaactagtacaacccaattagccagtgacatatctggtcaacccactaacagattatactaacatttttggattggaaggagggcactagggttgtgccgtaagtttaaatagtgcacgcgaactaattaaatttcactataaatttgcaatatctcataaaattacttaatgtaaaattagtgtcccgattttaaaattatgacttatcactaacagacttatgatgtattggcaatgcatattacaatttgttttgggcttatttgatatccacctcttttaatgctggaacccaattaaactgttgtaactcaacttaaaaaaaaatggaatgggttaaaatgatttaaaatataactaaagagatggatcgagattcaagccgcttcataactttattctaaagttcactctcaaagttaaattgagaaatttgaataaccttatatagactcaaaccgtactcccccgcaaaaaaaaaaaaaaaaaaaactcaaaccgtactcttttggttcttactgtactctttaaaaaaaagttgactagtcactcagcacttcatcacagcatacagtactccctttctttttcctatgaaccatttgcttttcttcttagttcttacttccattgctttaggcggcagagagagaggggttcgagaaataaattccagtggctccctgctttgccacaacactcatcagtgggggttgaggtggctgcatcagcaaggaaacacctgtccccacctcaccagcgggagagaagcccacgtcactcccataaatggatgtggatatctcagattctcatcacccaaattgatccaggaagccacgggacggcacggatctttgccccctttcctggacaacctctccccctaaaaaaccaacaaaaaaaatgaaaaatgagtgagaaaatgagatgacacggcgaggagaagaacaaaaataaaaaatctgggagttgggagaggaagaaccggaccaaaaatccaatctttgtgggagaaaaaatggcgctttcaggggcggtgagcagcgcagaaacggcagcttaattggtctttcttgccaatttataaaaagttttgattttgggagtaattgaaatctttattactactattattattgctggatggattgtttcttctggtaggattgctgcttgctttgccttcacgtcattatccggagaggagcaaagatcccttctttattagctcctctcccttggcttcctctcttctccgtgttcttcttgtccgctttaggggttcgcttttctagattcagtctgtcagcggcgacggcgagggagctgcgagatccggccgtgagatggtggtgatccgaaggagtcatcgtcatcgtcgtcgggttggagcctcttcgtccaagaacctgccttgatcttgcagccttgttcaagcttccgagtcttttgctgatccaggtgaggtggcttttgccttcacctgtaaaattttagagaatcggatcatcgggaggagggagcgaggagaatcggagattcggaatctttcgattttgtctgacttgctcgagcatctcgggttcagttttcattttgcgtgcccatttggtccagtcaagtactttgaaatgttcctagttcgaagaattcgacctgtttctgtatttctgcatctgtgattcgtcccttacctcaaatcagtgaaatctgtcggagaattggataatcgtttaccgcctcaaatctggctgtaattagtagtgattgttttctttgccatgggcatttcatttcatttcatttatttcgacgttgcttgcatatctgagcatcatgtcttctcgttattgtgcttgtccgtattcattttatggttgtagattctttttgagcaaacagttcatgaatcttgatggatcggtcttcaaattttctagcgtggatgatgcatgcactttctgtcatgaaaacattgtaaaataggctgttaatactatcatttgttttctttagagcttctatggaagtagtgctgatgaacaactttttctgaggacattgacaaacaatttttctgatgtgcagggtgcagtttcttagcatgtgagtaatggcagctgctgaaacaagggctgcttggcagcgtgctgctaaccgctgccgggttcaagaggacgcaaagagagctccgaaactcggttgctgcccgccatctgggcaacagcatgagaccaacaatggaaatcaaacaaatccgcaagactgccatatccccaactttatgcctttaaactggaatgcaatgaactccaatctgccaaaagatacccaatggtggcttcagttgcagcccaattttgggtgccagaatgtgcttgctagcgaggacctgaattatatgtgtggggaagttgatgtaaagaaagtcgaaagtttcgcaccagtgtccaaacttgaggacatcaatcctaagaaaacagctgatccttttgagcccccatggatagtttcaacagcttttatgaaacaaacatatgagacaggttttgaagagctcaagagtcttcctgcctattctgaaatgaccctcaaatgcaggggaagtgccacctatcttcatgaggacaaagaacatatggacttcaaaacttttgatcctttgtatccaaagaaaccacagacggcatgctatgagatggatgcaccttggcaagaaaacaggaagtctcggccatggtggcaggtagctgaagcggatggtttggcttccgtagttgcagaaagtgaaatgcacaacgtaggcaaaaatgagctgccaagacccacccaacgtgctcatggttcaaaattgaacaaccatgaaaacaaggatgattatggaccttatactggcaaagaatcacctccagtgcagtatgacactatgctgtgcagctatagcatttcaagcaccaatgagacaaattcatctgatggtggaggctggcaacatcaaagaaatgatgcacgtgggtatgttatattctttcacaatcgctggaattcactatgatttgccggtgtcttccttcttggattcacgccgtcttaaattcttaatgatactagttattttaagaaagtggtatgtggctttttgtttggtcccaaacctagggaaatccggtctaactggccaatttagagggccaaacaggtgattacgtgataacaagtaggtgtgcttgttccttgtgaacagcccagtagacccacttttagaataccgatgttttgctttacaaggataaatcttatggcttattattttcacgtatcacattacgaactagttctgaaaatgaacaaacacaaatgttattccaattttgtatgtgtgaaactagttctgaaaatgagcaaacacaaattttattccgattttgtatgtatgaaattgtgtgaatcttttgattccttgttatgatccaaaattgaagtaatggtagtcatgcatgccttccatgtcgtgttatttctcatccctggaaagtcccagataccaatttgtttgtccaagcttcttcctggttatggtccatatattgacataatcgcattcggatgcaggggtacacaggattcttgtagttctgatgatcgcacaccaggcagcaagccgacatatcggagtgccgctgagaggacccagttgctggatgcactccgccattcacaaacacgcgcgagggaggctgagatggctgccaagaaagcttatgatgagaaagaccatgtcatcaagctattattccgtcaggcctctcatctctttgcgtgcaagcaatggctgaaaatgctgcagctggagaacatatgcctccagctcaggttgaaggaacaccagatagcagccatgttccctgaactcccctggatcatgctcaaagaaaaggtgacgccagggcaagaaaggaaggatggaacaaggaagaaaggaaggaagcagaacaaggacagccacttgcgcaaggctgtcgtgtttgcggtcggtgtaggcatcgttggtgctggactgcttctcggctggactctcgggtggctcttgcccaggttgtaagttccattatcatctaccaccatggctagattaacgcctagcgcgcacttcgatcgaataggtgatagataaagcttcaggtatgtgcttcatgatgttagaagaatgaagatcatattcttggagctcattcatatctgttctgttgttggtttggaagccttgctgatgatattttcatatcttcatgtacatataggatgaatttgctgtatatattttcagaaactgggtgcttctgtatgttgcatgcgtttgcccgaatgttgtacatatatggggtcagtggtggtggaactagggaaaaaaatccgtcgacatcaacaatgtattaagtataaaacttgtattttcagttgctggagtagccagctcttgtttgtataataaaaacttgtatttttagttgctggtttagacagctcttgtttgtattataaaggcctaggcacgcttgtgacactatgaatttccatttgccaaattggtcttttttcttgtcaaatcttggtcagctttccaagtgctgtaatcagcaagaatgtgatctgttatcctttgggatagaagtcaatatgcccagctgtcagctcgtgcatttgctactgaattttgcagtccagatatctcagacataagataaactcattcttggtaactcctaaaagaatttgttattacaggcttacagcttcgaaggtgctatcaattatgcatcaaaacttctaaaggttactgtgatttttggcatagcttccgatctaagatgttttagagctagcataactttggatctaaggttttttttttttttggagttggatatttccacctccacaaatccatagatttttcaatcggcaattacattgattacttctgaatgaaatatttattccatttttggatgaaatataatttttaagtgattataatttactccctccgtctcctaatataagggatttagacattttgcttgcattgtttgaccattcgttttattaaaaaaaaaattggaattattatttattttatttgacttacattattatccaaagtactttaagcacaacttttcgttttttatatttgcacaaattttttgaataagacgagtggtcaaacgttaaaaaaaaaatagtgaatatcccttatattaggggacggaggtagtaacatataaattttaaatctagatatggagctgtgataaatattgcctaataaagagaaacaagtgccacgtgatgccaaaggaaagctgatgtactccttttgtcccataaaaagacaaacctgagtttggataggctatctaagaataatctgaagaatattaaaatgtgtcacatctcatcttaaaatcctatcctgagtttgtattttatgggatggagggagaaagtcagcaaagagagcagtgttgcagcaaccagcaggtaatccgtacaagggaattcattagggaaattgtaacagcaataaacttaagggatctagagtcatctctatcggagcagcaacggcacaactgtgaattacataagttagcacagagatgaactagtgttacagctgaacagctcccaagtgtatgattactagtagtagtacttaattagatcttggcagtgtttttccagttctttacactattaagagtgcttagctaattgttccaatagatcttacttatccaggctccggcagccaaaagtgcacaaatgactcccaaattgtgatattacatccacaaggcctccatatccagcaacagctgccatctgcacaacaaaggtagtaaactcaggacaaatcggccagactccagaagtagggtgaaacagatacccaagtcatttcaaaatgagaatcaagagacagacagacatacccctgaagaatgtatggagacagaaaatgctgagtgaggagcacacttgatttgtgaaagaagagtcccattgatagagaaacgagagagcagaggttcagcaccgactgctaagatctgaatggtgaaaatggagtataagaaaacaaacagttgataattcctaaaccacaagagttgggaaacaatgcatccttcgtgctgctctattgtctatcgccagactcaacattgctttggtaaatctctaatagatgtgagcagacaataataaaaagctttccttgcaggaataataactagttggctgaagagtcactcttatatttgtttggaagcaaaagcttttgattttattctgtttctctccaacaataacatcacaaagcttcaaattttggcaaccatgtcataaatcatcaggaaataatttattgcattttctgtgcatatctgagagattatctgataataatttcatatccacacaattatgcaaactttcatttggcaaacaattatgcataaaaaaatttagaaagggcattggttaaatagataaatcatgcacttgtggaactatcatatgacttgttaatggaaataattgactaggggaacactaatttactacaggtatagcatttgttaaactcacaaagactaaagaatggaatgatccgtcctaaattttttgccagcccatctttgaaatacaagatgagccatttctaaccatgggcaattttactggtttgctaaactctagcttgaacatgacgaatagatagacttacttggtttctgtcaaacagcaaatcttgaacaggagcatggcaatccacattaaagatgcactcatttgaaagaaggctccaaactgatataccactagaagtaccacaagcctgggaaaaataggaccaagataataataactgtaaaatacatgatgcataacacattgttatatcagcttgaagtgcatcctaccagccagctttcacttgcatcaatggcaacacaactgacccatgacccctcaaaaatcttgtttttcaccggacgtataacctgagtgcactttccacttctgcaatctgcagtgcacaaagagcagaaataagagaatgcctttttatggatttccatgtagtgccaaatctttctaaacctgtctgaaggtaaactcataagagagaggataaattttgtgaatatgatgtgacctgtgaccagatcaccagatgtgaattaaagagtacaaaaagacaaatagctagttggtgctttttctttgcttgaatcaacgagcagatatacaaaatgaccagttagaacaggatgaacatgagaaggcacacttcaagtacaagacaaaattatcctatcaaaagcactgctcaccccagatacgggctgtgccatcctctgatcctgtaactacctgaaaaaggaaaggctctattaactaaaagttactacaaaatgaaggcaagacatctatgggaaaatggtattggactacatcagtacaataataacaaaccaacctggcggttcgcttcgcggactgcaatgctgtgcaaatagtcagtatgtcccttgaaggtcattttacatttaccactctcctgaaagaacaagacattgtaaaacctactatcagatattttctcaagcaggcacacagaaaatagaaaattatggaagcctgtgccacatgaatcataagaaatctgtagttccttccatgtagctcaggacttctatatattgcatttacctcaagaaaatacataccacatcccagcaataagcacatgcatccccggccgctgcataaacagatccttcctgttgcgaagaagaatgatgagaaagaataactgaataagatatctttttttaagcaagtaacaatatgcatcatttctatataatatacacgatgaacaaaaatgcacacaagagattattttgcttctttggatgaagtgaaaatgcagactttctggtgttgacctgtttgttaatcgcaatggcgttgttttcaggtattggagagcgagcaccccaaggacccctacaaaatcgaaaacaaaagctctgaaaagatggaggatgagagtgcaagtgcatatttctctagaataaacgatatgtcaaatgattatcagatgtatgtcctttttcacagaatacttactcatgctgagggttcaccaaatcaagtactggctccaaatgatcccctggaaagaaaagcaatgacaaagtaacctattaaacaacatgcattagccccacaaaaaaaacatgcactagagcactagaaaaggaaatgggacttgcaaaatgttttacatctttgttaaaaatttagccttttctttgtggggtgtgcgcaagcaagtacaggtagaacttctaggtaaagcacacaccaaactaattaaccaagtcaatcctagtaagaagtgagggttcttttgcagcaccttgcagagatagcggcacaaggcagctctgcatctcgtgccatctccatccccgaaggcgcccgtcatccccgccgctgccacaaccaacggatcacgtcgccaaatgtcatgccatgtcacctgaacaaaaacggccaccgagaagacgagcagcagcacagcaattcacctgaagagcagcggctgctgcgaatccgggtagaacctgacgtcgtaggccgggccactgtgcgcttggacgatgcagacgggatcaaccagagagaccgcggcatccgggtgggtctgaatccaatcaaatcaaaacaaaagatcgaacaccttagctgcgcacgaggacgcggcacatggagcgggtgtggggaacgaacgaacctgtggggtgggatgggaggaggaggaggagatgcaggaggagagggagaaggaggcgagggagccgtcgctggaggcggcggcgaggaggacgtcggggtcgtcgtcgtggtggtcgaagaagacggcgcggaagagggtgcggcaggagaggtcccgctcccgcaggatgccccgcctgtacgccgcctcgtcccacccccgcgcgtccatccccgccaacgccgccgccgccatctcgcctcgccgccgccgccgccgctgcttcggaagcgagagcgagtcgaggagtggggggaagagacagcggctggttgggctgggcctttagatcagaaaccaacggccagatctattcattattaaaaaatataatatgaaatccctatttgatttgtttttgtacagtattgtaataattatttgagggtacagacaaataaaataactgttataaagttttaaaaaataggttaaaacaatattctaataaatttatatttattttttttgtgatgagaagccaacgacgagatcttattcattgataaaataatatgaaatatctatttgagttgttgcttcgcgtaatgttgcgataattattcgagggaacaaacaaattaaataaatgttactccctccgtattttaatgtatgacgccgttgactttttaaccaacgtttgaccattcatcttattcaaattttttatacgaatataaaaatacttatatcatgcttaaagaacatttgatgataaatcaagtcacaataaaataaatgataattacataaattttttgaataagacgataggtcaaacgtttgtcaaaaattcaacggcgtcatacattaaaatacggatggagtataaagttaaaaaaaaatattagaacagtattctaagaaatttatacaaaaagttttaagaaaatcacaccgtttagagtcttgagaaaggatccttcgaaatagttccctcaaatcttatggataggaaaataacaggaatgatcaattagatgaagcgtttgaaaccacacaaatcaaaagagaggaatttttttcaagactctatactactaggtgtagcaacaccaacatttaactcaaaattttatttttcaaagaacatggggtttgaggtatcatatcgttcatatctcgcgtttctgtcttgtttcactaaggaaatgctgttattttgtgaagcatgttgaacccaaaccacaggcttagcataaggttataaaattgtacagcaattgactctctctttatttatgcacctcaaaagatttttgcatgtatggtagcaagtaaaataccatatcatgcaaaggactaagttcaacatacactaaaatcaaacactgaagaacagtaatactttcatgtcacacatgatacacactctgctcatatatatatcagtggtacaatgaaccattcaacagttacaactccatagtttggcaataataagaccagccgatggatatctcacaactcatccatggatctattaataactcatgtcaatgttttcacatcaagtgcagacagaggcaacagaacatctcaatcttcacttgtcagatcccttctttgggtggaaggcttcaacaatagcttcaatctcttccttggcacgctcaaacacatttggacctttaactctctcaactggtgtattctcatttatatcatcgcttgtaccatgagtttcattcttgtgggtctctattttgttcattgacaccttgctttcatcctttgagtccttatgcaggtctacacaattttgtaatggtgtgtatcataatcattagacaggaagataaggttaatcaatgcataaaagaatctgaccatcatgcatgaatatcacacacaaagagctgacaagtcattgttgatttttttttgtgtgctgcaaattcttcgaaggaattcaagcaaagtatttgtattcaaactatttttagggcatacatatctaaacttttatgcctgaaaggatttccagaaagtttcatgatttagctgcatcatgttttaaagtcggttggtggcatcaaatttgacaaacaattactgaaaaggatgtttttgcaataaaagggagaaaaatgaagatgctaatattcttgaacttgtgtttgtgttatctcagaaaaatcttgttacagaaaaccagactttttcaacaaagagaaataaattctgatatatgcccaatgcatgattaatgacccatcatattatacaaggaactcaatacacaaggtaaaaaacatcaagctaaaatttagcaattgtcaattgagtatgctgtagcgcataattgctagatcagattttgtactccctccgtttcacaatgtaagtcattctagcatttcccacattcatattgatattaatgaatctagacatatatatctatccagattcattaacatcaacatgaatatagaaaatgctagaatgacttacattgtaaaacgaaggaagtaggacataattactgaagaactacgtgtcggcctattaggcattgaagagcttaagcttgtgcgtttatcttatatgagctttgtgttttttggtcctgttgttaagcagctaaggtcgtgacttaggtgatgaggcaaaggatcgtgcgatactgtgatggactgatggtaacattaagcttagatgtgaattgtctctctgggtgctttgggcctagccgatgctcctctatcctatccttttttccatcttttctgccagatagtttaaaatcctactcttctttctggggataataaaaggtgctcagcatcttcacagaaattaaattacggaaaacaccgttggttcaaacaaattaccagcattatttccatggggactggaattgtgctccatcttatcatgaacagctccaacgagagcctcaacctcttccttggctcgttcaaacagattgggggccttaaccttgtccacagatgttttatgacttatatcgttgctcgttctgtgagtctccttgtcatgaactttatctttgttcatcacgcttttgattcacagtagaaagctgcctattccaagctccactctgcacaaaattccaacaagagcattcaggatttcagcccgtgataaacaacacaaaacctgatacttgccattcatccctacgcaggatccgtgcccgaaaaaaaaaaaggtaaatagcagaccatttgccttaatccaatcgagcgaaaatggtaaatacaccgtttgacatcatgcccaaataaaaagactttaatcatctttcctcaccgttctgcttgctaaatgttgcagcatccagccaaataatacactgggaacgttgcacagggcaactgtttttcggctgtcagtgctgaaccatcaaatcggcaatggcaagcaaaagaaaacataatgtacactcaatataatcagatcaccacagtattactctttttttttgttttttttttcgggagactgcagtctgcaggtagtactcttgatcgagagctcactgatccggaatcaacagcttcccaaatcgaagccctaactcctaatcctccccatccccagatcaggagaaccctacgcggatccctgccctgcgcggcgagtgctaaaacgatacgaactgctctctctctctctctctcgtcagatcccaaacctaactatggaaaaagaacatgtcgccggggtacacagaaagatatagttgcgcacctgcggctggctcccgccggcggcgcgtcgatccggcgatatcctcaccggaattgatgatgaaggagagagaggcgcggcggatggatggattgggtagttcgtggaatggaacccagacgatggagaagggaaagggaggaacggaatattcttgggccggcccaacacaaaagcccaatgtacccaaaactagcttaaagaggcccatgtggccctctgacatctactaggcccatatcggctttgaccccacctgtcaatgggatgggcgctgaacggacggaaaggtcggggactttctgtgcggttacgcggggcccacctgtcagcgtcgcccgtgtcgctccgtctccaaccccgccgcgcgcgacaagcgagcggccggtggccgagacgtcgtttgaccgtccccgattcgcccgccgccgccgccgccgcccgccgccacagcccgccggcgaaccgtggccgtatctctctctatcctctccggagatggccggcgcgggtgcgggtgcgggcgcgatcgccgctctcctgcgcgccgcgcacgtgccgccggcgccgcgcgcgcgctcgattcggggcctcgccgcggcgcgcgggctccctcctctcgtccgcgccacggcggcggccatcgcgccgtcatcgttctgcccttacctcccgcgcctcagctctggtgcgttgcctggcgtgaattgctgctgccgtatgacgtacatacagctcgcgcctcagctgttcgacgtaatgcctagctccttctgatgaattgctcccgtttcttccagctcgctccttctcctcctcaacatcgtgcagcgccggcgcgtccctcggtggcgcggtgtccacctcgccgtccgagcaggagaagcagcggcagcagtcggagctcatcttcctcggcacgggcaccagcgagggcatcccgcgtgtcagctgcctcaccaatccctccaagacctgcaccgtacggccaccctcttcattgcagcagcgcgatgtcgtttctatgtcatactttgtgttgattggttgctcaatgtcatttgctcactttcttctttgtcctttcctgcacgcaggtctgtaccaaggcagccgagccagggaatcggaacaggaggcgcaacacgtccatcctcctgcgccatgccacgccgtctggcacggcgaacatcctaattgacgctggcaagtaagtatgcgcctttggttgatctgggagtctgaaagtttgcttcatttctcttccattctgggttatcattcttgaattgaaaaagagtgagagagagtaatgagacaccactgtgtttttctctgcttcctctgctaggttcttctaccactctgcgctccagtggtttcctgcttatgggtattgaactgctgacgtgctccatatttgtttccgagaaatttagccttgttaaacgctagcttctgacattcagattgaggacaattgatgctgtgattattactcattctcatgcggatgcaatcggaggtttgcaaatacttttattgaagcaagcaactttattaatattgattgagacaacacaccatgctcgttttgctcttgagctttctaaaagaaataagaactcctttggtacaggccttgattgtcttcgcgattggacgaacaatgtccagcccaccatcccgatttatgtagcagaacgtgattatgaggttggtgctatgtttgtagttttgtttttgcttctctagaattgcagcctcagaaagtttcattcctaacgtagacaactgtcatgccaattgaaatgaaactcacaacttctctttatgtatgcaagattttaacaactgggccactggctcacttttctttctatgcttgtactatttgttcgctatcaggtgatgaagatgactcactactatttgattgacacaagtgtggttatacctggagctgcagtttcagcattgcaattcaacattattaaagaggaaccatttacagttcataaccttgaggtctgttgtctaaaataataatttatgtaagcaagaagtagacataaaccacacgctatcagcaataattagctcttcaatccgcaaagaaatttctttttctcaactcatttgactgcactgtaataatactttatactctatgtaggcaggtaataaaaggatacatttacttctatatccttatttttgtttactatcataacttaattaactgaccatgtctatactttgagttatttgaattccaatgttgttctgagttaaatgttagtaaatccgtcatgaacctattagttacatcctatgttctcaaaatatgttgttttggtcatgatctccggtagacacctgtgaccatcgatttgttggccaaaagtatgtaaactataaggtaagtaattttgaatgtgcctttttaaattgcatgtccaaacgaaattaatatgtttttaattatgtcagtttgcgctaagtgtactttcgagtgtaccctgtctaatttattttgctgaagatatgatttctgtatttttcaggtcattcctttgcctgtctggcatggtcagggttaccgctctcttggttttcgttttggtcgtgtatgctacataaggtagatcaaagtgcaaagctaattttttacaatatattctgttggttcaagttcaacacacatggtcttaatatctctgatgtacacagtgatgtcagtgatatacctaaagaaacctacaaacttctggaagactgtgaacttctaataatggtattgacgttataactttttctatatatatatgtgaattgttaaagcatgagattatgggattctcttgaagctgcatattttcttatgttacttagtgtttttattaactttttgtataactggatttaagcttgattttattataattatgtccaggatgctcttagacccgatcgttcttcttcaacacactttggattaccacgggtgggtagttagttctaatatatcaatcagctctagcttcttattgcttcactgtattccatggtgatatattcttcacttctgcaggcccttgaggaagttaggaaaatcaaaccaaagaaaacactgtttactggtaatcattttgaggctcgtttaatgcctttactgaattaacgctgctagacttcttcagtttaaactctatgtgcactttaacttttcatgttaatttataaaaacattaatcactctggaacagaatgcacagtttactatgagaaaaggtacattgttctattgcatgtttgagaaagcttatctgcctttctattgattggcagaatttaatctcagaaaggaaaaaaggggcaatatactaaaaaaatgatctccttagttaactgttcaataatttggtacttcatgtgcacaataagcatgatgagggtgtcctacaatcactcacgccgagcttgctgtttgttttccaatggtgtgtttgatattttctcctattgcttgtcacataaaagaagaaaatatctgtatagtaacttagatctaaatattcatgttggtcacttttcagaacctttcaatgtcagaagttaactattactattcatgttactccagtttattcagaactaaagcatcaaagttcggctacttatttcttgtttatggacatgataagaaaaggtcgtttaatttgatcgaatttcacatgatgtagcttttattgtttacatgatgttgctcttgatgacttgactgaatgatatcttcaggaatgatgcatttaatggatcacgagaaagtaaacaatgaacttgccaagttgatggagacagaggggcttgacatccagctgagctatgatggtctcagggtacctgtatggctctaatactattaattcttttaaacacacacgacatttttttgtcttctaggcacagctaggatatgtttacagattttctaaggtttcagttagtaaaattattattacaagatgtaatctgttgaactccttgctttgagcctttgcttttcttttattctcccttctctatagagggagcttatgtagcaaatatacatcttataatttcccaatgcaataaaatttccaattgattgtttttgaaacaatactttcctatctttctgttgcccccttaaacagattttctttatggctattattgcttgggttggatacgggtgtgagggactgaggctagggatccagctgctggcagggcttattccaggcttccagctgtgaaagagaggctctgaggcctttggaaatgagaaggggaatactagcatgaacttgtatatttctgcttccgcaatgaagggtatgggtcctcacttatatagatgaggttaacccctaacaagagaatctaatcaaataaccaaagtaatctcgtctcctaaccaaaccaactaagattttaatctccaatctgctattttcttccctcacttggaggtggccttgctgattcttgcgtgtggggtgtctctacttgctgctggctgctgccccagagacactagagcccgtaacagttgtatggataactggactctaatgtaggattagggaccataaaaggaagtcatcaggacttccttgaaatccagctgaaggaacagaaaacactggtgggggggggggggtcaataaaccatttgatctgcaatatcacatgacacaaatgattactgggtacagatgaaactcctagcttgtctttcttcggtgaatcacactagatcccagcaataattagtaatttttcttctctaggtcacacataacaaaaggctggtgtccaggaatcgattacactccagctgctcgacctagtcttccccttaggatcatcactccaaaatatctgagtatgaaatatgagggaagcaatttagtctttaagagtttaaagttagaatatcattaggtaaagactaaagaagttaattttttactgtgtttatgtacctgcccatcatcatgaccgtggcttgagggttcgtccctggtgatctagaaaatgttgagccatcgactacacggacgcctgaaactccaagcacacggtgttgctgatcaaccaccttccctacatggcatccaccatggtagtgccagatggttattactgtatccctgcaaaattgctctagggattctgtgtcatttgtatgcttgggtatcaagttcacattagcctgcacactcatattgagcactctttccattgaatgtccatcagtgttggcagacagttcagagaaacggtttgtcttcagtattcgttcaatggtcttgataccatagacgcaacgagtgagatcctgtggatgactgaagtagttgaaggtaaccgcagggttcttcttgacatcagtgtctatcagggcaagatgtcccgtagacagtggaccatcaatcttctcgaggataaaaccaccatggaatatctctttgggtagattaagtttggtatttgcatacttctgtgctttttccaggcttctttccttcggaggaattgtggacagctgtccaatctgtaccataggaatataatatgtattagaccaacaaggccaagtagggaacaaattgagacaacaatggaaactatgatggcagttattggagttgttgcaatgtagacaacacttattttttttaatctccaagacaagaagttcaattctgagatctgattcctagaaaatctaagcataaaacaatgacttataaatcagataagtattatttcttagaatatactattatatgcatatgcatattcacctgtaattaatgaattggtctaagttgtgtttgcaatgttgcaaaatgtgagttttgatagtttagactttagaatctgttttcctttttgaagtctgcagatctaagcagcagctttttcctgatgtttgtgatactgctttagacctattttatgcacaaaaagcttctcatgatgcaagtaagattgatgacatacctcagcggacatgattccatggtggcaatggatgctttctggtgactggccaaaaccactactggcctcaatgaacacaccagcttcagttattccaacagtctcaatcagggactggcgaggggggcttttcgtcggtatgaatatggagttcatggggttatcagccatccctttacccacatacttgttatggagaactacaggaattttatggctcctaaggtcattcttgggtccaatcccactgagcaatagcagctgggggctgccaattgcgccagcagagacaatgatttcactatcacagttgctgttgaggaatgcctggtggagtcctccattctcatcggtgaactgaactccggttgctcttggcttcagttgccctgcatcagaaatggtgtatctgaaatatggtacgtgattactgaacttactctttctattcatggcatataattctatataactctattttagaagataatacaacttgtaggagctttggccacacatgtgtaattatttacctctctgcgagttaaagactatcctgttcacactagcatgaagcagcacccttaggttgttagggtctccagctgcaagtaagtcggctgctgtgtggcggtagccagtctcatcaaagatggtgccaccaactttggtcccagaaacatggtcatatgtgtagccattgaaaggagatacacctgcttggagtagcccatcccttagtgcagcctgccaaggtgcgatcttaggccactggacgatcttgtcctccacccaagggaaggactcattcaccaggtcttcatcccagcctacctcctggatgaagctgtttgtttcaagaacaaaaacacatggtatacaagttattagcaatttaacatgtagttcaccaataacaatttaacatgtagttcaccaatatgaatatcaatatagaagtaaaattccttcttgaagactacgggattaagcttatcaattattgataccttttaagtcacattggcgtttctggtaatgagcaggtatatcactagggatgactgatgagcacgggtgtgtggggcccacccattgacctattgtaattcgattctgtacaaataattcgaatgcatatgtactaattggcccaaacttgaagtagcctcgagtctactagggttttagttatttagtgtcctttgcctagacaacttagttaccatgactgcaaagaaacaattatagccccatgtgattttgttttgttgtctctctctttttttttttcatcaatgtctcttttcaatctagtctgtttcagtaacatgtagttcatgactgcaagaagagcaaggaagtctttttattcactgagaaaaccacagcatgtgctgctgccagcgtagttaattatttgcaataccagactgaagcactttaatgcaaaccacttttgcaatctgcttattttctttatgttatcaactttctcactagtgctcatttgtatgcaagcactcaaagtacaacctttgctaattttacagctggattttatttcgttatatattgcagagctgcattgtgataaatctcaaagaaagcctgcattttgataaccataaactagaagtctagaatcataccaaccaaaatatgtagtcctagtgaaccgataatcatgtccaaatgcagtgctgggtacgttctagagtgagtgctagtaatgcaggtggtggttttatgcatttgtgtcttttggctggctcattttagtcgattagaacctatttgagctacactaattagtgtttgtttgtttccccgttttcccttttccatttggacgctggagaaaagaaacaagaggttgtagccagagaatcctaattggcagaaactttggtttcatggtaattgaatgctactattgagaacagtgaataatatttagtgttctgctgcacgtttcagcagacagctattactccacttgaagggtgaacaaaggtggctgcagtatgctagggtggcagcagtcaagcagatcttaccagttaccattagtaatttctactggcactatcactgctctgcatttaccctagagctgatgtttgttcatgtgaaagtgataggccatgtgttgcatatactgagagactacttggtatatttaatctacttatgctaacttcattttaggctctgctatttgtgcttgccctcttatggtaaagaatataatagtaaattatatctgaagtcttgatcatgattgagaccattctgcacttcggcagtaaaaaaaaaggttaaatttgcatgtgtgaactgtgaattctcttgcatatgtttgtgtgtatatattaatgctgaccattctgcacttcggcagtaaaaaaaaggttaaatttgcatgtgtgaactgtgaactctcttggctggtcactcgtagacggaagagaacaatcataatcaggtaagaatactgatacacaagatagcatccatatctgtgcaatgcaattgcttactttgagctggcccggctgtagaagccggcattgatgcaggtgccacctcccaacaccctcgctcgggcattgatgacgccgtcagtggagatgaaggcctgagacgccgagtccggcgccatattgctcaggccaatgtggaagttctccatgtaggagacgttgcggttgccatacggagaccctcccctctccagcaggagcaccttgtacttgagcgacaatgtcgccgccagggggcaaccggcggtgcccccgccgacgacaatgtagtcgtatgtctcgtggcgcatcgctgggaagctgctcgccttctggagggtagggagattccttaagctgaattgctggttgcctgagaaaacaaagtgttccataatgttgtcattgcctgaaaaagttttgctttgttctgctgtaagtttctcatgctataaccccctttttttttttgcatgacttcaataaaagctttcattatctaaaaacataacctgtttttgcatgttgataaatgagtgtatcaatctaattgatgctatgattactagggtctggacctcttggcagttggcattgtacctcctaggactggatgagaggtacgtcttgtggcattgtgttgactatttatttcctatccttcaatctctaaatattgaactctgaatgattagatgttctgctactctcaaatactagtggtgaggccaatgtggcgataaacaatgataggaaccaaagtgtcagataatggaagtgcacgtgataatgatattcttgcgagaaagaagctaagcaaaaactagcatatataactgcatttcaccattgcaagttcttcaatgggaaggtggaacagaaatgtacagaataaaggaggaatgcctgagaaacatgagatgagacagaatacagaatagaggaggaatgcctgagaaacatgagatgagacagaaccacaagagatgcgcaccttgggataaactgaaggagcagaggcaaaccatggcctggaagatgaatagcattctcttgctcaaagccattgagcctgagaaccacctgccaagctaaactctttccccttcttaggattttccttccctccaaaacaacggtggcaaaacctctctccctcccctgtttcctgatctccacctctcaagcttgctcactgcatttgagtaggtttatgtagagggcttggcattgggggattgatagcaataggctgctgtgtatatgcattaaagagagctcaccagctctagtaagtgctattcaatgcagagggagcactggcctggtacaactgggatttatggacttcatcaaccaaccaaccgtagcaaggctgctctgaaggtacccaccaccctcattacaagaatgacagtcgtatatctctttcctctatctattcatagaaaaatattttccttttccaatctttttgccaattggttaagccaacgtgttattagtattctaatattctattcctggtctgttccctccatttttcaaatataggctgtgtttagttcgtgtgccaaaattttttttaagtacacggacacacatttgaaatattaaacgtagactaataacaaaacaaattacagattccgtctgtaaactgtgagacgaatttattaagcctaattaatccgtcattagcaaatgtttactgtagcatcacattgtcaaatcatggcgtaattaggctcaaaagattcgtctcgcaatttacagtcggactgtgcaattgggttttttttttcgtcgacatttgatgctccatatatgtgtccaaacattttatgtgacggaaaagttagaagtttgaagaaaaaagttgaaatctaaacatggccatagatacattcttgttatttagtgcagatgcttccatctttaaataccagttgcagacttgcaggaaacatatggtgccatttttttatagcaactgcagaaattgttttgtgctgccatcttcttggaacctatatgctgacaaacatgctccaaattataattagttagaaatgtctctgatgtagattatccagctctcacggcctgtttggttggagggagttggtgatggggaataggagtttatgatatctgggagtttaagtctgtagtttggttggaagacttgggaattcgagggggtttgggatggggaattaaaaggtcgaattctcaccaatatcttacctgggagagacctgttaattcgtgagacttggagggaattcgacgtgaaaccaaacaagggacgagaactaaaaatgtaactcccatgaccaatcccaccatcaactccctccttaaaactcccattcctcttcccttctcttaccaaacagaccgtcagtgtttttatttcatttcatctagaaaaattagccaccatccctgaatagacaagcatagcaaagtttactgtaatgcaccgctcaaagttaccgtcttaccattaagattacttcttttatctgcacactgttccttgttaatgcgatgtgtatagctagaaacaaagcagagagctaagccaagctgaggttgaattgactaattgtgtggcctaccttgtcctatctggtctgtagggatttatattgctatcgctcaaatatatcatttatgggttgatggccatactaaatacacttaacaataataaatgctatgtgctacctttagttatggagtacattacattacattgcttgagactcgtcatgatcaacatacagtgtgcaaaactgttctttgtttttttataagacctcttttaggacttacaaagctgttattgaacctttcatgtccattaggcggtactcacttgtgagcaccaggaaaagcaattagacctccatataaattttgaactggaaagcaagcgagcaaaatttattaccaccatcaactgcctgtgtatatttggcagaaaacaattgatgcacaagaaaagagtgaagtgttaactattacatctgccccaacattactaggctgtcctcttttcgttcccctgcaaccatggagcttgtgagtaaagaaaaataaaacactgagcgttcgtcaactacactatgatgcttttcttttcctgcatccctggaactcacaggtttactacaagagtgaaacctaaagcagaactatagctaatctcaagctgcaacgtgtcgcacacttttcatttccctcacaaggatataactcttttgttgcttatttgtctgcagattggaagaaagggacctatgcctctcaagcactttaaggagagggagagccaaggacaatatgacctgtgaagaaccagaaagagccttcacatcacacggttacatctggatcgaaaagagacgccctaacaacctactcgcaggcaacctgggattatttaaaggtaacacgagctagcgttaaatcagtttctacacacccgttttcacctgttgtcacagactcagtgtcacacaccaagcgtgtgtatgcatgtagatataacacaacttgcatgggtgaatcttttggtcgccatgcagcctacattgatgctgccggaaaattaggtgagtgggagatatatgatgacactgtgcatcatcttgatttgcagggctgtctgagctgccgaagcagagtggtgcacctaggggtcacaagactcacatccttgtccgggcagttcgctgatcgccggacggctccttaattttctcaacagaagcctttaatctgtattcaaatggctctaaatggatccgcagccaaacatttccaagatacaatcgtaactctattgggtggattctggaatctcgatgaaatggagttagatctgggagaagaatcagtactggaactatgtcaaatggggcaacctgaccagtgactagtgaccactgctacgagctggaacctgttaaatttccatgcccatccatccatatgatatatttcccactcaccaccagtttttctgaacctgatgcaattatgcaagtaatcaagcaatcaacccaccggtgaagatgttggtcaatgactgaaactaggaggctaaggttatgtcatcaagatgctccatctccctggaatcccagcattttcatcctctaccatttcaatacaaccacatggaaattgtgctagaatcatcatcatcaccatgaaacaaaggtacatttcctccttttgaaaagcagtgatactgaatttttcagcacttaaatacaccactttggatcctaagattggcgtcgacacccttaactcctgtggggtaaatcacaaccccctccctgccattggattgaatggttcatgcaacacaataggactacatgagtgctacaggtgaccccctcatccccaaagaaagttctagttctcgcaaggttccaagttcatcacctagccattgtgttcacccacttcccttgctccccttcatccggtccaaccttagtcgtgaatgcatgcacgtagttacatgtacgaacatctatgttatgaagatcgtagatgtcatcgtggcgccctaatccacttggcaggtgcggtttactacacccacatggcagtgactgttcacgacgattttcctagaatagttgcttgtactgtgaggagaacttgcaaatgtaaatactgctggcagcacacagttaggagagatgttagctgtgccatacggtgtgcgcttaaatgagaagggcagaaggtcacatggtagcgtatttaccagctgtgtcccagcactgtccgtctgctgctgcccattggtgatgcaaccatggccatgtttgtgtgatcccttgagctcaaatgcttcgtactgtgattatcaaaccatctaatactaatcaaagttgtttttgtagatgccactatatcgtctcacctctcttgtcctttcttttttgttgttaggaaaaatggggcgatcttgctactgtttcaagtttaaggcggcggcagatcagcgcagtcctcctgtctcttcacagatgattggctggaaaaacaaattctgcatctcatctggtggttgcgtctcaacggagctgacgtgatggtctgacaaagatgtttcaaaccataaattagtcactgacaaagcctgcttctgttgttcgccgaaattcttttagaagactcaggccctgtttagatgggactaaaacttttaagtccctattacatcggatgtttgaaaattaattataaatattaaacgtagactattaataaaacccatccataatcttggactaatttgcgagacgaatctaatgagcctaattaatccatgattagcctatgtgatgctacagtaaatattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcagtttgattactgaatagtagtgattgattttggtcatttggggcgccgtctgcatgttccatcctgcctactggtaaagattagtgatggtaatacaaaggagtacatatgttcaatgttcatagcaatcctctacaattgtcctttcagatacacaaatttgaactgaatgtgattttgtgaaatgtgaaaaggagaatggtgaaaatacgaaacaatttcgaccaatcctaagggacgtatcactggtgaatgatgttcaaaatttatgttgggatgatccaccaccgcatgtgccttcctgcagaaactccatatctaatttagcgaagttttatgcaatacacccttactcccttaggtccatgaagtgaaatggccaagggggaaaggttttaacaagggagatgaaatggtggggatatgatggaggtttagatcatacttgcaatccagctagagcaaatgcaagtgatgatgttggcctagtctaagagggcactacagtgaagatctagctcaaggatcaatgttgtgggacatgttgggggatctagcctagatgtgtctcacaatgaaggtcatgagtgtatatatccttaaccaccacaatgtgtgttgcatggcatgggagcctttgtcctccctagtgccaacaccatcgttgcctccttcattttggtgatgatggggtagttgtagctcatggttacccgcctccgggtttggtcatgtggtacttccattccctacactcatttgatttgcccctcccctgccttttgtgagagaccaacactcagaacaaaacccagagatgcatgtattgtgcaatggtgtgcagaaggtagtaactgggaatcaataatgttgttacgcatcatcctcaccaaaactcaatggcatcgccaattcaccatcaccacaatccgacttcttagttttcttaatcctgtgtttaaaaggagcctttttggtcttattgtgacacattttcgtggtggagtcaggagagagctcctattgactgtcagtagttatgagagcatctccaagagctccctaatatcagcttcaaaagataaattttaggaatctagaaaacaggtctccaagagatgcccaaagatggtaccaatatttacccacacctaaaaccagaactaatctgaaccaattttgggcacctccatgcactcccaattgatgaaatcgccggaggtttttgccactcgtgccttttcttcccctgtcgtgcactgccgcgagatgcccgagccatgcctgcagacttgtcgatgccctcgtcatcccctaccgcagctgttaggcacgcgcaagatcaccctgctgcacaacatagctgagccgctagcgcgcaattggttggtagcgcctaacgccgatctcccttttatcagaaaaatggaaagacaaacggttgaagcagatctacttgagatgatgtggcatgttttaaaatgattggaaaccaaatttaggggcactcttggagtagaaggtgatatttgggcccaatttcttttgggatggtcccaatccaagaattttaggagttaaatttttggatgctcttggagatgctctcagtggtaaattttcggcaacaaagctgaggtattccatgatgaaacttatgatttttttttttgccacacgatcaaatccattttcatatcacaaatttaattagctaaagacttgcatgcatatttcaatgaccgaacttataactacataaactccaaactacaccaaacagaaacgatcacaataatgttccaatagtgcaattaattcagctcaccaaggatgtctttttctctctttgaggtcccaaccactaacttctccagggtgtacattaccgttttcaaggtgaaaactgatccctttcggtttaccgaaaaccaagcgaatactactttcgtaggctctatttgaaaaccggcttaaggctagtctcaacacaagacactaaatatagttttcataaacttctcatcatcaagaaactagtactagacactactcttttaatgcaaacactattttttcatacttaaatttaatgctacttatttcacatgatgttttggatgttgtgtagaaaccatgtcttagggcacccgcaatggttatctataggctctctacaagagatctatgtcagcatattttcctacttggaagagattaaatgaagagagagagcaaagctatctactaacctggagatagtctataaagaaaaacgaggcaatgaattagatagctatagatacccatgtagacataccattaaagtggtttactattaatctagtctattgctgatatgtacatggtagcaccttactttaccattgtgggtgctcttatgcaagacctggtttccttatctttcctcatttattcacttgtcacattattttttatactaggtagcagcttatttaatactatggacaccatactagtctttgggttggaaatggtctaaagcaatcggttttcaccttgaaaactgatccgtgtcggtttaccgaaaatcgagcgaataccacttttgtcagctttatttgaaaaccagctaaaagcgatcggttttcacaaaacagacccctaacattttgatgaaaaccggttagaatcgcgaattctgctcccaagctaatccattttgatcccccatcgcattgtcctcgctcgtacggaaaagagaatcaagatatgaaaagtttgaaacagaactggaaatttatttgctctttgatggccgattccgatgtgcaactgttcgtgcggtggatacatactgcatgccatgtcaaccacggaattcaattaaactcactcgtcgaatgatgttgaaattgaattgaattgaatgtcgatcggtcaacatcatgtgttaattggaacgcgtacgtacgtagatacatctcctactatcgcattattgttcttttgatcagaaccggacaatgccagtcatctgcacggctactatcagatgtataaagacaacgtatatgtacacacagtacatgtgtcgtcacgcaccgccttatggaattaattaaactaacttaattaaaagcagtccataataaaagatttagtatattcaaaattacttgtaagcatatgcatgggtggctagtaagttgcacatgtatggaggacttgtacagttgtataattgtatgtgtcttatgaaaaatttgacagattaacttgtagcctgatagactgccttctttttagttgaagaaaaaggtcacaaattgaaagatgtgaaggggctaaatgatctattgtatgtgtctatggcgtgtaaaatgtgaagacaatggtttttttttaaaaggagaattttgagtgggtcttgtgccaagtgaaacctttcttgcagtactttgcatatcacattttttttattatacaaaagatgcccataaacatatatacatataactcacatacctaaatgcgctgtctacacatacacatagtaaaaagacacaggtcacgagttggtcatataaggatgagttcaaacctacatgctgtgaaactttctttccggcaaaaaaaaatagcaatggattagcgcaagaataattatgtattggcttaaaaaactttaaaaataaattaatatgattgtttaaagccatttttctatatttttttaaacaacacagctttcagcagtaggaaatatgcgcgtgaaaaatgagagagtagaagttaggaaaatatagtcgagaacacacgctaagattgtttataaggccatttcccaatgaacgatgccatttttatgtttctaaagatgccacataaacaacaagacatttaattaataattgaaacagcgcccatactgcaatgcatggttttatttttgttgtttcatagctagcatagtagcatatgcaagagacaaactgtattggtaaaagtgtagaaattgtttcatctagataaaactcatttcatctctcacttcattaatttcttactacatcatcaaaaaatactggcatatgtcaccctgtttagaataaaaattctattgggaggggcccaaacctaaagtcgtgtacttctaaacataatatgggccgtactatgttttgggccactcacgaagcccagcaaaaagaacgcgtcctaccttgaggcccaacttagtaacgcagatccagaattccagaggcctcttcgcttcacccaaaaacccaaaccccaccatggccgccgccgctgcctcgccgtctccggcgacgccgccgcggatcctcctcgccggcgacgcgaacggccgcctccaccagctcttcaagcgcgtcacctcggtaacctcctcctccgccgccgccgcgtcctcccctcccatctcgtcgtatcctctcaccggctgccgtcggcacaggtgaaccagtcgacggggccgttccacgcgctgctctgcgtcgggcagttcttctcccccgatgccggcgacggggatggcggcggcggcggggaggtcgcggactacctggagggacgcgccgccgtgcccatcccgacctacttcaccggggactacggccccgcggcgcctcgccttctcgcgaaggccgcgtccagcgcccgaggcttctcccccggaggcatccagatatgccccaacctcttctggctcagaggcagcgcccgcttcaccctccatggtttctctcttcgtctttccatttctcaattgtgttggactaatttgtttcattaacttaggcgtaaatactgtgctcatagatgagtagctttacatctccaatgtctgaagtaaaatgttaaacctgttcaattgcagcatcttttcttttgaagctgataaaatattccatgcgagctattgtagaaatgggctggaaatgggatcatcgaaacaaatgcttgctttagcaattccatttattggattttctcacctttcgttaggtttatctgtcgtttacttgtcgggaaggaaagggccaggagggcctggctgctacagccaggatgatgttgatgcactacgggctcttgccgaagagccggggattgttgatttgtttttgacatatccttttttctttctatggcattattatttcttagctgcttgtgttaaactgaggtgttgtcgtacatgaattctcaaagtatcaagtttggtgctgagttcccttgacgataatgagattgcactaacgaatggcctgctggagtggtgaatggagttgatacttctaatgcaccttctcagatatcggatcctcatggatatgatcctgtagttgctgaattggttgctgagattaagccacggtttggtttctgaattcatattttctatatccctccttgaagaagaaagtagtgttggtggtagtaattcagattttagagttcaaatccattgcactgatgttctccgggagtaacgaaaactgtaattttgtgataaaactgctgctaaatctgtagttttgtgatactatgccttaactctatagttttgagataaatgtgatgctaaatctatagttttgttatacacctccttaaatttgtagttttgcagtagtttggtcaaggtatttgtagttttgtgaaattcacacgaagaaccttccatatgacgttttattctcttttaggcttttagccttctaacaacaaattcacgaattaacattaaaggccaaacatgactgaattgccatgtatatatgtggtgtgtgagttaattctgaaatcagtgtgtgtatcacagtcaaatgccccttgtaacacaaaaggtgaaggacttcaatgcagaaattacatttatttctttgaacaatatgaagacatgcataattttcttttatccaagcaaatacactagtattaagctagtagtttaaatgttgactagactaactgaaagcataatcacggaatatgtttacatttatataagtctataagatacaatgccaaccaaaagtataccgaatttgtaacaaaagtctgtttcctgcagatatcatattgcaggttctaaaggtgtattctatgcaagggaaccatatgtgagtgattccgctgcacatgttacccgttttattggacttgctaatgttggaaacaaagagaagcaggtacatctatatttggccaaatcaacttagttcttcaaacatagtttctggttataattctactacattttcttgtattttgttcataatttagtatacatattaagttctagtactccctccgtttcacaatgtaagactttctagaattgcccacatacatatagatgtaatgaatctaaacacatacatatgt

SEQ ID NO: 79693 - DNA, 51417 bp, Oryza sativa
cgcgagcgcggcgaacgagatcgccgccagccccgtcgccggggcctgcgcgacgcggttgaacgtgatcgccgacgcggacacgggggacgccccggcgtcggcgcgcagcgagagcgacacggcggcggggacggcgagcgccagcgcgaggaacgccgcgtacgacgcggcccgcgcggcgcgggaggagtggtccagcgcgcaccactgcaggaacacccggaagctgcgcagctcgtcgtggatcaccgacttgctccgcgcgtacgccgggttcagcagcagcggctgcgacgacgccgccgccgacaacaacgacgacgaccacggcgacatggaagacgtctcctcctcctccgaatccattgccattggaacagttggataattcggtttgattcgtatgcatcgaaatatatagtcgtcgtgatcgagtgagcagtgtggggggtgtgcaagtgttcgacatgaggggaaaggagaggagggaggaggagatctcgtgatcgttcacaagggcggcgacgactgatgaatgcagaaaaaggcaaggggaagaaggcgactagctacgcgtgcatatgcacgaactgttcgatgatcttgatcgccatgcatgcattgtccatgatgttcttccttttctttttcgttgtcaaaggttgtcacctgttcagctcgatgcacactcttggctgagctatactgaactgaataacttgttttgttttttcttaaaaaaaaagctcgttccggtcataaatatttaactcctggaatgagattgtgatcaaaatttcaaaattcagaccatcgaaatttctttaaatgactaatttaaaagcacaaaaaagtggcaacaatagatttaccttgaaaagtactgtcataatatcataaacttatacacatatacagattggcagaattttaaacgattgataaatcttcttctaagcttcaaatatttataatcagagggggtaacttttctttttttgtgagtaaaaaaataaaatgaataagtattattaatgaactttggaaatcctagatcaaattccaaaagaataagtccacttctgagggactcaaagtagacttatacgaattccaaacaggcttagtaagcccatggtgagtttacagatgggccataacccggaagagattgccagctctgctaggtgaggtggagggcccacctagtgggcccaattgttttcgcgggggcatatacagcggaggacgcgtcgtcgtggagaagtggaaatcagtttccactttcttccaaagccgaaaaatcgagagagaaagagcaaaaccctaaccgcggcgctccgcccccttccgccgccggattcctcctcctccttcgtccgccttcgccggcgccgccctgctccgaaggagcccaggccttgtcgccgcgtcgcttgccccgccgccggtttcagcagcagccacccccaccaccatgtcttctcaggtacacgggtctctttcctcgccttgctctatttgtcgccgcggattggtcggggggctccgattgctgccgcgggaatccacccccgtcgccgcgggatggtgcgtgcgggagtgggtgggcgtagaattaggttaggttggatttggacctgttgcttgtcgatcagccatgggatctcgccgcaaaagctcacgcttgcggtgtttgtttgtttacaggtcgacaaccgtagccaatctgctggaaagcgtgcccgcaccgacggtaggtcgcttcgccgcggcgattaacctgcggctttcctttactgtttaagctgcatctgaggggaatttcatttttggtatggatgacgactcacaggtgggcggcgtgaggacgactgggtttgccccagctgccagaacgtcaacttcgccttccgcaccacctgcaacatgcgcaattgcaaccaatccaggcccaccgactatacggtacatgtgattgccaccgatgcgcgctcatgtggttgattagttccgctcatcgtgatttttgcatttacctagtcgtgctgttgcctcctctccagaaggatatgcagaaacctatgcagacaccgccgccccatttccccatgtcagggggatacatgagcccagggacgccgccatccatgtacctcgggggtggtgctcccccttatggcacctccctctatggcggacctgctttaccacgttatggtattgctcagttccctgggggttctggatatccatatggctatggtggccgcctggggatcctctagagtcgacctgccaatggggagcccctatgggccgccgatgcatatggcagggcctccatattctgctggatccatgatgggaccaggtaggggtgctacaacaatatagactctactaactgctgagtacttgatttactagatacaatgggcaaaatttttgagaccatttatgtccttttatgcaaaccttagtgtggccagaatgagattttacaggaaatatccttttgcctgacatttattttctatagctacaggatagaaatgctagtatgcgaagtatgtttctttgggaactaatttactcttctacgctctagcatgtaaacttttataggcaaattagttattaccatatattttttttgggtggttgttgcagtttatgaattaaatgcatacgagataaaaattaaaaagttaccaactctttgtgaatatgtgtcctgactcgtgtgagactattcctcacattttttctcttatccattttcctgtcctcaaaataggtggaatgtatgggatgcccatggacagatatagcttgggcttacctgctggtcctggtccaatggtaaacttttctggattattagtatttgctcatgcatattagcatgattcaattgtttttcccttgcataacaaactattgtgggatgttgtcagtggtcactctgtgctctgtgggtctaactgtcgaagggcttcctttaagtgtcctttgatattatagtgtgataaatcacgataggaaatgtttcaactctcatttatacaattctttgatgaagggcgcgagggctggttcatattccgaggaaggatcccagaagaagcctgcaggtatatattttcaaatgaattttgactgttcattgattttgttgtccattggtttatttttcttatgaactttattttaggagctgggcgtgataatgattggaaatgccctaattgcaacaacattaactttgcattccggacagtctgtaacatgagaaagtgcaatacaccaagacctgaaaaccaggtacaattctccacttcttgtacttgtgcaagttcccacctattgtattactactactaaattatgaaatatctttctttctataaatctaaaattggtcaaagtttatgtgcaaattctgataatgaataaatatttttgatttgcttactaaaaggtgtactgcaatatactaacatcgtaatcatgcttaaagttgaccttgttgccacaagattagcaatgtgacagccgtttatattcgatgctatagtaactggtctgaactgttcattaaaacctcatgccatgcaattcaacacaatttgcttgtgccatgtattaagttgcccattgtttgggcaccaggacctaaggtattaagttgcccatttcgtgtgaactgtcattgttttctcctcaaaacaagatgtactaaatttctctccatttggcaaatctggaacctatacttagcaatacatcgtccactcagccttagccattaatcaagtcacagctgacatgcagtaacaaaccggcgattttcagtactgctatattaactgtgttctgggaagtctgtagcgtgtcaaagtattctaaaatagtttgagctgttctcttcgtaatttcactttcatctatcttctgaaattgttcctcatgctttgacttctcttgtttttcctagagttaaaccatcatgcttactttgctgatagcttgtgtgtcaactcttatgcaggggtccaaacctgatggtgcaagaggtccaagtaagtttaacactaactatgcatacatgcggtgccttgtttgtaaaattttttagtgtacctttagtacctcgaaaccagtaaaattctgagatcaatgccatcttatttccacattgcataagttatgcgtgtcacttagcactagttcttgtaatggctttgtcctttttaattctatataatctttacatctaatatttcatggcagaaccaaagatgccagaaggtagttggaagtgcgagaagtgcaataacataaactatccattccgcacaaaatgtaaccgtccaagttgcgaggctgaaaagccatttcagacaaacaatgctaatgagtcatctgctgatcaggacaatcaggtgcataattagaacctccagtatgatcatcattatatgccatgcctttctttagaacaattcaatataaattgcatatcttatgttttctatcaacagtttcgtttatttgcttgtcttcatcatctcttgtgcatggcttgatatatcatgtccttactgttacagtgagtcctagaacagttatgagggtcaagaaggtccagcgtcgtcgtcaaggttcagtctgaatgtctggggtctatctgtgtcagtagtcgctgctgtatccccttgagaccttagttgagtcgtcgtcctaatggtaaacgttttggagtggcaactggagtcatggatttctttattgctacagattttggttaagaacatcccttgtgaatttgtcatatacttctgaagcttggttgctttgtcttggttactggtactctgggaaaatggcaatttatgatataaatttcaattagctatctgtgtcttagattgctacctgtgtgctatgaagtactattagactgttcattgcggtctcagttttgtcaattgtgtttgtggtctttgtttcaacgtaagggtttggtatctcagataagttggttcttgctgatgcctatatcttttttacccgttttaaaaattttcgagaggatcttggaaggtagattctcagtttctcactatatgtttgcgtggcatcctcttcacaagtttctctccacattttctttttgtactgaaaattgatttggagagcctctctggtgctattgtttgaagtagcaattgggtctaagaaacaagttagctcggtaccatggaattgatacctctgtgtcagtatatcactatttcatcaacggtatcagcctttggaataaataaaaaatgaacttgatctaggtttctgccacaaaatttttatatgtttgtaaaaagaggataacacccttctgtcctcccacaatgttggtatattggttaggagacctataaaaccattgtctgaggttaatcaggttcatttgaaccatggaccttagcttagtttccatcgttgtcaatggattgactcctacagccaatgtagaaattaattgaaaaactatgattatcccagtgctcagaagttctataagtccctattgtttgcttttacatgtgtacggcaaataggcatgcatgttactttctgccagactcgtagagctcatggaatcctgttatatgttatcatgttatctgtagcttagcattttcaagttaccccattctgatgtgcttgattcaaagagagggcccttgatgaaacaatgaatccatgtgcatcatcacattgtggagtggtagactgggtaccattgcatgcttggttcgactctgactactcgactgactggatgtcattaaaattagttgttgtcatgtaatattgtgaagcttttatcaaagctgcaactttcacatgactttcaagacaataatgagcaaacaaaggtggatcctcccggtggccctgctggagtaccgacaagttcgcacgccctgcgaatggcagctctcagtgagttgcagaacagtgttaagagctgatacccttttcattttccaaacaaggtgagaactttgatccatgtggatgtgcttctatcaggagcagctgacagtattgcatgcagtgatcttgctaaggaagttggagatgggaaacatcgtgtgatggccagccttgatgtaagaatgcaaatcagtcttactccgtaccatatctgtgtggagtgtgcacaccggaagcatagtcattttttgaatggtcgattgcttcttccacagtaaagtctataataccagtgtgcaggtgtttttttccctttctttcagtgtgaaggtgtttttttacccctttctttcgttcattcattctttttctttttccttgttgagacggtatcctggagcactttgtaatactctaatgtgcttcggaaagtagaatataagttgtgcttatgggcgggccaaaatgctttggccgttagttgcatgacagcctttccaacatgctgctgcctagccgtagttctcccaaaaatgaaaccatcttgagatccgtttgcggttgaactgaaattagacggtatctctggtttcaacatcatcctttaaaccctggatgaaagatttgcaatattcctgcggaaatctcaacgttcttgcctatttgtttgcggtttcgagtttcgagtatacgtagaaacggaagccggaacatgcaccacgctactcttcaactctatcaagttcatctgaaagtttacgcggcatgccgccatgttcttcgtgacgaggactcagcggccaacgcaaatcagtattcaggtgcttaggtaaagcttttttatctttgggtgcttcttgcaccgatcgatgagatgtgctaagaaccacatatatttgatggcattttgcggtactatgtttagtatgaacatccatctttcaccaaccgattgatttataaggagtaatagtttgcaaccaacaacatcagtagtagggaggccaaaggtgttgtcatgcaggaaagggaggcggtggagcggcgctcaacaatacacatggtgcagcaatgcgtcatgttgcactcgtgcaatggacacgcactaaaaatgtttcttatggctagtcaaaattctccaggaaaatacatttcaaccataatagaaaggtcctaaatgccacaaccaaaacaaggagtcaatgcatgtagattcaaaagaaaaggacgataaatttcatggccaaagtaggaatacttgttataacattaacaatatatttcaattagctacgatgacagtggattaaattataaaaaataaatctacaatttcgttagaaccctcttattactgacacacgaggcccacgagtcatacataacctacttgcaatgtgacacttctcatcatttcgcttccatctagtagagtttgtatggcatataagccaggtgtttaagtgacaagagggtctggagagttacagttttatgataattttattttgtattatcgtagctatctaaaatatgtcatttatattgcagcaagttgatagtttaatcattaaatatgtagtaatctgaaattttcccaataaataaataaataaaggggccctgtacctaacattgcacatgtggagatataacataggcaaacccataaaattgcataatagatggatgctcattaaataccctaagaaaaaagaataggtaataactaataatatcctcaagatgatatacatgtccagaagatacattgatagagtatgaagtaaccaatcttcaagatatttagtattgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacactccccctcaatctcaactctccaagattgagattgttacagaacaattgtaattgtctcacaggaagaggctttgtaaatccatcagcaatttgatcttgtgacggaacaaaccgaatttccaacattttctgcgccacctgttctctgacaaaatggtaatccacttctatgtgttttgttctagcatgaaacacaggatttgctgacaaataggtagctccaatattatcacaccataattgagaaggtcctggatgcaacaaaccaatctcttctagcaatttacgaacccacattacctcagcagttgcattagccaaggctttatattcggcttcagtactagagcgtgatacagaagcttgcttcctggcactccaggatatcaaatttgatcccagaaatactgcaaaacctccagtagatctcctgtcatctagacatcctgcccagtctgcatcagagaaagcactaacaatataagaaaaggatttgtcaatctttaatcctagaccaagagtaccttgcagatatctaagtattctctttactgctgcccaatgtacaatagtaggattctgtaagaactgacacactttattaactgagaaagatatgtctggtcttgtaagagttaagtactgtagagccccaacgatactcctgtactgactggcatcatttgcacccaaaaattcaccatcatttaaccacagtttttcagacacacagagaggagtactcacaggcttacaattactcattccagttctcttaataatatcacctgcatacctttcctgtgtcaacagcagacctttctcagttttctttacttcaattcccagaaagtagtgcagatccccaagatctttcagagcaaaatctttctcaagttccttgagtaaaactgtaactgcttgaccagaagagctagcaactataatatcatcaacatatacaagcagaaacataacaagtcccttcttattatagaagaacaaagatgtatcagccttagatgaaacaaaaccaagttcttgtagccttttactcaacctggagtaccaagctctaggtgcctgttttaagccatacagagccttatccaacttacagagatagtgtggcatctttttctcctcgtatcttggtggctgcctcatgtacacatcttcttcaagatagccatgcaagaaggcattctgtacatcaagctgtcgaagactccatccctgtgacacagccagtgacagaacaagtctaatagtagcagccttaactacaggactgaaggtatcctcataagcaataccataacgttgtttaaaaccctttgctactaacctagctttatatctatctatagttccatctgcctttcttttaatcttatagacccacttacaatctattacattcaccccctgctttggtggaactaggtgccaggttttatttctcactaaagcagcaaactcgctatccatagctgacttccaattagtattacttaaagcctcttggagattacctggttctcctgtatgtgtgagtcctgcataccttactgtgccatctgtgtacttctttggtttgtggataccacgctgtgctctggtcactggtcgagtcggctgagcggcaaactgagcactatcatcatcatgcgatgtggaagaagcaggagctgatgcagacgtgtcttgatcctcctgcgacgtgtcttgatcctcctgcgatggcccacgtgaacccggtcccacaatgtctcccgacagagacgaggctgccgcgtgtgacgacgcgattggcgcggttgccgcgtgtggcgcggccgagggactcgctgcgtgtcgcggcgtgaccggttctgcagatcgagatgacgccgagttctcctggtccgcctggttctccgtgccatgcatggtactgtgcgtcagagagtcatgatggccgccggtaggttgcccgccggaactctgcatgaaatcatgcccgtgctgcgcccctgattttgctccattgcctgcactgctgcctgcactattctcaataattggattagcaggattagaatcatcaatcagcggttgatcatgcatctgtacacccccgtgatcaagcagcggaagaagatgcgccgggaggagattgatctcagcccggaggcgagcaccggcgttgggatgaagtttttcaaagggatagatttgctcgtcaaagacaacatcacgggaaatatacacacgccctgtagagatgtctaggcacttaaaacctttgtgaagcgtgctataacccagaaaagcacactgtttagaacggaaagctaatttgcgggcgttgtagggacgcagattcggccagcaggcacagccgaaggtgcgaagcagagaataatctgggggcaggttaaacagacgttgtagaggggtctcaaagtttatcactttggttggggtcctgtttatgaggtaagcagcggtggtgaaggcctcatcccagaatttgagaggcatggaggcatgagctaacaacgagagcccgacctcaacgatgtgacggtgtttgcgctcggcagaaccgttctgctgatgcgcatagggacaggcaacgtagtgttcaatcccaatgcgctgaaagaaggaattaagacgttggtattccccgccccaatccgtctgcacagctttgatttttctattcgtcaagcgttcaacaaggttttgaaaatcctgaaacttggcaaaaacctcagatttgtgtttaaggagatagatccaagtgaatttgctaaagtcatcgatgaaactaacataataaactttattgccaacagagtttatagcaggaccccatacatcggaaaacacaagttgcaaaggttcaatagaaacactactggacttagggtagggtagctgatggctcttgcctttctggcaagcatcacacacaaactcttgactagaatccctaacaactgggagattattttggctaatgacgcgattgacaacagaaaaagaagggtgccctaatctactgtgccaccggaaaagagagggcttgacaacaccaaaagcctgcttgttggagatggtttggagcttgtctgttggcagaggatagaggccggatctacacctgcctcgaaggagtggcatcctcgttacctgatccttaaccaaaaagaagaaaggatgaagttcaacaaatgttttattgtcacgagtaaagcgatgggcagaaacaaggcttttgcatgcatcaggaacatggaggacgtttttcaacgttagatcacgagtaggggtacgaattgcagtatgaccaacatgatcgatattcatacctgcgccactagcattgtggacttgatcattgccggtgtatttgtccttcaccatgagcttctccatctctccagtgatgtggtcggtggcgccgctgtcgatgtaccagttcgtgtcgatgccgtaggagttcactgcagcagtgttggcgttcttctcttcaccggtgaaagagggatcaaacctcttccagcacttggcgacgatgtggccgatcttgccgcagagttggcacgtcggcttgggcttgccgtcattacgaccgcgcccgaagctgccgccacgtccagggttgccgccgccgcgccctctgccatcacgaccgcctccgcctcgtcctcctcgcgacgcggtgttggcagaaggattggccgcgttctggagaagttccagccgcgactcaaagccaaccaggagcgcatagacatcgctcacagagattggaccggtgcgtcccgtgactgacgagaccaccgagttgtagtcgaaatccagcccggcaagaatgtaggagatgagctcctcatcatcaactggttttcctgcagaagccatgtcatccgcaagagatttcatcttaccgacatactccgccatgctccggtttcctttcacggtggtggagagcgccatgcgagtgttgaggatgcgggcgcgagattgagatgcgaagaggctctcaattgcctccatctgccgccgttgtgagtgttgccacctgagtgagcacctcacgcgacagagacgacagcaggtagctgagaacctgctgttcctgcgccttccattgcaccagcgccggatttgccaccttctcggtggtcttgccatcgtccttggtgatgatgatcgttgcagccggtgcctgattgctcccgtcgaggaagccggccatctgtgcgccgcgcagcgcggcaagaacttgcgccttccacagcacgaagttgctcttggtgagcttctcagaaactgtctgcccattgagagcagatgggttggaggaagaagacgccatttgcgtcgggagttgggagattagattgaaagattgattggtggagggtggaaggctctgataccatgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacaagtatgatgataaaccaacgataataatggaaatcgatatacatactctggtacaagagtcaaactgcgccgatcgatgggagtgacgcggtagtaggcgtcaatacggagcgttggggttatacgtacgtgtatactacatatctgcaagcacataattaatcctcatatcttcaaacgcgagcaaagacagtactactcccttcatccgattcgatattcttaattttttggagaacgacataatttttgaagtatatctttaactatattgtctattatgacatatacaataaataaatacaaataagtatttactctaatagtaaagactaagagggactatatatatgttattctagtgctttcagtcgaaattttaaaagtttgaatacaaccttattcaaaacattaagagcaatggaaccggagagagtaatataattagagattatagtgtgtcgtatttgtgggttttacttaattaattaagccggcctgatcagtgtctacctacacactggcatggactcttgcaaagtcagatggatgctaatttgtacttttgtgcaggtatagagcggtcgcggcccagcctcgatcgctcacgtccgcaccgtcgccgcgcgcgcgtgtgacacacgcacgcacgtacgtacgctccgtgcatccgtccctcgccgccctcggtgctatactcccctcgcgttaagggggtgtatatccagggtttaaaattttaacgtgtcacatcagatattatatagaatatcgtatagggtgggcactaataaaaaactaattatagaattggttagtaaaccgtgaaacgaatttattaagcctaattaatctgtcattagcaaatgtttactgtagcaccacattgttaaatcatggagcaattaggcttaaaagattcgtctggccgcaagctgtataattagttatttttttaacctatatttaatacttcggatgtgtttagatctaaagtttggatccaaacttcagtccttttccatcatatcaacctgtcatatacacataacttttcagtcacatcatctccaatttcaaccaaaatccaaactttgcgctgaactaaacacagccttcatgcaagtgttcaaacgttcgagtgacagggtaaaaaattttgaagtgggatctagacaagaccttatttatacaacataaaaacactatatctatacttctttaaaataaaaacatcgatggtacaatctgacaagataggaccaccatccttcatccttcatccagtttcagacccagagatcaattgccacatctagcaacaatatgaatacccaatggataaagcgcgaggagagagttgcagacccagagcagattgcagccggactgacatggatagagattagtagatggtgtggcactttcgtttggtggtaaagtaagccatactgttagttactcctctaaattttttgcagtgtagcaagctaaaagatggagtgaacccataaataaattcaacctatagttatatggctagaaacataaatgtagctactttctctgtgcacgagacactagagatagaactacgtatgcacggaccggctcatcactagaggagtaggtgtcaaccggtttcaagataaatatccctatataataataaacaaataaataaaatgaaagaaaattaaaaaaaaacacttgcaattttgcaaacagatgcgccaggttgcatggacacgtggcatttctcccacgttactcctgcatgcgtgcatgccgccacgtgtccacccctccccgcctttaaaacccgcctccgatcccctctcccccaacaccatctcctcctcgtcatcgtcatcgtcttcctcctcgcgtcgccgatcacctcgccatggtgccgccggcggcgcacgcgccgaagaacctggggctgaggggggtgcggcgccggctgtggggcaggtgggcggcggagatccgcgtgccgcggggccaccgcgcggccgcgaggctgtggatcggcacgttcccgtccccggcggcggcggcgctcgcctacgacgccgcgctctactgcttccacggcggcgcgccgccggggaaccgcgccttcaacttcccgcacgcgccgcgcctccgcatcgacgaccgccgccgccacgcgctcacgccgggccacgtcagggccatcgccgagaggtacgcccacgacgtcggctccgtcctgttccgcccgctccctccgccgccgccgcccgtcgccgccgccgccgtccccgtgttcgccgcacctgcaccgcccatggcgccggcgccggccaaccatgctgccgatccttactactgcaacgagcctgacaccaccacagacgaggacgtcatggctgcggctgaccgcctcctctccatggacatcgaagaggtcgccgctttgatcgccattgttcagcaaggagagtgaccatatctacaacttcttagctagctagttacaccttctatgtagcatgtgtactatgcacttttgtggttgtgttgtgctgtcctaatggtgtaactagccatatcaaggaagacatgcatgatctagagtctagagtactctagccatggaataaattaacttagtctgtacttggtcatgcaccttgtgtatgatccttgtgtaagagaagtgtaataatcggttcttgaaaaggaactgttgttatatatgagatggatgttgtcatgaaatggaaatttgcagttgtttctctttgcaatccggtgtgattttgtagtggaaattaacagaggaagaaaggagaaaaagaggcgcgaaatcgacccatggcgcgaaagtttgaatttgaaaatttttgagtggaatgtttaattttgcggtataactttcttacaattcattctgggggatgacagaagcattctatatgaagatactagctatcatgaacatatgtgaactttggcagggtcgaatgtgaattaatcaattacccttttcatatgctagcttggagtatatatatggggtcaaaatctcatgcatgtaaataagtccaaggattatgaagcacatatataaatgcatgaactgaacatatatgaaaacaaatctagccataatgagttgtaccatcaaagtctatagaatcaagaacttgtgttaaagagcagaagggctttcatgttaaagagcagaagggctttcattagaatgactgatgtcttttttcttcctattttccactctatccggaggaagatagtacaagagatttaggcaagggctgcaagagatttttttaaaacttttttttgaagagattttttaaaactagctagatagaaagtgaaagaaccaaattaataatggaattcccgtttcatcataaacaaaagtaatggactcctctcaccgagcgctcacgtgaacattatagtcataattttgagccgaaaaaccccttcaaaatatgctacgtatagtacaaaaccatatatattgttcagtccgatatttgccatgttttttccttctttttaagcttgtgttaagggaggggactcactcgcgtggtgtacgtgtgtctttgatgtctctgtgtaatcatacttgtaagttcatgtatttcacattttgtttgaaaaacatatatagtgttaacaagtttcaagcagagttgcaattaaagttaccgtttcttttttactagttgagacatgtccaagattgatgcaactacagatgtgggtgaggtcaggaaatgatggcatctacctatcctgaagatgtcatgcacaaataaataagtactctactgatgagtctactcatcaattgcaagcagttttggtttatgctaattttcaaacacatcaatcattcagctatatctctcttttgtactcgtgtgcacgtcattctagctttggggccttggacaccacaccgtgcatgctggtagcgggtagcctcgaatcgaacggcaataatatccctctgtatcattttgtaataataatatttatataatttgtatatgtacttccatcagcaatccgttgtagtctagctggttaggatactcggctctcacccgagagacccgggttcgagtcccggcaacggaatttctttttggtttcataattgttgaaagattatttgttaacttttttgtggttttttttatctccgatgtatgatcaatgaatccaaaattcttgaaagattattggttttcagattcagatgtttgttacttcaccttttcatctcttctccgatgtatgatcatgtagtgcgatcaaaaaattgttgaaagattattcgttttcagatgcttgttacttcaccttttcatttctctctctgtgatatatgatcacgcaagctgaaattcctaaaagattattcattttcagatctttgttacttcaccaaaagttctcagtgcaatgtcccttttcctaattcttgagttcgtctttttttacgagaactagtgctgaagaaaacagagattgtaagctgtgcagtttgatgcctgagtttcactgaagcagtcataatggaactatattacaaactgcaatttttagttacatcggcaaccaatttttctccaaaccatccaacatattttctcagaattctttcgtctcgctaaaaatctctgaattcgatgaagccatccgactatgaagcatcgatttcagcagtttctaatgaggaaatttcaggctgctgctgctgaagctgaacccacgaatggtagtctctcagcagctgctcccccagcaagggcacgagcctgtccaggaggccttgcatcagcctgccaaatgttcagttctaatgttaaaccaaaatgaaactggtaatactgaacagtgattcagtttcagtgtaaaagatgtgcttaaacatcttgatggggtgattggattggaatttagttctcatcagcatctggtgagcacttgtgtgtaatttctttgagatattttgccttttttttttactactgaactttcagaaacttcagtgattaatgtagggccttacaggttgcctggtgtctccactgctgacaatggaagcatgctgaatggcttcgtgtaaacctgtaatccacatatgaagaacttcagtgtacgttaaaaaaaaatcagatcatctcttagttccgtagaatcagtaattcagtgagcaaaacggttgaggtgctctgttcatccagatgctgtatcttctcatgtaatatacctccagagtgacctccaaattgacatcaatgtccaagcatggttcctcaccatcgtctttccaagttatatggttgctcataaaagctgcaaacatcaaacctctaaatcagacacacattttattttgttgccccggaaaggaagttcagagttcagagttcagactaagcagtaatgattcgcatggttacaatggttagcaaaacagatgattgacaacgatgaattgatgaccaatctactaattgcacagataaatcagatgtctccactcaaaactgcaaagaattttcaagaactgcgagccaatcagctaaccgaagaacctgaatttttttacctgaaaagagctcattctgctgctcaactgagcctgaaccctcaaactgccaccaacaaaacgatcaaatcaaaccaagattaaccgtagaatcgatcaattgagcaagtgattgagacatcatgcagagcaattcgcttaattcagtagtaccctgcaggagagcatctcgacggtgcagtcgtggcatgtcggggcgacgcggaggtcgaggacgggggcgacctggaacccgaggaagccgatgctctgcagcgtgcaccggaacgtgttcgcccccggcgcctagtccaccgacgcgaagctctgcagcgccctcgtgttcagcagcgactccacgccggcgggctgacgcaggaactcgccgatgcccccaacgccgccgccctccaccaccacgatcctctcccgccgcctcgccgacagccgcgcccgcctgcccctcgccctcgccgacagcgattggccgtcctcatcgccttcggcttcggcgtgcgcattgccgctcgccgccgcggctcgccatggccggcggcgaccggctgcaacggcggcgacgcttgagattcggaagaggcagcaaggtttggcagccacgagcctcattccatcgtccactcagctgagctcgagctcgcgcatggagtgatgcgaggttggagttggagaggagcagcggcgacggcgagccactgatcagatggcttatcgtgttcgcggtttggccatctctctctgtgcacaagtggagctcgatttgtggtcggctgcgtcgcgttcttgctgtcgcggtcatcgtcttcaacctgttcaccagttcaatctttagttttcgacatttttttcggagggtgcaatatatatcgaatctttagtcttcaacctgttcaccagttcaatctttagttttcgaattttggaaattttgataaattttgttaaatttgaacaaattattaccaaattttaaaaatatttttttggccgaaataatattgtatcgcggatccaatagaaccgaaattttagaaatttcgttccgaaaatttgaaccctgcttaccaccacggattcaccacttccaacctaccaacgccactaccccaactcacacataaaaccacttgtgttttcttatctaaggatgaaaaaggtccgaaaatatggaaaccactttcatagttatatttctttcggaacggaatcgaaaacagtaaagaataaaatgaaaacggtatcgaaaaatattggaaaaaccggaaacgacgtgttggaaaacgataataaatatcaaaaacattgaacggcgaaatcacacatttaactttacatagctatataaaatataataaattcaagattatacaatgtaaattataattgtctctttttttagccatgcacttgatttgggtatggagttgatgggtatcagtcaaataaaaaaaaatgggtcatagatgttgacgtatttacaaatatagggtaatagatggtaattttcatacaattatggtataaaaattcggaaacactcgatataacaataaaatagttttcatttgcatttctatatttttctactatttctatttttaattttgttggcaacaattttcacatagctcagccagtcaaaatcgagaacaagtgtcggtcagtcaggaatttctacgattattttcacccctagtcttatcttctctctcctttcctctttaccatcaaactattctaaattttaattggaacttttaaccatactaattggagtaaaatgctatcctaccaaaatttcaaaagttttctcaatactatcaaaatttaaaaaggcatcaaactaaacacatagtaaaaaactatcaaaattcggtaacactgaatcttgccaaaatttggcaatgttcttgaactgagagcgtattacatcaggccatcaatattcgattctagccacaatcctagccgccggtttccagcccagaattaatttcatttaatttgggcaaaaccctggcttaattctagacacaaacaggctctggtctcttggacccaaattcaacttggataattccgacacaaactctatcgatcgaacgtactcacgtgtacatattccgaggcgatcgatcgatctccacgcgcgacacgacgcgacttgcatacgcagttacgcacgcatgcaggcgagccacctcgccggagattcagcccgttcgacaaccctaccgccggcgagcggcggcgtacgtgcgccggccatgtcgatgtcgaacttcgcgaagatggggtacagcatctgcgggagcttcgcggccggcatctacgtcggcgttaaactgcgcgtgaggcagcaagcggtggagcgctcggaggggaagaagtacatcagcaacatcgagcaaaatctccagagcctcaagaatctgtatgagcgcgtcgagtagccgccgccaccgttcgtcgtcgagacaactgatccggccgccgccgcagctgaggagactcgccggagcaggagagatgccggcgagcattagacgtcatgagaagttcagacatgcatgcaccccgagatgatatatgctataataatattagcaacagatttacacggctgattttcagtctatttaatgattaatcatatatatttgtcccaatttcaatcggcttaattcattcatgatgtgtttttaaatggatgttttttttatgtgttcgattgattgtgttgtttgttacacaccgtacatgcatgatcacattaaagtatgagaatttttactgtacatgcaatttaagccattgatttcgtttgatccaacgggtgagaaagagttgtacctagtagtactgtccacgtgattttacatagcatagagaggtgctaaagaagtaagggtagttaagtaatttcacgtgtatcttcttcatcttcctcctgtcttttctctctccaaaagatgctgcatgcctgcatcgatcgatggctctcaccagggatggataggctagccggagtggaggtggagggggccgacgagcctccgtgcatcacttcccccaagctcgctggtgacatacgcctaccgcggcccttcccctaatctcgctgccggattcgagcacataggcgaccgacgtaggtcctcgtcgcctccgccgccgcgtagcagcctccgatgcaggcgccgccgttcaacaccaccggcgccgaccacccctcctgctcctcgttacctcgccaccatgcagacaccgccggcacccaacgcgccgccgtccaacaccccgccgccgacgcccccggcaccaccggcgccgaccacccctcgtcccgctcccaccacgcccttgctcttggtttggacttgctcagttgctcttggagtcttcgttcacacagtcactcagtcaaagagaaggagcatcacgagctgcttagcgtgagattttcaatcttaccctccgtgaatgaatggccggatttaaattggtacctcaaggtaccggtacctcgaggtacaatatgctggactggagcaatgctcttaaagtatacatgcaagcatggatggaagggcgaagacccaaagacctcctcgtacccctagtctacgcaatttctaagaagaggagagagtccctacaccaaggaaaggagaataatgtctgggtcggagatttagccttggagacaaacccacatatcacagtggccctcgtggagcagcttgtggcctttatggaccgcagtccgtggtgtgtagctagacgaggaagagtctgaccaaatctcatggaagttcacaccccatgactagtacttggcttcgtcggcctataaacacaatgcgttggcgtgctcgacacaacctttgattcattgatctggagggtctgggcgccaggaaaatgcaaactacacgcctggttcatcatcctgaataaagtctggacctctgaccgacttgcgaccaggggatgatagaacaacggacggtgcccactttgtcggggagaggacgaaacggccttgcacctcgtcactaggtgcagatacactaaaaggacggattgggtggccaatcatcagcttgagccttgacactgggagactactcagtcggtcaatgaatggtgggaagtgccagccactttggctggcattcccaagaagggatcccgtaccatgatcctcctcatcgtttgggaaatatgaaaggaatgaaaccagcggatctatgagtacaaggaggccacaacttcgtatcttctcgcgagaataaaggaagaagtcgacatgtggggtttggcgggcgctaagtgccttagtgagcttgttccgcaccttgtatagtgtacagtttttcttggcttttgccttttctttgctcttaggggttgcatttttctcccactttatttaatgaaaaaagcacactctcgtgctggatcgattaaaaataatggagtcgtctttatctgtaactagttgaaaccccgcgcgttgtggcgggcacattagaaaggatgaatatgcatgtaagtatgaataaacatgaataagtgagatataagtgagtagttctgctacctaaccaaacaggaatatagtttagtatagtatacaatttcaaaagtaagcagttctgctatctgatcaattaaagatgatatttgcatcatcaattgctaaaagtgccaagcacaaaaaactcatttcgagtccagggagttggaaatttatagtcacaatgacaacaccattcagatttactggaaacattgcaagcagaatattgttaggaacaccaagatcttcaccagaggataaatataagttgagtgaaacacatgcaaatataaaattaagttttgtttatttgattacagcaaactgtaggtaggtagtaatactatgagctggaaacagtaggaaactgtaaggtctaaatctcattgtttgtgacattttctccatcgagaatgatatgcatgtgaggaagtttatttttcatgtaattcacaacatgagcttgagttggctgcagcttggagaggtcgtcggtggatgatttcccttggagagtgatataaatagctattgatttggatgcagtaatcttggaaactgcttgcaggtagttggtgtggatgagttgcgcctcatggttcctgaagaagagtaatgcgtttgatgatgtatagataggcatatacaatgtacagagcactgaaatgcatgaagcatgttaaatataaaatataagcttgaaaactatgtaattaggaagctatagctgaacctggatagtgagagctaacctatttttttctggttgttggtccatctgtgttggcaatggacgttgtgtttgcagaagaaattttgtgaaggaaggactgtggtatgagaaattgagcagtgcacatgttgttgtggtgttgtgggtgattcttatagtatttcagtggtgataataaggatactaattttgttttctcatttattgcagaatcagatatgattaagaatcatatcttgagtcttttattattgaggataaaatatggaatagatataaatgccatatttcagatttggttggttttgccagtaaacttgcaagtaatggttgcaaagataagttagcaatgatggtgatagatttggtgcaggtttaaatttcttaaggaaatcgttagcagtgatggtgacagatttggtgcaggtctaatttttttaagaaaatctatatatgttgctgataaaaggccatgttgtaggagaattgtgaaggatttgaagagttgtacctgttccttgtgacccgatggctgttgatcagctatctttggctgctgcagctggttttcctctccattggtggaggtttccgttctgaatttagcagtcaaattagtagcaaaacatacatacatacatacatatatatatgcacgcgcgcgacacacacatatatatgtttataggctgaaacttaaggtgtgcacgtacacttttttatggcacttagaattttgtcctggagaaaattctgttgacggttgtttttccttgctgagatctacttgttggggatgataaagttgatttgttgcaacctgaatagtgtttgcaattgctgggctgatgcatatatgaaaggaatttagttgaagaatagtttgtatattctggaaaaagaacttgtatcagtgcagtaccttggttgatcaatgtgtaactccttttcaaattgaagagctctctttgctgaaggtataatttggtttactgtattgttgtctagagttgtttctggaggttgtagggatggtggcgtagtgggatgttggtcttctttgctgctattagttgtagtcataaatatagaaatgttaagcagaatataataagtaaaaaaggcatatgttggttaacctgcaatgttccatggtggttagcccttcatctgttgcaagttgtttggtggctgattcctgaaaaaagttatttttagattatagatggttggtagaagatatggtaaggacaaacatttgtatacctttgctacctttgtattttccagagtaggtagtatcaaacttgtattttcattttcaacgggataactcttcttgaggacataattgatagtgaagtgtgaagagtactttgtattcatggcaatgtgaaacaatcttgttttcccaatggctatatcaagagctatggcatgttctgttgcatcaattttcaagttctgggtagcttgagtagcatttacctcaaccaaatcctcagccacattgtagaatgctactgcgtccaaagttcctgattcatctttaattgttaaaggaagtttgtacctgaaagtttgtttgagtatattagatttgtttatagaaatgtaagacgaattaattaataagaaaaattagtattatagatatgtcacatacattggttttggcatggaatgctgacattgacatcttggagtgtcggagttgctattgtatgatgcagtacatgatttgcatattttgtagtaccaatttgtatatggtactatcgctgatacctttgcaatgcaactgtatgaattccctccctagtgtgtaagaaatattgaaatgattatttaattagattagcaacttatttagtgatgtagtgtgaatgaggtacctcgaaagcagaaatgggcagtcttgatatttcttcaagtttgtatagcttaccagccgcttgaagtggagttaaatgttcaactcgtggcatttgttgttggagagttggaatatcccattggtagcttgaaggaagattgatgcatttttgaagcaaatataaattaaaatcagtatgacaataagctatataagttacctgctttgatattcagcaatctctgttatatcggagtcaaaatatatttgtgttgctgaacttgatgtagcctctgttttgccttttaaaattgtagcacataagtgagtagtgttgtttatgagagggggtattaaaaagttatttgagggactgacctaaataagtccctgctgtaagtccagcaagtatagctactactattttgtggtctgtagatttctgtagaacaaaagcttcatcaaatgaccctccatattcaccccagaggactatttcttgttcttgttcactacaaattggtgaaacaaaaggtataaactactgtgtcatatacatttggaacataaaaatataatgcatatgtgatacatactctttgctacggattttgagctttctgtttttcttggatgatgttttgccagcataatcatatggcccaacatggctgataactcctatcagatctagaggcaaaatgttcgagattagttgtataataattaaataaaagaagatagaaaatgcaagtattacctatcaatggttttgatattccgcttttagatggtatctgatcaaatgggcagaattcaaaaccatagtttgggatggatgaacctcttgattctaggtgatgaacctttgtgctggacttaaactgcaacatgtatttttggtggtggtaaatatattttttgtttttaatgtcaacagtattgacatcaacaaacatgtagacacaacctagagttagtgatggacgaaattcattttcaagtttctttggaatagtaaactgcaccatagtgccctgcaagattagaactggtataagtctaaaactgcatcgttttatcagtaatatttagattggaagttaagcataggataaatcattttttggtgtaggatagtatacctcttcatcaagaattaccccatcgatgttgaatattgttggtgtactggctgaggccatgtttttagcatcccatagtctaataagtcgtccgaaaactttgaggttttgctgtcccaaatttatctgtttgagttttgttgctgatcccatctatggaaatgttcctgaaataagaggtctaaggttagctagtagacaatatcagaaaacatacattgcatataagagataatttgtttacaaaataccttggtaactaattcatatcattgttgaaacggtgaaaaatctcatgatatactacattttgcgtgcaatgttcatttgatgaactattgctgtttataagtatccgcaagccttttggagatgttactcgtgataacgcaacatataattgtccatgagaaaaaactggagatggcaagtatgcaccaactttttgaagtgtttgaccttggcttttgttaattgtcatcgcatatgacaaacgtattggaaattgacgtctttttagcttgaatggccacttagattgggctgatgtcgttataatacgcggtatgtatgcttttgaacctttggcttttccagtcattatttccccttcaatgatgcgggttgtgagctgtgtaacaataagtctagtcccattacagagacctctagaaggatcaaggttacgcaaaagcattatagaaacaccaattttgagatgcaaaacatggtctggaagtccattcaaagatattgtgttgcggaattctgttgggtatagagcctctagagttgaatggtttgcacagctatcatcaatagtatctgagctataatatgaaatttcagcagctgttacttgagcaatgattttgttgtttatttctgaaacaaccttatttgttggtgataaaattgcacgatcacaaaaatatgttgtaatattgcttggttcatatcctaagtcatacacaaaggaaatcaagctatcaagatttctggaatctgagggcaacaaaagagattggggtatctctatgaaagtaccattggtttcattttctattgaaatatgaggctctgtaccatttcctactcttaaaacccaatctgcaaatacccgtagttcttctttatcggatggtgaaaggttttgtgagctaagtctcatattttcagtcagttgaagaactacacattgatgccataagtatgaattaacaatagaagctcgcagaatttggtgccttgttgcattctgaataacaggaagtgtttgccgaaaatctccaccaaatgcaacagttattccaccaaattgcctatgctgtgcattaggtcgaatgtccgataatatatatctaagtgtgtgatctaatgcttcaaaacaatacttgtgattcacaggtgcttcatcccaaacaataagagatgtttgttgaataagttctgctaagtgtgtgttcttctttatactgcacatagaattctcacgtatgtccaaagggattttgaagcgggaatgaggtgttctacctcctggaagtaggagggctgcaattcctgattatgcaacagctaatgcaattttcccttgagttctcacaaagtttaataaagttgtccataagaaagtttttccagttcctccatgtccatacacaaagaatgttcttccctcattatttatgactgagttagaaatagaattgaatatttccttctggtttgtattcagactattgatgtcattagcagatgtagatgcaatgctggtaatatcatagctgagttcatctagtaataatctattatctgcagatgcactaccaatatcatctggaagtggcaaattaaagtgtgataaagaatatccagcatttctcaataatttatccaattcaaataatagggcattgccaacaaaagagtctgcaaatgaactattactttgtgatagattttgatttgttctgtatctaaaatcttcactcatatgctgggcatgttctgtaaaaagcctttgtggatttgtcacctcacaaaacagtaagattgttacaaataactgacgtaactgataaggtaaggcccagtgcactgcatcattgagagcatgggaccactcttggtcatcaccaaggagacctagagcttcacatgcagctcgaaatgttggatgttgctgtccagatatatttctgatttcagagaaggtctttggtcctttaactatatggagtaacatcctcaaataatacttctcccctttggttggatcaacatgagctatacgtccaatcttattgtaacaaccacgacgtatatcccaatatttttcacttgcatgccatgtaaagtattcagggaattcaatatatgtatgctctctagcttgaggaaattgactattagcttctaaccatgcagtaagtttggatttctgatttcctgggttttcaatgacttcttctaggtcatcatcctctgtgtacacaacattattctctaaagggaggtggaccggaaggcgttcaactgatgggtctgtatggtgtatatcaaactgaagtaaacgccaagcaacatcatttggggttacacatcgacattcaagatagttgtctatttcatttatagtttcatttgctgaattacgacgaataccagctctagaacaatcatagacttttgtaacgtacttaaaaagatacttatgcataccatcatgattaacactttccaaatttatgtgatcttggtacttaaccaccaaatcaacattatgaggaacaatgactctgttgtcaatgtcaaccccattttttgtaactatttgattgtttggtcgtgcgtattgggtaaaaccattttgcaatatataagtgtgttcacagaattcctttggataaaatttggagcaccttccttcagacatgcatggtgaataggaaattccaggaccgcaaggcccatggatcataaaagaagtaacagcttcaaatcctattggatcaagtgtaggatttggtagttgagctgaaatacgtaggtcaaccttttcagcatctagaggttcttcttttgaaagccaaatgattatatggacatgtggtagtccacgcttttgaaattctacagtgtagacaactgtacaaaagggttaactattatatggatttgatgaacaatatatgtatctaagaattttgattgaaagttgttttggaaattacctgcatgtatgggaccaaaaaaaatatttttttaatgtcatccattaacatattcagcttcattttgaacacacggtcaacgatatctggacgatctgaaggttgttgtccaggtgctagagcttgtagaatttttggccaagatgcatttgatgtgaatgtgacaaaaagatctgggcaaccatacttcctacaaatagcaatgcagtcttgatagttttgatatagataccgagggcttccagtatgagaggctggtaagataacccgttggccagccgaagaaccagttgtaatgcctctagacacagagctggctaaagaattgaatggtgccaatctatatttgtgttgaaaactgggcaacctatagtgttgtatgcgctcaccttcaacacaacaatagccatcaaccaaataagattgggttaacctcccacaacgtaatggagtgttgaattggcccgctctatcatgcattatataagcaaagaattcaaccattgttgctttgttacgccgcaaggcagatgaacttgctgtttggttatacatgttggattcatggaaaccatcttcaccatatgggaataaaataggatattgcatggccataaattttcggtgtttttcatctatacgctgcaattgtgatgaatggtgttgtattattatatcccgaccaatatcagtcaccccaatatcccaacaactaatcctacaacctctgctgcaactggtgcactgtatatatctccatgtgcatctgtcgagccaaatagtcggatcttgtaatgatcagattcattttcacttaatctttctcttgctgttcggaataacttcacaatgggattgtgtgtatcgaacatttctattagagagcgaacaatttcttcattggcatggaaggagtcgcgagaagaagaagcaatgttgattatgttagagatttcattttctgtatcgaagatgtatagctgagcatattctggccgacgaccttgtgaaggtattaaagagcctactctgtggcagatctatccactaattttgaagacatatggtccatggccgtcgttgatggattcaatgattttagcccccattgaagtcatagcaaacatggaattgtatcgatgaatatgctgcaagaaatgatttgaaagggagctcgcagaagttaacaaattcaatatgggttctggaggtggattacaaattcaatatggctgccaagattaagtggagcatagattgttcctaacaaagtatatgaatggaagatggcagatactgttatatataagatgtaaggttggcgtatgtcaaattttacgtataaaggatatgataacatacggtgatggcgaaatacttggtttgatgtagacacagatgaagaattattactctcagctgactgtgaatgagaggatattccaataattcgttgttcattagccaatggaggagtagatgcagatgaagagcctatttcagttatgttcaactctcgatgcaaagaccgttgttctgaagataatgctatatgttgtgaagggaatgtgggtacataattagataggctataaccgggtaactaaggtaggtaggcaacgataaactttacattactaaaaaaaaattgaaggtgtaaattggggaaccaacctctacctctatgggcatccaatatgagtttacgttttcgtcgtgattcagcagcagtagcatgatcagggtgaggtaccaaaatatgtgccagtggacgtcttgaccggcgacgtcctactggaaaacgtgaagtactttgcccagcatccatgggttgaaccctttgttttttagttttaatcaacaaagcatctgatcatatatttacaaatatcggatgtaagtttattatatttgaaaatgtaggagtatacgcataagatgtaactggaatatgaaatcagaaaagagatgtacaaaaaaatatgaaaaatataggatgagttgaacaacacacataccgagcaaggttatctgcttttatgacaattgtcaggcttctcctcaagtgatgaaacaaatgttcttgtatctattaataaaggataggtgaaagaagtataagctgcaagcaccatttttttaaagaaactaaaacagtactcaatgcataggtctccaacatgtgcaaaaaccacaatgtatgctcgaatataatataacctggcaaaattcatgtgaaattcacacatactgaactgaatcaccaaaccaaccaaaagctttcattttatcacactttttgcgacaaaaatgcatcataacatgaactatggatttgcatagtttgaaaaacagtataagctgcaggttctatttttttaagaaactaaaacagtacccagtgcataggtctcctgcatgtgcaaaatccacaatgtatgctcaaatattgttctgagaaaaatcatgtgaaatttacacatactgaactgactcactaaagcatccaaaagctttcattttaacaccttttttgtgacaaaaacgcatcataacatgaactatggatgtgcatagtttcaaaaattttgataacatttaacgtatgttttttaaatgattttttttcacattttaacaggaaacatgaatagcatggggtgagctcaacagaagacataccgagcaggttagtagcttctcgctatgtcaggacatctatgtagcaatcctctggctcctcaccaactgctcaaatacattaaagttataggacatataagtatccactgcaaatatcagtttattttttcttaaaaaactggaacaacaatcagtgttgaaatcataatgtttgctcaaatagaatatggagaaaattgatgtcaaattcaggcttatcaaatagaataaattctcacacttttttttcagaaactaaaatcacataggacatataagtatccactgcaaatatcagtttatttttcttaaataactggaacaacaatcagtgcataggatagggattatttctttaggtgtagagaatccaatttacaaagctttcatagtgatcttgcctggttgaaatcataatgtttgctcaaatagaatatggacaaaattgatgtcaaattcaggcttatcaaatagaataaattcacacattttttttcagaaattaaaatcagtactcagggcaaagaaccaactcaattcagacatatttttttcagaaactaaaatcagtacttagggcaaagaagtaagaaccaactcaattcagacatacaaaattagtaacgaagcctacatacaatgatctgacaaagtttgatccacaactaacctatcttgccgtgatcgcaatcatgtccgaattggagaatatgcttgcaggatgaagcgatgatgtcgagggaggtatggatctgaggcttgcggatggatggatgatgtctgacggagaggcacaggtttgaggagacgtctggtagcactggggattgcaagaggattatcaaaaggtttggaagaggcttacgaagagaaattgcaagaggcacataaatcgtattaaccatcgtgcctccagtaccataatgattttggccgtttctaatgtaaatgcacatcattaagggcggggaatgggaagaagcatggtgattaccgtttctgctagccaagaagatggggagggggcggttgatttcaccatggatggtgccagggttccagatgcttcttcccatcggatggatggcgctagggtttccgagtccagacgcttctccccatcgccgtatcgctggttgccgagtccagacgcttctcccccatcgccgcatcgctacacagctccccatcactacctcctactgcgaccgagatgagcgcggtccccaccaccacctgcgcgccatcgccgcctcctgcgaccgagcgccctgtccccaccgccacctgcgcgcgatcgcgacgcggtgggcgagcgctagggtccgtcgcactacgccgctgctgctctgctcaggaagtcaggaggagatgagacataccgaaccctaaaatctctcattggactgacttgggcctcctgggcctcacgacttgggcctcctgggctgcagtatatgtgttgtgttcgaccccgaggcagattgcatccaacggtgcagatgcaatctaatctaccgatctaagggctataaattaatgatgacgttgatcattgaggtttaagctctaggatcttaattgcccgtagtgggggataactttataggaaaaagggatactaaaaaaaaaagctaaaaaaaagcgcgctagctgtgcagcccagcagcagctaggccttgggcccttggcccacgcgtgcagcaacgcagcaagcaagcgagcagtagcggcagctgtagctagcttagtaccacctcggctagctagctccatctacactagcttaaataggaaatgttgccggtgactgtaacatatcgattccagaatttatgcagcgtgttacagtgttaggtgactaagagtatgttggaaaactctgttcattttttaagggtatgttgtcttatttctgcatgtctcttagaagtcaaaatttataaatatttagtaacatagatcaatttgtgatatgtcactatagaaatatgcatgttcaaattcaacttactttgatctatcttactttttttatggcattttaaatgccatgcacgaatgttcccttgaggaatttttttaaaaaaatccacttcctgtttggtttgctaccaatttttattcacgtagttcaatctctatactaacaatttgataacgcaaaaattgagtccaaatcaaacaagttaatttcgcgcatctggatcaacttggatcccgacagaaactcctaaactccattaatattgttgaagtaatccggttttgctggggatcatggcgtgtgtatcgctccgacgcatgctgcgttcatgcgggagctctttccagttttttagtgagtgcgtgcgcttcgtgtgttctccgatcgtgggatggcgcggtctagtcaggaggcatggcgaagtggcgggagtttaggaacgcatggcaacagcttcggtcgtgggatggcgcgatcaagtaggaagttgtgggcatgtaatttactatttaaagtttcctaatacaacagaaaacgctgccaagtttcttctcgctcgttctgttttgatcggctaaacttgcggtagttcgctaacaatcttcatattatatatgcagcctgcctccatcacgaccacgacgtactcacaacctcgccggagatccaagcagcccgttcgataataatcctatcggcggcggcggcgatcaccgaccggccaagcagcatatataccttcggtttcgtaatttttctctcttgttcgttctccatggcggcgaatttcgtctgcttcttcgccggcttgtgcatcggcatatcgatccaggcgaacgacgaagagcagcagcggcggcggcgcctcgtcgagctggagcggcgcggcgaggagcgggagaagcaggtcgccgagatggtgagccgggaggaggatcgcgagcgggagcggaagaagaacctggacaagctcgaccagatcgtccagatcctcaggaatctgtgaccggatagccgccggccgccgtggagacgaggctcgccggagctaggagagatgacaataacagtgttattactactgtactagattattactccctccgtcccacagtataaggaattttgagtttttgcttgcaacgtttgaccactcgtcttagttatattttttttgtaaatataaaaaacgaaaagttgtgcttaaagtactgtagataataaagtaagttataaataaaataaataataatttcaaaaaattttgaataagacgagtgatcaaacgttgctggctttctctgtaatcatttgtcccatatttttcgcttttctttgtgatcacttgtagtaccaaatttaggctttgttctaatgtgcaagtcatttataagcttttcgccaaccagtgcgtaaaacgagagaatcaatcacaccgtttagtagtttaaaatatgtgctaatgaaaaccgaggaacatgacgtttgaagtttcagaaaagaacgctgcctttaacatgaaagttccaattcttacattccttattgatgtttgttgaaaatatatcctacagaactgcatgatttattagccccctacattcaaaaatataaggaggattttgattgtctagttctatgctttgacccttggtaataaaataatatataggttttgctatacaaaaatatatttgttggattcatgttcgaaactcctatttaatgactatgatttcgtaacagtaagaaatttacggtgaaagcttgtctttggagtaaatattaagaaatccagacctccattgctttgttttccacaaaaattctctgaggttcctacgtttgaatcgtgcctaatagcctacacgagagagagctgtgtgcgagtaaaattaagctgatctccatgaggctccagtatttacaagcttgatgtatgcatccttgaagtcggcaaaaaatttagcttggtcctgtgcatataaattgatccatctgcaagtagtttggcatatgcccaatgtcaatggcctgaccaaacatgtgagcatgaaggaaccttgcaaatatatctatttgtcctataaatttgtgacttaaaacctaaagcctaggtcctgactgaaagaattgaagatagagtaggattagtgcatggagtttggaagcttatgattatccctagtacttcttcagagcttgtaacaagtaagcgacattatttagcatatctagttcaagaaaaaaaataccttaagcattcatcatcttcagtgagtgcccaatccgttcgcagtcctaccattgccggcatgccagcttcatagaagaacacaacacattgtattaaggtgatttacaaataatgccaagtcgattgtacattgtacaaggatgatttacaaaggcatgagctaagttgagattcagttatggcttatggattcatgatgacagtatttaaagggcatgatggaaaaaatgaatggacttacatgaagatggctgtggcttctcaaggagtactttaaaataggagttgtcgaaaatatttggattcccgaatcctttacctccaattgtgtgtgctccagataacacaaccatctcctgtgtcctgccaagtatcaagtttaacttcagacatggaaggatgctaagttttgaggaacattttgtagaagcctagaggggaaatcatgtgcagatacgtatcatgtacagatacataatttttaaccacgcattagtaaattttcataaataggcaatgggaattgaattcacaagatgtttgtgtaagtagagaaaaggaggactcacgaaaagccctttttgctgaataatgttttcagcgcagtggcatccaatgtttcttcaggaagtttaccagcaggatcagcagtactacagagtcaaatgcattatttcataagaatatgggtattactttgagaaaatatggatacctacatgttctttaaaaaatatggatgcatactaaatagaagcactgcctggaaatgaacagcctaaaattttgccaacattgcaagggaactgttaaatgaacaaaccactgtgatgttgcacctggaatctaatcgacctagtcttactggaatttctggccctccacatagcgcaactgactcagcaccagccacggcaatcaaatccgcccatgatactgttagcaaagtaacggtatatgtgtgcttgaagatacatcacaaccgaagctcaaaacagaaagaacatataaaaagggtgtaaaccatgtaccttgctgcacaaggtcaattacttctttcgcttttcctaatacctgttcagttataagtcattaaaaacagatatgggaagtcaaaacatgttgttcttcagtaaggatatgttactactatttatgataaaaagcaagaaaaaaaaggaggaaaaaaacctttatggatttatttagcccagtattttcaggtctatcaacttcataaattatagatccattcatgccacctgcaagatattgtcataaatatccatctactgttttacttctcagaattcatctttagataggttgaagtgtagttattcgtagtttgttcttgtttgcaatactctataattctactttatacacattcaatttttgctctaaaactgtatatagaacttcaaccaatgaagacattaaagatcgaacctgatttatcagcaatatcaaaagtccctgcatcatggaaagccaaacgaagcatgccagcagccttgaccttggataaaacattcctcacaccgttttgaataattgaaccatcaattggctcagccctatagagtcaaacataaaaaaacttctctaaaagatgtcatactgccgttttacgagaatgaaactactttgagtaggttattcttatacacaaatagctattgtaggtatactttattgacctgtggttcatttcgacttttgattctaggccatgcttccacaattgaaccaattaaacataaataaaaatactcatagaaatgtaaattaatacggttagcaactcatagctatggaaacttagagcagaataggaatatgattatggttgaatactgcacttacgcactcgctatatgaacatgaggaagtatgaaagggagcagagcaacagaagcaaagtccctccttgtataacaaagagaagatatgggacctgtggtcaccatacacaaagcaaattcagttgggcagaaatatatcagtaggcactggaagcattctctcagttcttgcaatggaaacaactcatacctgaaaagaaatctgcattttgctgctcagagggttctgaacaagcagaatcatcactactgcacctacgaccagcagcagaagctcctatcctcgtcttcccacttcttctaatcctgtatcatcacaattttcacaggtcatgtgccttccatgaacaaatgatggcacggttggtatcaaagcatgagagaagatgcaaacattacctgcaggtgcaacgactgcagctggagaagaagcgggaggaggctgcaatatgggggacattagtgagctccattcccgtccttctggccttgttaactgtcagcaatggctgctactatcctgaactgaaagaggaaaaggacacaactcactagtcactagtcagccagcctatctctacctggctatacatgtgtggttcccaactgatggtccccaagaaagcactttggataagctgtacttcagtggtaaatatctgcccaattgtagttctgaagaatatgcctctgatactccagtgattatttttagaattcataaatgccattaatgtctcttcctatgtggatatctttctttcaccagtaaatactcccatctgttcattaaaccttttatggtaatagagtatgatttgaactgtttgtgccttactaaatttgcaatttcaacacaaatctataaaacaagctaagcaaaaaagaaaaaagaaaagaaaagagcaccaacaattaacacaatttagaaaacaaagtaagccaagatcccaccgttaaactcaattacaagttactgctgatgccaagaaatcatgttcacagaacaagtgagaaaaatcatagtttgttgatgtaaacaggtagtacagaactttctaagcaaactgcaatgaaattatatgcttatttacaacagtcattgcatgtttgaatgtgaattatctgcttcagtgtgtaatatgtattgtcacatataaatgagagaacatagtggacacttacataaataggctacaaatttcgcaaacaaacacaggtggtacttgggagctattaaaagtaccatgtatacgcttttctttgtttgggaagctagctgtctgtgcctcaaatttacagggaattatccgtctatataacacagattgcttaggagtccaaattctttgaggatggattgaacgccacctggtcagcacaatccaagttatctccagctttgtcactaccaacacccatcaggtcgagataatgttggtagtgggatacaatgacgttcatcttatcgatggagccttgaccacagatgagatcgccatacaggatgttcattgtagcaccaaagccaggatacctcttggacaaagtgtcattcttggttggtttccagttgccaacgaatacatcatgggctgatggttgcttcctcttcattggagtcatccacctccagattgctgcttcaaatgctagggtcgcattctgttccaataactctgggtggttcaacagatcctgtttgataccctgaccgataataccatagttgtagttcctgaataccatgtacaagcagatttaattagtcagtaccttaacctaatcagttactaatcaacagctatcaagatagggataggtcagcctaaccagtaaacaggaagagcgcctcgaccataatactcgactccttcaacacaaggatacaattcgttgctgttgtcacaatagctttggcttgggctcaattcatggttgtagcaaagcccccaagccaatggaccaccagttgcgacactatatccacctgtagaaatcacaattccaatactctatcagatgctactagcctagggtttttttattcatctgaagttcacgtgttcggtgaacaacagaacatatcacacagttggaacgaaacttctgaagattgctaccaattgaacaaaccttaggttacaatcttctttacaaatcaagtacatattcaaatcggaccaaagtccactgtgttgtgatattcagaatttcagatgcagaattgcagttgtctacttttaatatggaaatgccaaggatgatacacgatgccaatcaaaactaattaacatgctccacatatagctgcattcggcagcaattaactactagctgagataaaaaattgttacctcccattctacacacggatccagattactttcagatcttaaaagcaacactccgcagagcacctatcctaaagattacagtaggccgcaaatctactaccaattcgtccatttcccccaatctatttctcgatccacgcaacatcaaattggtaaaatcacagtaacgatcagcgagaagaagaagaagaagagcagcacacgtacaggaggtcttggcgccgacgtggccgaggaaggcggcgacctccttcatcccaacctccttccctcccgtggtgccgaacccgcggggctcgaagagcgcggcggcggtgatgaaggcgtggtagtcccagaacccggcggcgtgggcgagcgagcggtcgttgcggtgggcgaagagctcctcgaactggtacgccttgaagtagtcggtgatggtgtcgttgcagcagaaccggctcccgctgcactcccaccccttgtcgcacgccttcgcctcctcgtcgccgctgccgtccttgtgcctcctcccctccgccgccacgagtagcgccaccagcagcagcagcggcagagatgccgccgccgccgccgcacgcgacgtcctcatcgtcgccggcgatgcggatgcggagcgcgtgatcggcggaggaggagcggagaagagagagtgtcggtggtggggtgggttggtgggggcaagctggaagggccgatgtgatatcgctgttcgggggtattttcgtaatttggtgttattgggttgtttcgaacttcagatgggccggtgttctccggctgtctaaaaaggcctcaaggcttaaggcccattttgtgatacggctttcattggagtgaaattgagcaatttcatagaagaagttcattattcatcccccaattatagccccaaattgattcattcaacccaaaaaccagatatggagcatcccaaactattaaaacaagatcaatttatgtccctaagcggtttggtgattttatctaacgtggctgcttacgtcgcatttcattttagaaaaagaataaacaaagctattggtggaccccaacatttcaacaacactcatctctctcctcccttctttctttcactttccattttctgatttcaatggcgacacacattttctttcagacataggatagggcattataagttctgcaccgtttctcttagtacgtgtattcattcatgagagttaagatgtgttattttcgcaacggctattattggaaaaagaaatcaagtgtactatagtattttctattgtttattggtaatccaatgtactaaacaaagagattaagtaaatacaccatatctttttactaatacaaaaagatttatatgttcggcttttggacgtacatctttacatgtaaggataaaaatagtcataaaaattctcgatcgatctagaattgttttcgtatgagtggtaccgtttctgaccattactattttaaacctaaaaaaattggtttttctaagagtgaattacaccttgagccacctttgattaccattgttacaatttggactaggctaaagccaaacttttcactttgggccaggtatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggccggcaatgacagacagttgctgctactttctgaactgacgataagaactaagtcaagtagcagatagccatgctcaagctcatgctcgacctccgctagtgctacatgttatgctgcacgcctgcgctaaatttccacatgtgtcgctcgagcttcaacaagttttgcaacgctcaagctccgccttcgtagtgccgcctgcatttgagctcgaaatcaacttcggcgggtggctaccctatgaagaagggttttgcttcttgccttttcatgcactacacctgatcgagaaagagaccttgagctgtacagagaaaagagagtaagaaagggagttggaggaagaagaagagagtctaaattgaaaccttgtgtaaatatacccggtccaaagtgaaaagtttactttttcactggttcaagttacaacacaggtaagaaaaaatagtccaagatgcaatttactctttttctaatttcgttcggtgtcgcattaatctcgatacttaatattttaattgataaatattatcaattattaaacagataagcgtcgttttcgaagatacgttaccgattccaaatgttctcatccttattcttatcgacttttgtttttctccatttgaccaaagcgttttgagacggagggctttgttgttcagccagcaaataggggagtgtttccagtgtttttccaccgaagaaaggcgaaaaaaaaaagagaaggcagcgaagatttctctagaaagagagacgattgtcccatatccaccgatgccggattagatccggtggactccaccgatccacgggccgggggcccattccaacttgcccagccactggtgggcccaccggccacctcatttccctcaccccccaaccaaaaagataaaaaataaacaaaaagtttaattcgccgccacgcgctttgccggaaagccccaaaagcccgaccaccactgccgccgcgccgcctcctcctcctccgcctccgccgccgccgccgcccgccggccatctccgtcgatccaccgtccggcgagcagacagcagcccggcagatctgcccccaccacgggatcgaatcggcggggggaaccgaatcggggagcgcgggaggcggggagcttagtttgagctcggtcggcggcggcggcggcggccatggtgaaggagacggggtactacgacgtgctaggggtgagcccgaccgccaccgagtccgagatcaagaaggcgtattacatgaaggtaagtaggattcgtcgacttgtcgtcgtcgtcgtcgtcgcttgattttggtctgatttgtgtttgctggtggtggcgcaggcgcggcaggtccatccggataagaaccccaatgacccgaaagccgcggagaatttccaggtaggtgttccgccattgttctactactggcaacttatacccttataatcaactcggtgcaagcagctcacagggtagtgtagaaccctcgattgaatcagattagatgcttatttagctggacagctgatgcgcaaagtccgagatgttggacagattagatgcttattagctggatagctgatgcgcaaagtcactatcccagcacgctgttctctgcggattggtttcgtaagcagtcgtgtttttgtttgtttggctagttaatcagtaatcactttaagtttaaggttatacagctaaatgcttattagtaaccaccattccaccagtctctattactctgaaaacataaaatgtgtctttgccttttttacgtttgagatttggttaatggtgattagctatatatgctaaactaagtgtttgcctatctaaactgctctgtgaaactcaacatcaggaagtttaatatctaacatttggaatcagaattatattgctgagatatatagtaagttctagttaggccattcaacttaactatgcagatcgaccattccacaaatgaaatctgtgtaataacatgccagttaatgatcgcgaggttatgatatgatatctctaatctacttaaaaaggcagtcgtccgtccgcactcccctccctccaccacgcacagtgagagaaaaagaggcatgcagcgcatgccccacttgccccacttgctccacatcctcgcctccccaaaaaactggatttatttaacagctgacagaaaacatgtaaaaacaattaaaaaaattggctataaacagaaacagggcacaattaatattttataggtccgttgcaacacacgggcatttttactagtattagtaacatatcacattcttctctcctccctaactccaaagcagcaatgaatatatttgaagctgttactgcatagccattgtagtattatatggcattggctttattagaaagggtgctttttttttttttgcatattttcctattccgtactattgttacttataggaattctcattgcaggcactaggagaggcataccaagttcttagtgaccctacgcagcgccaagcttatgacgcacatgggaaatctggcatctcaacgtatgtgctgattttctcaaagaaattatatgatgctcttgcaaaatattgaaaagctttataggattttcatggttattaatttgccatttgtggcaaagcaacgccagtactatagttgaacttctttttttttcttccattcgagagatgcagatttttgtgggatacttagtgattacctcttttttgttttgaataataataccagacaacaatgttctagctcatttggttttgaaattctatagggaagggataattgatccagcagcaatttttgcaatgctatttggtagtgagttgtttgaagattatattggtcaactggctatggcatcaatggcttcacttgataatttcggtgaagatgaacatattgacacaaggaggttgcacgagagaatgcaggcatgctcctttagctggtttattttatatcatcttccatgctcattgaataacatgaatacagtcaatggacattaatgtatgattcttttggcagctttcttttcatatttgttgcatttttcatattcttctgccacaatattctgctgagtagtatacttcaattcaggctgttcaaaaggaaagggaagagaaacttgcagagacactgaaaaaccgactgcacatttacgttcaaggaaataaagaggaatttgtccagcttgctcaagctgaggtgaccagacttagcaatgcaggtttttgtcaatactacccaccctcttcctcaactctgacttccccccttgctctcttcctttcctgcttaagtgcttattgctgcaaggacttgctcaacacttatcttagagaagttggcatatgatatttaaggaactgtacctatttatcacatgattgaatagataactgcataataagatatcttgacaagcatatctcatgagatggcatctagaatcatccacttcagctgaaacagatccaaaaattagtatgctattctttggctacacatacttcttgctgagcttattaattgaagtgaatatacaagcaccataagctcattctttttttttttaattatgcgcatgttgtaaaaggatgtgaatggcctatatgctattcctgcaagtatatgatgatgttagctcgatggcatattaccaattttccctatattaaagtatatttgccaagttcgtaaatagaacccattaaatgttcgttttggtatattttgttgtttttgctctgttgagtgctcattgtgacttcggttggtctttaagctacattatgtgaactttctcattctgtttggtcatgttttgcttcttgtgcagcatatggcactgttatgttaaacactatcggctatgtatattcgagacaagctgcaaaagaacttgggaagaaagcaatattcttgggtgttccatttgtagctgagtggttcagagacaaaggccatttcatcaaatcccaagtaacagctgcagcaggtaacataactcatcaatatatttaacttgaaagtatatgatacagctaatgtcatctattgtgctagcattatattaatcataaagaatttggttgtctcatggttctgtaggtgcaatagctttgatgcagttgcaagaagacttgaagaagtatcttagtgctgaaggccattacacagaggaggaactagaaatgttcatgcaaaaccacaaaaaggttatggttgattccttgtggaagcttaacgttgctgacatagaagccaccctatcacgagtctgtcaaatggtctgtcccagcttacccatcaccgttttactcatggttattttttaacataactagtgtgatagtgaattttgaacattgtatggatgccaggtgcttcaagatggaagcgtcaggagggaggaactgcgtgctcgtgctaaaggactgaaaacattaggcaaaattttccaggtatagcttgttcatttgttcattaaagttttggtgatgctgttgacattttcattatatgacttgtatttacccttcacttagcgggttaagctcaacaatgatgagggggaagcatcggatatgaggaatatagataacatggatgacaatgacgggagctcccccgatacatcaccaagaagggaaccaccatacaatcctatccctaaccctcctcatgctcaggtagcagctcattatgattttttacttctgtcgaatttctcaagatggccatttgccactgtccattatcatggtgccttattgattgactcattgagagattgaacttggagcacagtaattaatctataagaggcttaagagctcttatatagccttctctcatgacatgctaaaatacttttttctcttgttctagagcccatatgtggaggccccacagtttggaggaacctattacccattcaatttcccaatgccaacagctccacctggtgcgcagagggatccaattccatgacaccatttaagcttgcatgtgctgttgttctgtgcaatattgctggtgaaatactagatcatttgtgtgatgcatcatttgtacctgtagtagagaacggaggtttagctatccttcgcaccatttattcggttgtacaatcagagactggtcaggtagcagccgtgtactgttgtgtacagttgttaacgctcgtgttgaggcagtagtaggtcagcattggtgtacatggtttggtgttaatctgcggcctcgttccgtttagcttgacgtgcatcttctatggaaaatgaagctgagaaataaaatcatgtttatagttttgggtgtatttcatggaaatcattgtgaatgagtttgttggcggcaatgtcgaataaccataatgttttggaaatatcatttggatgagaaactgttggtctttctgcttactgtactatggcataagatttatcaagaacaaagaaaattcacagcatccagataatagagggaaaatatattataataattcgcacgaacagtgctcgtcgatgcttttggcgatgttgtcgccgacgtcgaagctctgcgtctcctggtaatctaggttgaagacgaaactggaggttaacatgttggcaataatcttgcaagcgaccgatatctatatgtaaagtttttaactctcaatccgttttttaatctcttcaataattaacgggaagtcctgcctaagatgaaagtagccattggtgacggccaccttcttgaagttgctctccgccatcaagaagttgaggcacttgctctttagctccgggcaatggtacgtctcggcgtagcctagcgtcgtcgccaccgtctccaccgacacgctctcccacagcttctgtgcacacatcagcttcaacctctccaatgcgtacctgtccgccgccacgagcaagctctcgaaaaaaccggtcgtcgtcgacgacgacgacgacgacgtcgatggcgacggcaaggcgtccgtgtacacgaagtgtagtagagctttgaacgtggccggatcgatgtcgtgcagggtgacgcacggcatggcggcctccgccatggacccgaggagctccgccttgaacaccggcgagcgcgcggcgagcacggcgcggtgcgcgtggaacgtctcgccgccgacggagaacgacacgtcggagcagtcggcgcggtccacgatgccgccgagctggccgccgaggttcgaccgcgggacgggtatagggccgccgtcgtcgtcgtcgccgccgccgccgccggcgtcggcgaagaccacgacaccgcagacgatcgtgaccacgccgtcgacggcgtagagcggctcgaggtcgctccgcctcacgaggtgccggaacgcgccgccgtagccgcgggggtggccggggacactcatcgggaaggccctgtccgagcagatgatcgacggcgcgccgacgccgccgtcgcggcgcatcaggaaggtgtggaagatggccctgacggtgttcgatctcgccggcacgccgatgcgcagggagacgtactcgccattgtcctcctcgcggtagccgcgcgggtagcatctgatgacccacgactgctccccgtcgccgacggcgaagctgttcgtcgtcgtcgtcgtccctgggtactcgagcttcaactcggcgaagctggatgatatcatcatcgtatttttggtgtattattaattaattgcaaaaatatgccgccaaacggacaaattaataaagtttatatatatcgaaaatctcacggacacgctctgcgtatcatgacgtgaactagagtagttcatgacgtgaaccatagtacgttgtaggaatttattttcggcaagataaatgattccttttttatgtacgcatttgagtcatattttgattggtaggagataataagtacttggtgttttatgtttatgctaaactaaacatgtctatctttaactattaatttttaagaaaatgtatggtttaacataataagatgttatgtttttagattcaccatgaaatatatttttgtaatatagatatatttacatgttgtcaaactatatgattttttttattgtttgacttcagatacaacaatgaatttgtcaattttatggattagatatgtcatataattggattcgtaatcaccatagataccacatatatacctaatattatacgataaggtatattgaaatataggaaaatagcagataagaacaacaactcttcgtacttgagggaaggggattgggagtttacacgagggaattgatggtgagattaagataggaatttgatttttcatcccagtctcttgtttggtagaggtaatggaaattgatagggagtttagttggagattagatcattaatgaaaatggatggctgagatttgtttaggcgaagtaaaggagaaatttcctcccaattacctgcccctacccaggtattgaaaatgagggagttcatttctcaattctctatccccatcccactaaaattcccatgtcccccaaccaaacaaaacagttaatagcctcatccctctaaactcctaatctcttctaaaaactccctccaaccaaacgggccacagtttacacgagggaattgatggtgagattaagatgggaatttaatttttcatcacagtcttttgtttggcagaggtgatggaaattaatagggagtttagttaaagattagatcattaatgaaaacggatggctgagatttgtttaggcgaagtaaaggaggaattccctcccaattacgtgcccctacccaggtattgaaaatgagggagttcatttctcaattccctatccccatcccactaaaattcccatgtcccccaaccaaacaaaacagttaatagcctcatccctctaaactcccaatcccttctaaaagctccctccaactaaacgggccgctaaggaaatatatataggttgtcaaaatctgacctaaaaagggcaaggtcttatttactcaaagttttaacacgaagtgtagtagagctttgaacgtggccgggtcgatgtcgtgcatcgtgacgcatggcatacggtggtctccaccatcgagccgagggactccgccttgaacaccggtgagcgagtggcgagcacagcccggtgcacgtggaacgtctcgacggaaagcttctggtttttctttcaaggagtaagggcaaaagctctgccgaaggatttcattaagaagggaaaggcctaaggttcacatcatacagattacaaggatcaaaagatcccagacaaaaggcttctggctattttttggtagtcaagtttgtactcgatgaaaccggaggccagcatgttgccggcttgccgccggcgaaggatgaactttctcgagagagaatttttttacccacagcaatgtgaagaagatcgatggtgaggaagcgacggtagttgctgccgataccgctggcggtttaggcggcccatgaagtgcgcagacctagtcaaggcccaagttactccagtctaaagaagtctaaccgcaattcccaagccaaccaaactattcgcaaaataacttttttctttttaaatctagggcctga

SEQ ID NO: 79694 - DNA, 62308 bp, Oryza sativa
  unsure (1)..(62308): unsure at all n locations
ctagattcgatcagcaatcaatagctacaactataagcattggctacgcaatggagtactttgttcttttgattctctgaaactctgaatctctacaagtcaagcagagctcctctgctctgaaatatctgaaactctgaatctgtgaaattctgaaactctcagaaaattctgcgaaactctgaatttgtgatcacctgacgaacttctgaacgccttcgaagaaatcgagcatgtagtcctcgagatcctcgaggctgtacttgatgtgcttcgccgccgacgaggagtggcggccgctgctgctgccggactccagcagctgcctcgaccggccgacgaacgagcggtacgccgggatgagccgctccgacacggcgatccggagctcctcccggagctgcgggtcggtcaccttccacgccgtctggctccggtacagctcctcgaacgccgcgttgaagctcctcgccttctccttcagcgccgccctgccgccgtgcccgtgcgccgccgccggcgaggcgtcgtcgcggagcgaggccagcacggacatccacgacgcccggaggtagcctgtctcgtactgcctgatctggccgcggtggcggcgcacccagtcgtcgccgaggagctcgcgcagcgccgggaactccaccatcatcttctgcacgatgtagtagatgttgttcatgaggaagatgttcttcagcccggcgtcgtcgtagagcctcgatttctcgtcgaggttgcggaggaggtgggtgaggatctccctcatgcaccgccccgacggcgtcgacgaggcgccaccgccgccgccgccgtcgtggtcgtcgtcgttggtgtcgtggttgctggtgttgttgtcggcgaggaccatgtcgagcgtgacgcggcactcggcgaggaggccgcagtagttgagcacgtagcgtgtcatggggtggatctcgccgccgaggactggtcgccgcgacgactcgccgtggatgacgttgacgaactggtcgatcgtgtggcggatggtgctgcccagctgcgccgcgacgccggcgacctcggaggagaagaagtcgcgggcgtctccggtgaagagggattcaatgtccggctcgacggcggtgagcgcctcgtacatgccgagcatgcggtagagcttctccgtcgccggggtggacatggcgacggcgtccgcgaagccgatgagctgcaggaggcagcccctggcgacgtcggcgaagcactcgtggccgagctcctcgtcggaggcgaacacctcgtcgcagaggcggcgctcgccggcgaggagggtcttgaccacggctctgacggcgtggctccaccgccgtatcctctggttgagcaccccccactccatcctgagcacctcctcgatggcgacggcctcgacgccgaggtgcgccgcggactccgcgagcgcgtcgcggcggacggcgacgtacacctgcgcgagctccgggccgtacccggcgcgcagcatgcggtccgcgacgccgctggcggaggcggccgcctccggcgagagcgcgtcgcggcgcggcggcgacccgtcgggggtcgtcgccgcgcccgcgtcgtcgaggtcctcgaacgagtcgagcgagaggcgccgcgcggaggagcccagcagcgcgcgcacctcctcctcgagccgcggcatggcggcctgcacggtctccgcggcgcgggacgccagctcgccctggagcgccgtcgcggcgatcgcgtcgtccacggcgtaaagataatcaaccatctcggacggcgacgacaccgagttgcaccggcggatgatgtcctccgccgccgcgaacacctcctcctcctccgcctgatccacctccggatgtgacaaggggaacatgggcgcctcaccttcgtacctggacagaacgcgcatcatgtcatcggccgcgttcttggacaccgcgaggctcttccccatgtgcttcgcgacctccaccacggcgtcccgcgcgccgtccgccatggccgtcgtcgacgcagcaatcgcctagaggagaagcaaaggagagagagagagagagagcttcttggtggtggtgttcgtcgtcgtcgcgggcgcgcgcgcgcgccgggtggtagctttcaaagaccgggtgctgtgcagcgcgacgcgaccaaccaaacgcgccgctcgtgctgctttgctttgctcggcgtcctcggacaatttccacgtatcaaaacactgcagcgccacacctttctaatactcggggatgattatctcgtgtcgagtttatggaaaaggctatcttttttttattgaaaaacacagttcagacgcagttgttttatccaattaacacctctaatcatgtcagtgtatcttaaaatcgacgaagtacgggtatgtcgtgagaaaaagaaaactaactgtcgttgattgttgatagaaaacacgaggtctgagagatctgcttaattccagtgcaggttcaaagctcgcctttgaatatatgagcgtaccagttgatttgatcctgtaatcaacaagaaatagaaacaaaaaattcgtggttaaatctataaatgatagccgatcggctaggtgccgatgacatatcatttatctttgagtcgatgtcatatatgaatcgatcggcgcttataaatagatagtaaggaactaaatctattcgatcggctgtagatattaacgatatatagttcttatattaatatatacttaaattaagtgattgggatagatcggtcaccatgccgagacagtataaaccacttagatcgaaatatatattaataacaggattatatatgtttatagcatagctgatcagatagatctagcatgtatcagctaatactccgatactactttatataaagatatcaaaacaaatataatattccaaacaaaagcttaatatacttaaatgcaataagatcttgacataaatggcggatttaatatgtcattgaagcatatagatcgaatatggttaaatcagataagatcggctgaaactccgatactaccctaatcggcaaccagagggcaggctagagattgatattctaagcacgacttaatagatcaaactcaactgatgcagcattaagtatgaaaagaagaacaatatctagacaatcaagccgctaggtgtttcataaagtggtagatatcttatataatctaggacaacgtcgttatttaacctaatcggctgccttctattaacatatgttagccgattgtaggttagatgacgatattgccaaagattatgtaagatatatgataacttgacgaattatatagacaagattagagtgtcataaagatgaaagcactaatctcgagaacacaagtcatcataacaagttttacctcttgttgaagatcgaaaccgatgcagctcaatccgaaagcaagaactcgtcgaaacaaaactaaagtaaaaagttggtgatgcgccgaaattgtattgaacatgtgtgttaaaaattacatagggctcggggtctatttatacccgagaattacaagatatgtccataccggacacgaccactatctctaacaaactctaagataccataagtctttgcggcagacttttgcccaaacatatctctaaggaagttacataaaacatcataattaatagatacaatcgccttctcaggactctatccatgtgcggcaatcatcttgaagcacctcaattcaacccaatgtcatacaccaaattatactgttagaatcggctgcatcggctcacctagttcgactcagacccagccgatcctaatcgtagccaatctggacttcagccgattctttgctctgttcttggatcaatctccgccttcgactacaccttgatctaatctccttttccgatgctgatattaccaaatttggtcattaacactaactaactgataaatcatgctcacttcgtgaaaaatgtcgtttttaatggaaaaaaaatgtttttttgatggagaaggttgtgcttttgatgggaaagtcatgttttttttcccttgttcgggaattgtaaccgtgtgcaaaaatatgtacggcatacaagtttgtattcaataggaggtagtaatacggttttgtccttctctaaaaaagtgctaatacggttttgtactttcatggtagcttcgtaggatttggaacattcgaactcagctggtaggaaagatgcacaatggagtgcgagtgtgtgactacttgtctacttccctcatgtcaagtgttgtcttccaataggccctacaatttttatttggtagatcagatgaaatttcagatgtccaatcccacaatccttgattggttgataatatcaattgtcaaataactttttacccaattcaggattgcaattttttcaggatcacattttccaacgttgacaaatgagaaagcttcaaatttcaaccataacaaggatcacatttagcgggacaagatcacaggcatgaccaaagaagatattttgcaggataactaacgaattgaagtttggaacaatgaattccatcgcatatcagaaaggtcattaattattgttttcttcatattttagagaagtcgacggtcaaattactcggtctgggacaggcagttagcctatgtgggcccacaggccgagaggccgggcccaccaagtgccaattgggcaagtggcctagaaggtcaagtataaagattcttgtagctgttctgtagacggagtccaaatcgtagaaagttcagacttggtactaacaaatcgacaaaactgtatcagtagtgacgtctcatcccaaaattacacactgttcattgaaccttgcttaatcacctccagtttcccccacttaatccaaccgaaatatcagagtgcccattgcacaagggaaaacatcgaacctgtgccgattcgatcgaagtccatcagagaatatccttctgaacatttgttgtcagctcttcagtaaacctgaacgattctactccagctgatattaaccgtcaagtctgggattgcataaatgtccctttatcgtcactatcttctcattagtgtccctttatcgtcaagtctgggcttgcatcacagctgacggtaattacaatgctgcttccgtttacgagctcttcttgctggctcgattgcgatcgcaatgcgcacagcttatttggcaaaaaagagcaccgtcgcggattaaattcttcatgtggttggcaacaaaaggccgttgcctgacagcggacaatcttcagaagaggggctggccgcatgacgcctcttgtggcctgtgcaatgctgagatggagagctgcaatcacctcttaatgaaatgccccctaaccaatcgagtctggcgcatgctcatggtttgctggttcatatggaaagagcgcaatgcgcgtattttcgagcatgtctctaaatcggcaacacagctcttttgggccatcagggaggagattattatttggagagaagcgggcatcttcaagcaagtagactaatcgactagtttctcagagtttgttagaggcgccgtgttcttcacggtcgtttatttcgggggtgttagccacggctagcatccctatcgactgtttaatgtcgatgatgtaaaagttgtatcaccctctctcttaataaattttgggcggccaaccttcggccgtcccggcaaaaaaaagtctgggcttgcatatagtatgtatctgattctgacaacccattgaaaaagatcaaagatgtcacataggatgaattatcatggttaatcttgtgcattgattctctctgatggacaccatgcctcttgtctgccggtcctatatgcatagtattaatcattttcttcgcagtttttgtatatgctgaattaagtgatcacacaggtgagaaaaacattgaaactacgcatcacttcatattcgttcaaacggccagtgtattagagatggcaaagcatgattcaggtgacgagtaatttcgtaataatttactagctagagcagttcctattcgatcggagtggttgggaacacatgaaagcatgcccaccttgatggatgtcatgactttgaaatgaaggccgcttctgaattcatcagttcacattcaaattttctactttgcccgaccaaaatactactcaacaggattgtaatctcttatgtattgtttaatactactctgtaatctaccctgttttggaaacaaagaaaaacgaatactcgtatcgaatttaggaattacaaaactcactgaaagttatgtgcagtcaacgtccaaggttcattaccacagtacgaatctgagcaacatctattgaaaagatccctttgggccaagtgagccaaacaaatgtgtatgctgtttctatcaaaaagattactgtatcacgaattcgagcctctgatttcatccgagttggacagtggatacaaagttttgacttttatcttgctggattgctactcaattagtctttcctgatcaatttctgatctgatggcttcagccaacttcatcaacctgatgctgtggtcttagaagaaatgaacttttgttgctcacagtacagactccagaacccattgtcttcaaggggatttttttttttttgtcttcaaggaaaaaaaaagttcagaacccattgtatttataagtgttgctgtgcttatgttcaatcttaatgtccttcggttaaatattatgttatgggcatgcagtcacaatcaaattacatgactttggtcgccgaccttcactatactatattcacacaatcgttagaatattcatgaggcagatttgctcatatcatcttggatgttcggccatcctgattataatacgccgcacgctgattaaatctacgatatacagccatacatgttcatattatcaaccgttctaaaccaaccatccttttgaatacatcctttgttttaaactttatagtttttatatggaaattgaattgtgttcttggctgtgttcgtttcaacaaatgagaaaactgcaactttttttacatgcacgcttcctaaaccgctaaacggcgtgtttttttttaaaaaaatttatagggaagttattttaaaagaatcatatatttttttaagtttgaagtaattaatacttaattaattatacgctaataacccatctcattttacgtatcttctatctcttattttctatgctctcaaacacaatcttatcgaattcattttggcaagaccaaataccaaatgggcctaatttgtctattagaagagcccacaataatgggccagccttgtgcatacatgtacgtacagtccactaggaaccaagccatatttttgggcccaactaaagcctaaggcccatgtagagatccctaaccatttctagggtttcttccctcctcttagaccgccgccgccaccgagccactgcttcttctgtgcggagagagagagagagagagagctacccttcccttcccttctcctcctcctgctccgccgccgccatggttagtcctgagctctctccgctccggtacgttgatccgctcgtggtttgttccgttattgatctgacgtctcgctgttgcatcttttcgcagggcaagtactcgacggagccgtccaacccgaccaagtgtaagatctcgatgatatcctttttccgcgatggtttggtttcggtttgatctgtctgtgtagtggtttttgatgggatgttgtttgtgtgcgcagcggccaaggccatggggagggatctcagggtccacttcaaggtgcgtttcgtcaacctgctctgtgtgcatctctgtttttgtgtatttggttgatttgttgtaggttattgtgtttgctcgttttgtgcaatgttgttcggttagggcaaataattgtgtggatggcatatgcgaaattattagagtttcattctgtagatagcatcgtgaaaggattggattctcactctgtagatagcattgtgaaaggattggagtctgatgatgacctaaagagtaaaaggttctgttctgtttttcagacgaacagttcccacgttactttaggaacattgatgcactgtcttctggcgaactgttgtatctcaatgacaaatggttcagagacagtgcgacatcatgcttattccttagttatgattttggcctgatagagatcataagtgtttctgcattttgttcagaacctgtgtcgtatatctgcaaagttagattttcgctatgcgaaaatggtgtaagatattgtgaactgcacataattttttttgacgatattgcttgcataatgctattcatgttttgatgttgttacctgttcaagtgcgcactgtacaacctggaggaagttatttttattagcctgattgttaggtataattctattcacatgttaaccatttcattgaattttcttgatctgattaagcttagactttcacaggttacagctattttatgctgttctattactcattatggtcttgtttctcatgttttccttatagatcttccttgtacataaaactattgtatcattattgtagaacatttggccttcttgtcacactgctcataactctcactagaagttgctgttgatatgaaatcatttcctggtactttgtgtgcatggtaaactgaattcactggactagtttattgtaagactctgatgcgtatgcgatggtttgtttcttggttcttgttatcctttttcctgtttctctagctgaatgtcaaatgctctaataattgctgcagaacacaagggagacagcgttcgctcttcgcaagctgcctttggtcaaggcaaagcggtaccttgaggatgttattgctcacaagcaggcaattcccttcagaaggtactgtggaggcgtgggccgtactgcacaagtgaagtctcgccaatcaaatgggcagggcaggtggcctgccaaatcagccaggttcattttggatctgctgaagaatgctgagagtaacgctgatgtatgaacctgttgctagttttcctctcaattttaatggtgacactcttcatatttttttaatatgcttgggctaactaatggtttgttgcgtataggttaaaggcttggatgtcgacaacctcttcgtttcacacatccaggtgaaccaagcccagaagcagagacgccggacataccgtgctcatggacgcatcaatcgtaagttctcgaggatggatgttgatttatggttccatttgtagtttacttatattgcttttgtggccagcttacatgtcctcaccctgccacgtcgagcttatcttgtcagagaaggaagaggccgtgaagaaagaggtatttgtttctttcatcccattatagtctcagttgttttcgtgaattaggtagtttgtgggaagtaatgctttggatttatatagactattcaagctgtttgggccacaatgttttttctcagtgccatgttctgtgcaataatacaatcatgatgttaacctaaatccatgtatccttctcagcttgaggtccttgtagttggagctaaattttgtgggcgatgccccttttatcgttccagcatttctttagctctttttttcttctaatccatactgtcaattgtttcttttgtagcctgaaaccaccatcgccccgaggaggcagtgagcttatccgcccagagtcgcaactttagttcattttctagtactttgttatggcattgtgtgctatttatgtttctggtaccattgtttagtcggaacttgttaagtttgatgctatcctttcgtttgtgtatgttcaaatggtaacaattacttgccaacttatctgccaaaattttactgccttacaaaagcgtcatcatcaaactgccttgattgcttacagtgattcaaattaaatcttattttcgtctatgtaaaacggtcggtcgttcccggcacacgatggttggattgctgatgctacaggccatctagattcacaacaattcgattacatctatattattgtgagcttggcataatcatattcagggcctgtttagttaacaaaacacaaattttcatgctgccacatcaaatgtttagacacatgcatggagtattaaatgtaggaaaaaaaatcaattatatagattgcgttagattgcgtgtaaattacgagatgaatcttttaagcctaattgcgcattgttaatgacggattaattaggtttaattaattcatctcacagtttcttgacagaatattataatttattttgttattagattacgtttaatacttcaaatttaaatgtgtgtctatatatctgatgtgataactacatccaaaaattttctctaactaaacaaggcctcagtcattcatcattttttgtttggtggtaacacgtaagaaatgtttcttacaaatttcttacaaatgatacattgacgtggcacacaaattcagccattcataagcggccatgtttcaaaatttcttggagctaagtattttcagctctagaaatctatgaatctgagctgtgattacaccaataacatttggattaatcattttgcgtcagttttagggtaaatttaaagggatttgctatacaatagcctgctttttttttttgtttttatcagctgaattgctggccatccaattgttcaaggtttgtgcatgtaatcaatgaatcctaaagttagccctaagccggcttctccctgcatccgaggcttagggctaattttagagttttattgattgattgataatagaggacatgcggtccctttatatacagggtggacatagaaggaactagtctataatattatataaaccaatccaatctctatctctaactttccaataaacctcatatctttcctaactaggtaatctcttatatttatgtgacttattcctaaattatcatacctaaactgttgcatgggcctggcccatgcccataacaaactattaaatcatattatttatgtcatagagtacttttgttaggccctagtagtccagatgaatttgtacttttgtttttgtctttgtctttgtcttttttttaaaaaaaaaattatgcaaaaaagtggttttgtgtgtcccatttgtaattttgttaccaaatttttaggtgtagtgagtagttgtgttagtaacctgttttgttagttcttatatggtttttcacatatacttgaggtgtttaaaaaaaatgcttcatattaatcaagttgatacgctatctacatgataataactattaaatcatattatttaggtcatagagtacttttgttaggccctagtaatccagatgaatttgtattttgtttttgtcagttttttttaacttctccaaataagtggttttgtcattgcttgtcttatttttttgtcaaaaaaatttactttatcataaatgagcataatttcaaaaacggtgtgttttatttagaatgcaagggctgaggctgagcagaaagtggacaagctaaatttctcctgtatattgacacatggttgttttttttatgctcctgtatattgagataacttgcaatatgtatttgtttctcaagactagcggataaattaaagatgatgtatattcgtgtctggtttttgtatttttttaaaaaaaatattttgctacttattaatcaagttcatgcgctatctacatgataataattactaaatcatattatttaggtcatagagtacttttgttaggcacttgtccagatgaatttgcttgtttgcttatgcctggcatccattacaagtatacctaacactaagatcgttcactgtttccacgtaggggtagggagacaaatcgtgtaatggctgttgattgattattatattcttcagtatatataatcttgttaaatattgtttgcccgggtgcgtaaagtcgcgcaatcatagcagcaagaacatataccctggcaagaaatgccgagcaagattactactcatgttgcttttgtttatttttacaaatcaaacctctgaatgagctcataatgtacaatactctctccatctatttttgatagtcatatttctaaatctgaaaaatttatttttgataatcatatttcaatccaacaatctatcatcttaatgactttctcggatttaatgcatgactctctattcttccacacaagattggctatatgggcatcgagaaatataaatattaatgattcgcttgtttacgaggaataattagtagcatgtttaaatgtatgataagtataattacttattcttagtctgtgtgttaagatgaaatatgactatcaaaagtaaatggagggagtattaagtagcctacaattctctttctaccaataaataccttgattttttagccagtgcacgaatgcaacattgattatgcacagaaaagtttgcaactggagagcttcattgatcatgtggcaggccgtatcccttttgttttctgaagactaaattgatttgtacgagtattgctgcttaattgtagccactcaagcaggagacttaggcgtgtatttgttgacataattatctcaaattctttcttgcatccaattagtacacttccctgtcaacatgtctacagttttgcacgcccagtatttcgctaactggtctgcaattccatcaagtattaaaaggatttttttttttgcgaatgcaattccatcaagaacttgtcatggtgaagcttcagattgaatatcagaattgagaagattttcaggattttggtctcacaaaatgtatccccagagcagtcgctatccatttcattgcaccattacaaaaaataataatcaaggtaccctttggatgatgaaggtttgcccaactcacagttggataatactggtagagagtgatgcctcgtctatgattaagataataataataattatgccagtccacttcagctcacagaagacttcagatagagaattgattttgtcaaatcatatcatagtacacacacttcattatcaagaaaagggccaatatacgggagtggatttcaatccctcgaggggatatctccttgttatttgcatgtcacttaaatacttatgaaaaaaaattaagaagatgcattaacatgtgatatatcactccacaaacatgcaagttcaaattcaacttctatatctcgtaacgaaaaaaaataattgtgaatatacgttaactagttatagtttaatttgttttttcgttgcgagatgtagaaattgaatttgaacttgcatgtttgtggatgatatatcacatgttaatacatcttcttaattttttttacattttttcataactatttgagtgacatacaaacaacgataggatatcccctagagggatcaaaatagtttcccccaatatattattcttgcaataaccatcagttgatcacacaaatcttgagccctgttctggcaccaatgctggcctctagcattatacaacttcagaatacaaatttttgaatgctccttaaggataagtattcataaactgaacaaaaattttctgaatgttcttgcattagtttagtaactgggactagtttcatttgcagagatgcagtcccttcttccaggtcttgttcgcttcatttccgttttgctgtcgtccgaagattgaagcaacaatcaagcctcctaaacaaagttgggcttttttttagcagaatatatatgctctctcttttacgactgcattgtttttctaagctttttttaagaggactgatcgattccaactggtggcagagggggataatggggctaagcccgtgtatttccagcaaatgggcagttcgtttcaaatttctcaaacagactagtttggggtattggtggattgtgtgtttttaagtcagcttgttttttgggcaatttttactggacaaaacacaaacgagcttgatgccaatctgatccacaagactgggcaagagaagcgcgcgtgaggtcagcatgcgcgacacgatgctgacacgtgttttatctgatggccccaaattcggctgaagacacacaagaattcagctggatgatggctagacagtccctagctattatttaacttatataaacttttaaattcaatacatgtgtttagtatttcaagctgtgcacctgttccaagcagggcctaattaaattgtatttaggggaaaagtacatgtacaaaaggtttctatgtttctataatactcttacaaacgacgatgtggaacacaagggtgttgattttctataactccgagcaaactaaaaatcaaacggttataactatgtattttttcatcatgcattgcacagctgattcaattatgttcatagcaaaaggggggaaaaaggtgaatttgtattatatgttatgataaaaagaacacttttacaatgctcctgatatcaatcagtcccacttagatcccaacaagagggaaacaagaaaatgtacacacgcactgactactcttgaccagtacgtaaaacaatcacagtaataactactttatctgttttatatcataaaactttctagcattgtctacatttatatagatattaatgaatctagatatatgtgcatagattcattaacatctatataaatatgaacaatgctataaaattttataatctgaaacggaggtagtaataaacagtggtagcagcagctagctagctaggctaaaagcttaaaattaagctagtagcaagcagctgctggaggtgtcagcggatgcacttgcccggcgtggtccatccgaagcctccccggcgcctcgccgccggcggtgccgccgtgtagttcctccagtcgcggaggacggcggcgaggtcgtgcaccttgttggcgaggccggtgcagcagttggcgtggagcgtgcagaccctggccatgtcgcggctgagctggcagaagccgccgcagtgcgccgtgtcgaggaactgcatccggacgtcggcgcggcggctgagctccgcctgcgcccgctccaggacgtgctgctcgttggtccccggcgggaagcgccgccgcgcgtcgcgccaccgccggtagaagtccaccgtccgcctcgccgcgcgcacgtacaggaagccgccgttgggcctgttccggaggctctccgggtcgccgttgtagtagtcgttggccaccgcgatgtccgacgtgatcgcgatgtgccgcagcgggttccggaaccacatgatgtcaatgtcctgaataattaatgcactactattaatactactttcgagttacatgcatcggccagttcgccgtaaaatttggaatattatgtactatcttttgtagtaaatatttaacgtttaggataatatttgatcaaacttttaaaatttaaaccatcaatattttaccaaatgcttagtttagtttcgagaaatggtatacatcgaaaactactatcataattccacaaattacttttttcttagataatgagaaaatctttataaacttactacttcttccgtttcatattataaatctttctaggattgctcaaattcatatatatgttaataaatctagacagacagacatacatacatacatacgtacgtacgtacgtatacatatatatatgtatgtgtatacatatatatatgtatgtgtatacatatatatatgtatgtgtatacatatatatatatatatatatatatatatatatatatatatatatatatatatattcattagcatctgtatgaatgtggataatgctagaaagtcttataacataaaacggaggaagtagattttataaacgtattctaatatataaaattgattgttgaaaatataaaattttatccgaatctttgtcctaaacatcaaatgtgtttacgaccgaacgatgatttgagttgcatgcgatcgacaaccagtttatgctgtgaagtttgtccaggtaaggtgatcatgattattcataccgtgaagaggaagttgaagccgagctggaggatggtctgctggaagaggttgcgcccccacatcatgtcgaggtagtccttgctcatgaagcgcttctcgtcgctgtagtccacggcgccctccggccgccggaggaggtagcagtgcgggtgcacctggcggcaccgggcgagcgccgcggggtccatggccacgatgaggacgtgcttcagcagcggctccgtgccctcgccgagccggaagctctccaggaagaggtccagcagcgaccccggcgccgcgtacgcccggttgatcgacgtcatgatcaccgtcctgtcgtccatcgacgcgttcctcagcacctcggtcaattctgacaatgctttcatctgcaatcattattattatcttttttcagcctttttccattagatgtttcaaatttgaagatcgatcttgttgttttaagaatctgaactgaaagttagtagcaaatctttccattggatgttgcaaatgtgaagatcttgttgttttgtctaagaatctgaactgaaagttagtagcaagtctttccattggatgttgcaaatgtgaagatctatctcgttgttttgtttaagaatctgaactgaaagttagtagcaagtcgagctgtaaaatttcatagaaagttcactcgaatcatttggctgagttgtaaatgatgtaatatatcctatccccacaaggctgcttggacaacaggttagcatattcgttacctcatcagtagtcagtttcagctttaagcttttgggctctgtggatgtgacaaagctacaggaagcttatctcaggctaatgttggaaaagtagaattggcactttggcttgttgatgattggcttttaaaaaaaaaggaaattctagacttggctaatgctgtggaagatatctgcagcattatattggatatggatttgcttgtcgttgcgtcttagagacttatcagctcactgaatgaagatgtagatagaggaataatctaggacgatagaaagggagaccagtagactacctgaccactaatacccgtctattatgcatagttgcaacttccaactatttgcaacgaaatgaaacagtcccaattaattgcacggccattatctattagaattttgaagcatcttgcaagacaataagaacaagaaaattgaaatgaaaaaaaaggtataaaaaccctttttttattatgtaaaagtataattcggcattactcaaggaaactgcactgaagatgttctcatctcatgttcagaacttcagattgttaagcagaaaacgcagaaagcagcatcggtagatcactgacctcgtcggtgacggccggtggagaatcattgttgttccaggaggccagggcggagagcctccagttgatatccatagtagcaatgacgaacgccgccgtcagcgccgcgccgaggaagaaggagatcaccgggatgagcttgcccatgtcccctctcaccttgcaagccatgttcttggcttcttgctgctgctccctgaacaaggtgatcagaaacaagatggatcatcagagaagagttgtgtggtatgatttatatatgcatgcaacatgtagcttttaccactagtttgttggctcgtttgttacaagacctccaaggaagcccacaggttgagccttttctaaagaagagaattttttagccttaatgttgatgattagggggccttgaattggaatctagtacaaaagaattgttctgaaatgttgatattatgcatgataacaaaaaatcaggcatacaacttgcgagagtagtggaacgggaaagaatatgctgcccaaatgtccaagcaaatgagtttgtgcaatgccaatggatgaatcaaatttgcgaagctattctgacgttggaactcaaaaatgaaagatgatgcgtcaatttgaacaaaatctgtattaactgaatgtaatagctaggtagcgaagccattggaaagtcaaaaggagtttttccttgttgtcgctttgcttcgttggtatttgaaaaaaatgaaacgatattaaaaatcttttgcgtactccgtaaaagtgagttgtttgcaagaatttgaagggacataccaattggagaaataaaaagtcagagtcaatgcaattcaaaagaacaaaaaatgatgccttcaattcgaaataaaaaccatatgggtttaacatcctattgaaatcctcaatagagaaattcaactccagattcctatgggtgattcgcaaaactgatattgaaacccaaaaggcacagttgatctctgaaaaactgaattcagaaatttaccgtgaagcagttcatccataacctatttatgttaaattctgttggaaacattgtcatgcaagtgtgatattattagtgtgaacaagtttgtatgtacggaatcatgtacgacatgcatgtaggagatgtattacttggtcagctatgatgcatgtgcttgcatgagttagttgagttggttaattagtggctgagccatgtgttcgatgcatggccagcagagttagtgcatgcagagtacgttgtggtcaaggtaattactactaatttagcatttgtatttaaggaggggttcaggaagcttctacagttgaggttgagtcttgaaataaacaggacaaaaaaaatatggtgtttggaaccacagaaaatcagtgtctattcatatttgcgttcatcatgtgtatacatttgaagttgagcgatcaaatcccaacaaaattcagagatttcagtcaaaaataaataaattcagaaatgtcactacacttgtgtaatgtactacttaccggccccaaaaccgtcgttttgtactttgtctgaaactgatgtaaaaacgataaattaaaacgccttccctgaattaattaatcacgacgatcaaacgacctcgtatcataacaaaaataataataaataatcatacggaattgtatgcgattgtgagcaataacatcctaatgatggtgattgaagatctcgaagtcaagagagggaggactcgcggttgatttacctaccgagacgggagttaaccgctcgcggcgggcggcggcggcggcctgcgacggcgagggagtggaggcgacgagagaggtgtgggcgagcagccaccgcggcggcgatgaggagggggtgcggcggcggcggcgtgccggcgtgggagtgcgtgtgttggcgagagacgacgacgccgcggcgccgcctttcgccctctcccccgcgtgcgcggttgggcttgggctggctcgcatgtctctggccgaaacggccgtaattgggccgcgtatcgaaggagttgggccgaattgacgtaaaccgagtacggctccgggccgaaactaccgcgttgctgggattttattgcgaacaaacattattattacctgaaaaatatacatgcataccaatataccatgctccctccaaatctaaaatataaattggacaatatctttctattataatatactctctcggttccaaaatataagtgccaaaataaacatttttaactttgaccgctaatagcaaaaaaataaaaataaaaaaaataaatcatgtaacattgatattactagattttttattaaacaaactttcataatatgcaactctttttatttaaaacataatattgttggtcaaagtatattttggaacagagggagcatccaataaacaaaaaatatatttctatttttattgcagtattttgtaagacaaatctatatatgttgttctagcgcctttaaactaaatatttttaaagttgttataatagttaaagttataaaagtttgatcttaatcttatccaaaacgttaagaattataaaaccgggaggattacgtgcataccaatatatcaatttgaaatatatacatgcataccattttcaaccctcctaaattttaacgttatcgatggtttatttagtttaaaggcctaatttttaccatatcaaaattaattttggcaacttcaatagtatcaattgaatgtttggttggctaccaattttgcacacactagtttaaattctatattgtctcaaaaaaaagtttaaattctattctatgctaaaacttgttaagattttgaaactaataaaattttggtttggcaaaaatttggctccaaacaaaacaagctcaaaatgcacaggcatcaccatgtttgcacatcacatgctaaaacacaactttatgtgcataattatgagcactagaatttacaatattatgtgtctacggactcatatcctctgcagcagcaacgtgcatatgggctcaaagaagagtggagtaggacctaaatgtcagtggctttcatatctcctagagaatttttgttcggcaccccttttctcagcccctctcactcgttttccgcacgtacacttttcaaactactaaacggtatgttttttgcaaaaagtttacatacagaagttgcttaaaaaaccatattgatccatttttgaaaagaaaataacaaatacttaattaatcacgtgctaatatattgcttcattttccgtgcttagtgcacgttgggagccggctgtagcgaacacacccagccaacaatgctgcttccacgatgcgcaaacaattgtcaggaccatatgcatggactttgcagtacatacatatgtaagtttcattagcatgcagttcaatcacaactgaaagtgaaaccacacggcatctgccgcattcaggcccgagaagtgggctctacatgtcacaaatttttcccttttttcacacgccgctgtaactagcgacaggggccttcaaaattcaacacccgaagtttttatcacagcagcaaacactaacacacgaaatcgcacgatttcggtacctccaatggtataccacaaacaaccaaacaccagtatatatctctctcacggtaatgttagctctaatgtgatcttttcacatcgccaaagaagccagtatcaatccctgattagtctgtaccgaagtagcgatcaccatactctcctaaccctgggatcacccggtactcctcgttcaacccagtttcgatctctgaggttacaatcttcagacgagggaatcgcttgcagacacaatggaccccttcaggagcctgttcatcgaaatgccattaccaagtttgcacaaaatgaatcatgtactatatcagtattaaccatgtcaaagagctggagtattttaccgagatgagattgagaaacatgatccgctcctcaggaactccactacttataagaagttctatagcttgatttgccgagttacctgtacagttgaatagttatgataagaaactttagctgtgacttcagtagttctcattccgacaagcaagcaaacatcactatgaaaggagcattggataaattcaacactacctgtaccaagcacaggatccatgagtagaacatgtcgttcagcaatatccaagggaaacttgtggtatatgagctggacaaggggaaaaacaaggtccgttcaaaatttcgcagaaagtgaactatttccatggtattttcaagaaaactacaaagcatttcacctgttgtccattgtccccatcccgatgtattagaattttgcctattttaatccccttacaacaagcacgtaatgcattctccatgctttctccactgcaaaacaacatatataccaagttatttcatgcagtaagtacataaggataaaaataaatcaaagaaatgggtcgtaagtctaactaaactacactgctggtcagcatgggctgagttatgagtaccaaatacatacccctccgtcccaaaaaacagaccaatcctacctacgaacgtggacacatgtgtatccaggttcgtagctaggaattcgtttttttttgggacagagtagtattgaataaagattttcatcactgaacactaaatcaatgtatacacaataatctgcaaaagaacttatatggtatagaaattcactcaggttttattaaccattaaaggaaggttcaacactagaagctgcagataatccaactttttttttgcatttgaagctattagttttcaggaaagcaatggcttaccttcgaataattgacacaccacagagcttcttacaaaagtcaactcccatgtaagtagaccctggacaaaagaacagaatgagtatgacgtcataaatgtgcaaccttccaacatttgtttacattaacataaatggacagtgctacgtgcgtgaaactgtagacaaccagtaattgcagcgctttgctttctctttattaatacaatgccagtgaagctggacctttataaaaaagaataattcatgaagtaattgggtgatcagacaacaatcttttagaagccccagattcaagatttctcttggcaatgaatattgaaccaagatggttagattcatttgattcacagctgcttacattccatatttttccactttgaatggagaagctcctttatcgccataaaattaaaatcagtagtaaaattgtaaaggggttattggagctcttgttgctccttgttatttttcaggacaaaagataataggtaagtgtttgttgaaatttagatgcacaactttatcattttagacctattttattggagcggtgcaaaaacatatttcccattgcttgttgcaaagacacaaaaatggttcttagtaaaaccaccatggattcaaatggctctgggcaaaaccataaacatgcaattggaaatgtcaaatcccacactttcataatggtatatatagcagatccagttttgccaaaactgtccttccatttctacagttcacaaacactattcttagataccatagaaacattgttaagaaaacctccagagcatatactaagttgctaccactaagagataattccaaacatacttaaggtgttactttttctttttctggctggcatatgctaatggatttatatagggcaaattccaagaacaaaaataaataggcgcaaagtataatggaaccagcaaagcacctgttggtgtaacaatctgcttctctgtgaaaggcaaatgccccagtccatgctcaactacctagcaatatatttattttccacatgaataacacatcaataaacagtcagacacattcagtagctatgtagaactagagaagggtacagaggccaaaaagaatgagtgctaccagacgaatcagacgatctgaataaaagacgaaatctggagttgcaatgtcccggtcgcgaataagagtatgcattccacgtatctgttaatcgagtgtttataaccatgggttgggaataaaataacattatgaaacttaggatcgagagaaactattgattgtacctggaaagttgtattaaccacataaacatttgggtagattttgcataagtcatgctgaccaagttttgtacgaatatgttgcacaattaaatctatggcaacatggttatctccccctcgcggtatgatcacatcagcatattttttggaaggaagaacaaaatcatcgaacgcaggcttcacaaacctcccatactacaattcaataaggttcatcaaaagtgtcattacatatgtattacaaacatcagggcatgcagattttgtgacatatttaaatagaaaaagactaaaataacatagacgggtgtttaaattacctgctccagcactgagatgacatctctacctctttcaactgtatcacgccttatacgccgggcaagtctaatatcggcatctaaattgatgcataaaatacaaagggataaaggtgaatgatcacaaacgatattgttaccataatatctattatattatacctaacaaagaggagcaacaaacctgtgtcaacaaaaattttcatatccatcaaatcacgaaccctttgatcatgaaaaactaaaatgccctccaaaatgatgacatctgatgcattaacctaagaaaacaaaatagtcaaaaggtttttaagcctaattaacaatcataattcattaggtttcactaccattaaagaaatccagaaaatagaccaacaacgacactgaacagaaaaagaaataccacccataaattattgccatggcgaaactagggctgggttggttatgaaaaaatttcatgaatcataactgctacataggttgagcaaggtccacagtagcttcttagacatatgatgtactctttatattgcatatccttatatcctttccccgcccacaaaaaaggtcactttatagtatactcttttagcatgtgtagctcatttattaatggagacttcatagtacactacttaactatgtgcctatagattcaatattttggcaccaaatttctagaacagaatgtgaaataaggcacaccagatgccatcaatctacataagacctttgcatacaaagttatcaaccagtaattaatcatagataaaaggtgtaataacaatagataaacaggaattatctttttcacaccaaaggtcaacaacgacattactacctttctaaaactttcagagcatcgacggtggttcttaaaatcatatataggaatatttacagatagcccacttttaagctgtcccatgcactctaaaagttgctctgtatcaaatgcatctgcaaaaaagaaagaacgaaaatatcttagtctcttcccaacgtaaagcagattgaaacctcgagaactcaaaaggcaatcaatttttatcaaatcaagcacctgggtgatcaaagttgtaatcttgcacacggtcagattcttcctcagttaaaccacggtagaatgaatcctgcaaaattgaaactttagctgaagtatatagaataattgcagaaatgatctatcagacatagtcaacaactagtctttgctcttttgatgaagctcttattcaaatgacagcaacttgcaagtacccagatcagcattcacccaactgagcaagaaaccacagccaaccatacaagacacacaactgaatacagatgcgaatatgaaagcaatttcatgcttctagcttgccaatacgcaggcaatgatttaatcaaatgcacattttgttcaagctgctccgaaagaagttcttttcacaacgcatttccccttttgacaacttgcacaaatagcaattctgcctgcttgccttaaagaaaagaaacaagctatgaatggtacagagaagaaaaaatataatactgcacgaaaggccctacatgtttaggcattaggatgcatacaaactgcacatacaagaaagtggagtaccatactcatcctcgaccttgactgttcaaatcatgtcatttttggacctaccgcatcacaatatgttccactccgtaagttattttgtactaacaacaaaccatacactgatcactgcaacaacggattggctgattgaacaaaacgctcgaaacacgaaatctcactactaggcaagcatatgcatatagcaaccaaccaagcagacatgatatgcatcctgacgatgcaacgaggcacaccacacctggttgacgagcacgacgcggtggtcgtgcagctgctggatgatcatgtcgcagaccgtcgtcttccccgacgccgtccctcccgacacaccttcgccaaccacaaccaccaaaattcaaaacaaacaccaccaaggattacgattacgagagagagagagagcgggcggaggagtgcgtaccgatcacgaagggctgcttgctcccctcctccgcggctgcggcggcggaggggggcggcggcggcgcgaacccgttaaccgcggcgggggcgtcgttgccgccgcagccgttgctggaggcggcggagggggagggggggagggaggaggaggagaggcggcgcgagtcgaggcggagcccgctgaagtgcggccccaccgccgactccatcgcggcgtccatctctcccctcgccgtcgccgccgccgccgccgccgccgacgtgctgagctggcgcgcacggtgcggaggccggaggttttgacacgcggattgggtgggtttttgggggacgcgtggacccggtttatgtagacccttcgccgagccgctgctgacgtcatcacgcggtccaccaaggataggtccagggatgtttcggttcgccctctctgtggactaggcgaggaggaatatgaggggtagattcttttttttttcttcttttgttttttttcccctgctctgcttaactgctttgcagaaatcgcagtcttgtgttgtgttgcagttgctggtcctgtttggattttgcaaatttgtttccttcccattgtttgctcgtgcgtatttatgagctaccagtattcagttttttttttccttttgtgtaatgtattcaatgttcatgaatgtccattgaccaaatttatgcgtttttcccgctacattgatacttccgatgctattactccccctctgtttataagtgcatttgtggtttatgtgtccaacttattttaccgtccatctcattttaaaatttataaaattaataaaaataataaaccacacctataagtattattattcatgtttttattatctaatatcaataaaaatactaattataaaaaaattaaataagatgttaattaaatgttggatatacaaaccacaaatacatttaaaatgagagggagggagtagtagagttaatgggacatgaatcctctgcagtactgtatttgcagtagcagtggctgacaaatagatccggttccacatgtcaatggcagctactacaagtgcagtactacaaacaatcccgacagcattggttgagctggtaacgccgtaagaaatactaaacttattatggatgaaaaaccaaggtagaaagaagcctaaaatcaaatctaaaattaagttttaacatttaagttttagttgtggttgataactaatacaccaactaacaaactggtatttttcatcttaaaagaatatcagggatatgccatgcaagttgctataattattaggccttgaaagtgtgattagtgcagacttgcagagaatggatggagcaggaccagcaggtgtgtcggtgcatgattgattagagattagtcactctttctttttttggacgaaagattagtcacattaaaaagacacaaaaatacatgtgtcttgattcctggggcgataggtttctgttcacacatcaaattatcaaatggacactgtgatctgatcgaaaatgaaataaacaatgactctgaactctcgacagacactgtggataagatcaagtaaactggaattaataattaaaaaaaaactacttggaagactagcatccaagtcatggcatcaagaattaatcgaatattataatgtaaatccaacgtggctagcatcaaattaaatctaccaaagcatcgagtcatggtcaagtgattaaaaaatacacgagacaattacgtgcactcatcaacttggttgcaagtagcagctactgatatagactaccaaattttcaaaaaagcaaaacaaaacaaatgggctctgtttctttttcgtcaggcctaaattgggccggagcaatgcatgatgtttattatctgggccgtaatttgtaatggacttcaaattgggccggagtaactgaggctggttgatttgggccataattcgtaaaggactcaaattaggccgaaaataggacttcaaattgggccgtagcaatggacgaggttgattactttgggccgtaattcgtaaaaggcttctaattgggccgaaaagagcccaaatcgccatagattggcctcccttctccgtcagactgaagtactgaagcagctggcctgcagccctgcacgcacaagttcagagttcagattttcagagaagtgttcgtgtggacactggacagtattagcactgaactgctgctgctgctccaatgtcaaaagggaggagaccagctagcgatgctctcatctcaattctcacctcatcttctccaagaatctcgcctttattctcgcttctgttgctgccttgcttgcttcatcagttcatctcatcgccatcgcaggataagtcaaacataggaccattctttctttcttccttttctttccttgtgctagctcgcttagaacagaactgatgggcttgatcaataattgagtgatatatgcagcaaatgcgtgcgtgcactcatcaactgcttggagggatcgatctctgctagatagatacatgatgtggatctgatcgatgatgcaaatgcttgcatgatcctaggctcatagctacacgcgtggacatctagggttcgaggctgagattaatggattcgatccatatccatgtcagataagcgaaaacttcagttcttctgacggtggtctgaatttttgcctgaagaatgaaacggaatgaagagttcagtgaggttcagaaggagaaaatgcattgattttttgcaaatgcaaaattggaaggttacagaaaacaattactaggtgaagtagtggattgattagtgccaactagagattgccaactgttggcagaccactaatcctttttgtaatggaaaaaccaccaatccttttataggctactctgttgatgtgtttctcctaattgttttctttttgtgggaggatatctaatgatggctggctagctagctaatctgaaaaaaagaatgaagaatgcacaatgcactaaccattgcaattacacgttttgcactctttaaacgataatgcacccaagcagtagtgccgcagaaacccaaaatcaatacactgatttcttttctgaataaaaggcaacaaacactgagatatgtgtcacctaggcactgaagaggattgagtgactggaccactatcttctgcactaaggaagacaggaaggtgtgaacatttgagcgcatatgttcacttctcctttttccaaggacaaagatcgagaaatgttcagttgttcactagtgcagagttcttgagtaaactgtactagcgcccatgctgcgttgcatgagttttcaataccgataggccatatacggtactcgtcgtatatatctatcttgttattgggtaggggagcttgctagctaatgttctacaccgctctgtacgtgccatattcatgtcatgatctgtataaaaggacaagaagtttggattggtaggacatgcatttttcttggctctttgtatggatcaggacgagaatgtagtattacagagcggtgcagatcacatagcttgttttctctgcaactgcatgatactatagtacttaggccgtaggccgtgtttagttccatgccaaaattaaaagtttgattaaaattaaaagtttgaagaaaaaagttaaaaatttatgtgtgttggaaagctttgatgggatggaaaagttggaagtttgaagaaaaagttaggaactaaacaagcacttatagagttggggtactcgatcgacgtgtatctgctggcctacttttgagtcaccattccccacctgatgaaatgggtgtaagatgagatgcacttgatagtgcaatgacaaaaaagttaacccgaaagtcttatgttcaatttctaacacgctatcttcttaaaaaaaatatttggagaacgtctccctctaaatcttgttttttttatatattatgggtgcaatatgtagcagttctcgattctatttgatagagcttcggatctagtttttcaagttacataaatttttaaggctagaaatattcaacttattcttaggtaaattcattgggacatgcttctctagatgttccatatctgttttccatcttgtatatgaaaactgtcgattcttattagatcttcgagtaatgtcaaacaggttcaagattatcttttatatccaacgttttagacctggactgttcgtaagtttgtttatccggaaatgtgaaatgcaacgtgtttttaattattcagactaagggatcagatattcagatgggttgatgggttgcatggattcatgtctgtttctcacctcctccgttcccggtggcgtctgaacccaagaaaacaggaggacgacctgatcgatgatgatactgacgagcagagtccaccacgccaaactcaataaaaacatcacacatgggcatacctttcccagcaattcggtgaacacattatcatctaaggtctttcgtctagaaaacattatagtgtggatatttcagaaattaattaaaagcctcctcttttcgcttatgtttatgcttatcaaccaaaatttaaattttcaaccttaaatttgaaactaactttggcttttttttcatagaagtttattttcagcctttacttttagatcgataagaacatatatgtaaaagttttatttataaattactattagtttataaatatgttgtttggcttattccacaaataagcgaaacaatgaggctttatctgatttctctacaaaagattaagtcttagctctgggtttcaggaagtgctgctaatggtgaagagttgttactcttataaaagcataagcatatatactcttaaaaacaagagttattgcttagtatttaaattaattgaatttcacatagttaaaactagaattaaaccaccacagaaacagatcgagttactactaacagtaattaaatagcatttgaccgtgtgtcattgttctgaaccctgaacaatgcgtgtcacactctcacaggccacagacagcacgcatatgcatcaggaacattatggcggttataattaattaattactcagaattaatttaccaagtcaaattctttacacacgcagtaatgcagttaattacagtgttatgccgaatgaattttgttagaactaatgaaccgtatcgcccatgcatgtacacccattcccagatcagaactgagctgagctgctagctagcaaggtagccaggccaaggtgtcacgctgaagaaagcaaaggccaagaatatatctcacgcactgggggtcgccgcgttcacacggcgcagctcaccgcaacaacatcactagctgagcagtgaccacttttaaatacgcatgcgcccactcctcgatcgctcgcagcactgagctcgatcgtgcgcgcgcgcgcacgacgcagcagcggctagtggcactcagagcgcgccacggcgggcgccagcatgagcaccgcgtgtcacggcgttcgcggcttcttctcgatctcggcggcggcgatgacgatcgtcgtcaccaccgccgtcgtcctcctgtccggcccgcagctcgccgccggggcgcgcgtcctgatcaaccacgctgaactccggcggcgcgacattgccaccgccggcggcggcggcggcggcggcgacggcgcgtgcgcgacggccgtggcgccgttcggctacccctgcgaagagcacgaggttaatcaatctcgtcgaacacctttaaacgcgcgcacgcagaacgttcgcacgcacgaatcaaaaccgtcaaatctcttttgttttcttcttcttctcatggacaggtgacgacgcaggatggctacatcctgggcttgcaaaggatcccgaggggacgcatcggcggcgtcaccggcggcggcgcggcggcggcgcggcagccggtgctactgcagcacggtgtactcgtggtacgcatcacgcacgcatggcacctaacattctctctaatccgtggtcgttttcttgccaatctcacatactttcatgtgcttagcaccacgccatgccggtgcacacgtattcgtctcatcatgtcgcccctgtttcattgcacctttcgagcttttcttagctttacagacaactttgtctaaatttaacccaagttcgtacgctttttcgtagtttgggttagtagaatagaatctgtgtccaagaaacctgatttttggggggtcggtgaagaattctccgaactccgtttgggttcacaatatccgttcgatggagaacgtacggacaggatagtccaggatttttagcatctttgaattaaagtttgaatggaattaaacaagcttgaggaattaatatatatgcatggatgcttcttttcatgatatcccagtgttagtctcgatcaatatggaatttgcagatatgcatggcacatggttcggtgctcctgtctccttctagcttctgctgcggactagttgcagcactcatggactttagctagcccatcacttgcatggggtctcaaatccgtacaccgttgtagctagctagaaacatgagacatgctacgagcagtaatacggagtatatcccaaaatataatccctccgtcacaaaaatataacaatctagcactaaatttcctacatccgaatacttatatgtccagatttgttatactaggatacgcctcatccattaccatactgttatattttgatatggatagagtaaaatctttcagaccagttagatatggtattaaaaaataggtaaaattaaatagaaaatattgtgattggttgagaagagaaagcagatggagaaattaaattgtaaaaatttatgattagttgagaaaaaattggtggagaagttgttatattttaggatattttaattttgggatgaagagagtagtccttaaatatgtacagcacggcacgcatcacagttttatattgtcaatttgtgttatctcttgatgcatcatttaaaaaatatcaggagtattaacatttacattagatggtgcaataactctcgagaccttcctaaagattctaaaaaaaaaatctcaaattatatagagtatatatatgttatatcgaacttgcagattatatatgcacaattggtgggtaatttgttgtttgcgaatctaattcttgctacaagttttttttctgctgattgagatttttttttaaaaaaaccgaagccagactaagctggtgttatattaagaaggagagaaaatatttacaaggtcaccagataggtgagagaaacaggggagggggggggagaaaacatagaaaaaatacacacactctaaatgagagctaagcggatattcttgtgatgttttttcgctccacacatgctccatatcttgatttcatcttgtattttgacgagtagttgtgacatggttttctcttaattttgaaatattcttctgtttcgttcacaccatatttccgaaatatgccaccaacaagtggattgacttgagtgctttagctttgctttttcgtctgattgagaattaagtggagtcagagagccgttaggacaatttacaatgatgtttactagtagtaatgatgtaaatgtatggtcagatatatagtacgtatgacaaactaatgaatatacattcatgcaagaatttactcctagtatctcacaatcaaacatggataatagcaagatgcatggttcaacaagaagcaatgataacagttccgtactacactattttgcaatcaaaacatactctccatctgtggtgtggtacgattattgattagtatggctatcaacatcactactctctctattccaaaatcccaaatttcattgtactacattatatctcatcccaatagattgatttattttgaaacggaggaagtctctcttatccggtgtcttcatgcatgaacaatgggcacataaatttcaaaattgtcaaaatacgcatcacctaaaacactactatatttggtcataaatatttaatatttaagataatatttggttgaactttaaaactttgaccatctatttatgttaaaataaatttataaaatctaataagtttatgatattagtatagtacttttcaggataaatatacacatacttctttatcctaattttaaattaaacatttgagaaattaattatagaagatcaagatttcaaaatgttgaccaaaccctgtactaaacaccaaatatcagggaatataataaattgttcgtgacaaaacattaatgctaaaaccgtcccacgttaattagttgaaaggacgtacaaatctaagtaaaaacaatctttttcatagtacacaaaaagtgtcataagcagcccaacaattacatcgttcaatcgaatactccatgtaatgatgtaaggctgcgaaaactgtcactccatcttgttgagctgaaatatctttgtgagtggcaggatggcatgacatggctgctggggtcgccggaggagtcgctgccgtacatcttggccgaccagggcttcgacgtctggatcgccaacaacagggggacccgctggagcagccgccacgtctcactcgatcccaaaagccgggtaattacttcaccattaatcacactctgaatctctttactgcttgctaatcagaaaagatatgttctaacttgtactacaaagtaatcttatatcatatcctagatagcaacaattttttttttgggaataaagatagcagcattttaaaccggatgtagtgatattaactgcaaccctgcattgcaacacggtcatgtacactgaagactgaagtaactgatgaccatctcttctcatgtcagagctactggaactggtcatgggacgacatcgtggtcaacgacatgcctgcaatcgttgactacgtttgcagccacaccggccagaagccacactacgttggccattcaatggtatatactaagctggcaaattaaaggagaattcatcatcatcatcatcatcatcatcatcttactgtaatctgttgggttgaaaacgtagtactctgtttttgttgttgttgttgcaggggacgctggtggcgcttgcagctttctccgaaggcaggatggttgacaagctgaaatcagctgcgctgctcagccctgtcgcgtatctgtctcacattaccactcccattggcgttgtgttagctaaagcattcgctggagaggtaaaaatccatactgaacaaacaatgttcttcatgcagatgctgcaattgcaatgttcttacagacatattttattttctacactgaactctgctctgatcaactatatgttccaaaactgcagctcatctctgatctccttggcatcgccgagttcaacccagcatcgtatggccggcattctcgtgcctttcagacaaataaaaatcatttttacagcttggaatcgtctccggttgctatggagctgacatattggtaattcacttctgtctaatgcaggcctcaagtgtccaacttggttagaacgttctgtcgtaagcccgggatgaactgctacgatctcctcacatctttcactggtaattaatcaaggattagtattttacctacctgagttaatttgctctacattacatttcactccatgctaactcccatgcaaacatgtcaggaaaaaactattgtctgaacaattcagcagccgacatcttcctcaagtacgagccccagccaacgtccacaaaaaccttgatccatctcgctcaaagtaaaccaatcaaattctagtctcatcagtcatcttataccctctaattaaccaaaccaaaatcatgttaatttgatgataatttgatattaattatctggatgcagcggtgagagacggggttctgaccaagtacgactacgtgatgccggacgcgaacgtggccaggtacgggcaggccgacccgccggcgtacgacatggcggcgatcccggcgtggttccccatcttcctcagctacggcggccgggactcgctgtccgaccccgccgacgtcgccctcctcctcgacgacctccgccgcggcggccacgccggcgaccggctcaccgtgcagtaccttccccagctcgcccacgccgacttcgtcatcggcgtctgcgccaaggaccttgtctacaacgacgtcatctccttcttccgtcgatttcactaaaaaaagggaaagaactgaataaatcaaaacaaaatatagctggcatatattcactagtagtgattaagtagctaattaatttggaggtctgagaaaattatatatactagtatagttgatatacagttacatgaaagatgataaatggaaatgggaccaaaattttacaatagaataagatatagagagatggcatttgggccatatcgattttttttaattttttctaagatacttatatgtggcaatgcgggtcctgcctattttaattttattttttttttccaaactatgaatgccatgtaaacgttacataggcgctgcgatacataaacgaccaggtctaagtgctaagcaagcgcctcgtagcatgaaacaataattaaaactaccgaaacctaaattgatcaggttttaataatagctgagtgaatatttatagttggttttgttgttgaaggtcgtaaatttatagtatagggagctgcaatggattttttttcctatagtattgtcatgggaagtttggcccaagaatgaccacccacagtgacggatctagaaaaatgattcaccacccatccccgttgcaaccggagccgccatcaggttaggttgttgccgacgcctccatccaatccaatagaggaacgtcggcattccaactgccatagcagcaacaacaccaccgcgagacaccatccggaacgggaacaccatcagcgtatccctttccctcacgcacccacgtgtcactcctccctcttcgtccacagttgagaaacacctagggattttctgggccttccggctagcttcacaaagtggtgggctaaacgatctgggttcgaagtctcacctcttataattatttgatattaggtcattccctaatattcaatcttttttttttcttcgtccacagttccgacatgaacctcaccatgggccacaaggtcgtctacacgacgaacaagctctatgagttcatccgtaattatgttttagacttagttggcgcttacaacctcaacaagcattcaccgagaatacaatcgtcatctcatagcttactaactactccctccgtttcacaatgtaagtcattttagtatttttcacattcatattgatactaatgaatttagatatatatatatatatatatatatttatttatttatttattagtatcattatgaatatgacaaatgctagaataacttacattgtgaaacggaggaagtagtaagatttgaccgaaaagacagtattaatttagtgtttatgcgtgaattattgaagcaatttattgtgtgaattatgtaaggttaatttatgtgtaatgtatttgaatagttaataccattatctattctatcctattgtatgtctctattatagacacaactaggtgattctctgcactttgttgcgggaatttctaagcaattttcaatatattttttcgataatcgagctaggagttaaaaaaaacaaacgctagagtttatcagtaattatcatgaatcaaacaaatgatacccacgctttaatgtggaacatactaattaatataagttaaatattataaaaaagatatatttattaaaatattgtggaaatgatgtgagagatgacgattgaatatgtttgcatgttgatttatagaattaaatagattatatatatgatgttgcatacttgcatgagattaaatatgcaattattattgtgagtgggtgatgatgtggtatggttgtatgttgaactttagtcttagtgggttgtaactttataaaatgtatagatgactgaaagacaggaaaaccaaccatgcatacattggaaatgatcatcaacaataattgtcacctttgagtattgccgtgtggccgcgcggttaaaaagggtacctataaaaacctagaggtaccgatttttcacaataggcacatttatgttgttataggtgccagttgtaaaatgccacatcagtgtcgtcttacgggtactggttatgaatctaacaccgaattgaaagccggttttcaacccgcaccaaagtggttttatgtagtactgaatcatgatttagaaaccatgcatcaattaacatgacacaacaaactaaaaattaacggagatttcgttttcgtcaactatatataaacaactccctacgtaaaaatgacctcatgctttcctacctagacattattcatgataagctcccaaccataatgtaatctccaagcagcaaagattatcacaaatgcaaatgattggttatggtagtcaatgtgaaactatggtatccttgcaagaatcatgatttagaaaccagcaacatgacagaaagaaattaagctagcacatacgtctatatatcatcaagtgacagtagtggtgaggagaaataaaggggaataaggaagctaaaccttggacagacaaaacctaggttaactcctcataggtcttaattttaaaacctacaaatggcaggttgtcctagctacgtacaatgtactcctttcgtcccaaaatataaacatttttagcatagcatcaagtcaaacatttttaactttgaccattaataaaaaaaatagaaaagatcaataatataaaattgatgttactaggtttatcattaaacaaactattataatatgcaactcttttaaatttaaaacaccttacttttatagatattgttgctcaaagtagcatctcgaagactatgacaaagtataaaggtgcttatattttaggaccgatggagtggtcgacaaagtttgccgtggtaaaaaaacattggctcatagtattacactgcacgtaaactaattaagacctatgtaaagtatgctatatatgacaaatcttaattttcagctcatctaatctaactactcagcacggatgagcattagtgttagaatcatgtgtgatacgtcacgatattatacatatgagttgcgtctgtcccttgagaaataagctttcatattctcaaaaccctatttataatgcacatgaacggtgagaaataagctattcatcttctcgaaaaccctgtttataatgcataaaagtccatttgataagagaaactgcacatctatattatcttaaaaaatgctaagatgatagtagtggtgttgactgtgttcgctggtggggagtttagaactaaactctccgcacgaaaaacggagcggtccattagcacgtgattaattaagtattagctatttttttaagaaatggatcaatacgattttcttaagcaactttcgtatataaacttttttttttgcaaaaagcataccgtttagtagtttgaaaagcgtgagcgcgggaaaagagaggggtgagttgggaaaggggattccgaacacaccctttgttatcaccaccatccaactatcatatggaacccacgaacaatgagaaaagattttatctgtccctatgaccaacttaacatatacttagaaagtgacaacaaaattagcattacgataatttattagacaatatatttttatgtacttgaagatatatgttatgatcttttttttaagaaaaaaacgtttcaacgcattgatagtatgctattaacataaaaataggggacggatatatttgaaaccatgcactactacagaaaccatctttgctgggttgaccaaaaatcacaatagtcccggtttgaatagaaaccgggactaaatatgattttttttcccggtttaaaactctatcagccctagatgatttttagtctcggttcattttctgtccgaggctgttagggggtcaaggatttttagtcccagttggtgtgaccaaccaagaataaaaattagtctttagtccatatatagtatataatccctaggacttatccccccaaactcctcatcttcctattcctcctctctcttatccttttctttaaagccgaacttatcatctccttcttcctatcggtgagagcagattgaggagcgagagcgagcgagtgaggccggcgccgggagggcaggcggtcgggcgggggcgggggcgggggcgggggtgcggactgcgggcggcggcgtggccgcgtggaggccggccagcgaggagggctgcacggcaggcggcagcctatggctctaccgaagggaaggcgggaggcgggaggcggcagcaatggatatgtgattttttgagaatttgtgattctggatctgagatgtatttgatttgtgtgtgatgcgaatatgtgatgtatttgtgatgatttttttagaacttgtgatgtaatttttttagaatttgtgatgtatttggagatatccttttgttttgtgatatgtgatgatctatttaggttttcacgatttggggatgatttagggatggagtgaaatcaatattcaatgttaaaaacaatgaaaaaagaaaaaaaactagcaatcggacctagcctggctccatctttagtcccggctggtaatcccgattatttcacccgggactaaagatgatcccggattcgtggtcctggttacataaccgggactatagggggttatcaaccgggactaatacccctttctccagcagtagtgggatgtgtatgcagatatacgtacccatctatccagaaaattttttcattattttttttcttcgaagtgttactttttttttctcaaagcatgcatgctatgttccacagcaggcgcacttgggtaaaatagacatatcacaaaagtgcaaaacgtattagattgctcccatacctgtttttaatttgcaatccacaggtaaaacaagcggtattactgttgttaggcctacttcaaaaataagtccacatcaaattctttcttttgactaagataattaagtcccacattcaaatctaccccgtacggcctaactgcatgttgcattattgaagcctttttatcaaccaatcaatcaagataattcctagcaactcttgttatgtgataatttcatattgttgcttaatttaaagtacaagtcaattagggaagtactagttttcaaaagataaatcagggaagtactattgaaacattttataatactaacaatccatattgcattttctgctctacaagaaggcagtaccatgatggcctataaaagggttaagattgatcataaatggagacaactcaaacaaaagaaacaaagcaaaccacacacttagaagatcatgtggagtggcaagaaggcagcttgtatggtggtggccatgaccacaatactgattctgcagctgacagtaacacaggtagtattggcaatccgctcaccacaggaggtggaactagatggtttcattactacggtaaaatcagactgccttactgtctcccaaacggaagtggatcaggcttggacaccttgcggggaaacttgtcttgttttaccatgttatacagctcggattggctgtctatgtgttaacagcgtatgtatgctacctgtgcctgcgaagtctgaagtcattgcatgataaccgtccgtccgcctccggagtcagaagtcattgtattccatgatgccagacttgccagtcttgtctagaatgttttaagtatgttgtttgcttataattaagttgttgttccatgccatatgtatgatttgctggggggatatggaaaaggttgttgtacactatgtttggtgattgaatataggggacgcgatggatgtgtatgagttgattggtgcaccttttgtctcagcaaaatgtaactttgtcattcaatccgtataagtttgttaccaggagcattcgattttttttttaactggagtattcgttgttggttatatatatcttatacaaaacaaaagaagcaacgctagccatgaagtggtatagaactactgtgaaaccaatttgtgtggtttttgtttttgatggaaaattggtatttatctgagcttagattggttttgaaatatcggaggagtcagcagggtttacaaattcaaagaatggatcatgagtgcatttgcttaagaatccaaaaatacaaattctgaagaatttttaaaagccaagagtttgtcagatttaataaaaattgaaaacaaagtgatcttgagctacaaacactagacaagataaatttaactagtcaggaagctactgtagtatttgctcaaattaataaccttctttgcttgttcaatttttttaaggtaaagagagttttattgattttaaacaattacatcgagttgatacaattaaaaaattaaaaataagtactccatatagttcctcttgttttctcttccgcttcttcatatgtctctctttacttcaatccaacaagtagcagacaaaggagtgaaaccatcgaccagcacatctcccctcgccaccccatgagtaagcatatactccctccctccgtccctaaatatttgacgccgttaactttttaaacatgtttgaccgttcgtcttattaaaaaaatttatgaaatatgtaaaagtatatgtatatataaaaatatatttaacaatgaatcaaatgatataaaaataattaataattacttaaaatttttaaataagacgaacaatcaaatatgttttaaaaaattaacggcgtcaaatatttagtgacgtagagagtatatccatccaccttccaagcttccacaatatggaagccatggctttgcccgagctcgccatgcatgaagtggagagctccacgatctttctctctccctccctttgtttcagaacagttaataactatgtcatcctcccctcttggcctcttctcaacccttcttcaccggaaaaaacaaaaagagagaacatattctataccactgaatttatcataggttaataacttaccattgactttctctctttctatattatactggcgactttatcaattgttctacaatacactattaggctgggcttatttttcaataatagcaaaaatacccttatggacatacaagtataacaattgatttatatcattagaagttttaaggaaaaaataaaacttttatgtggcctccttaggtataaaagtttgtctataagtttcaatttttttcatttctattttttaaatataacttatttgttatatgctatataaaatatttttgtgttgttggttttaatttaaattatctttcatatgcaacataagatattttttgctattttcttttgtgtaagctatttctctctgatataccacacaaaaatatttttttctaaaaattaaaaataccaaaaacaaattgaaactgatgtacatacttctctgttatgtaaggatgccatataaaatattttatatttttttgaaactttctaatgagataaattaattgttaaccatgtatatctctaagggtattttgggtattttttgaaaagaggcttatcccaatggtgtattgtagaacaattaataaagccgtcggtatattttagaaagagacaatgtcaatggcaaatcgttgaactgtaataaactcagtagcatagaatagattcttaaaataaaatactgccttcaccaacgcagagccgtatctagcatattgcgagattgttgcctcaaggaatgatgaggattaacttgtaagcatgtttgcaggcagacgtgtacaatcatttctctctctttttttttcagcctttggctacgtaactaaacctcttctattaatactagtaatgtgcccatgctaacgctacggcgatatttagtaatgacaatatatgtgtgagcatgataatcaatttttggcagattggcacggaaggttcgccaccatgtggagctattttatcaaacgaccacaagtgatgaagataataataaatgcacatataaaaagatatgatgatgacaaagttcattttatcacggatttttctgcttaaatagtcttaataatatcttgaaatgttcccatttgctaaaaaggggagataaccaatagaaaataaattaaaaatatatctaaagagttttaacaaacacatggccagtgggttgttaatattacatcgagaccaagcattttacctaaaatatggtttgtcattttaattaaaggtaacttgcatcgatgcatgcacaacgcagattaaatcatactcccttcgtctcaagaaaaggcaaaccgtgtgtttccgtgccaacagcaaaccgtgtgtttccgtgccaacgtttgactgtccgtcttatatgaaaattttttataattagtattttcattgttgttagatgataaaatatgattaatactttatgcgtgacttatctttttaatttttttcataattttttcaaataaaacggacggtcaaacgttggcacagaaacccacagtttgtctttctttggacggagggagtatacattaagccttatctccaaacaagatgggtagcagcgttcagtggcagagtcagatgcagagcaatgattctctctacaaagaagaatcacacatttgagatatgcatatccatattgtccacttaatttttggcatgcaactgtgattcttcattcacaatcagatggagcagaaaaggtcagccaatccctaaaagttttctatactatataaacttgtgttgtattgcataaagtcccatagaccatagtacatatgttcccgtcttcttccattttttaccaactcctcaattttcaacacaccttgctgtgaaactttgctttagaattccttctaaacactgtccttttttttttgtcatcgggaacccacaagagttctttgattggtatacacttttctgttatcactatctacatgtgtacttacaacacccaactaaatatattgattatatcaccaattatttttttatcataaaatattaggggaagcccctacgtgtattgattttataaggtttatttacaatgtctcatcatacctaactataattaaatgtagacttagatcctccttattctacaaatgaaaactgataacacggtgcttaaaatgctgaaagtttagtttattgtgtatattgtataagattaattagaagcacataagatttaataggcactactgaaagctgtagcaaaaaggaattagtttgacagttccttatctttttaaatgcacaaaagcaatctgtcaaagacaaaggaaattccttttttttcttgtttttcctcttgatttatgtaattatgtcaggtcattactaatttgtatctgcaataatgtagttcccatattttggagatatacagatagggtcctacaaatagaacaaatcttcaaatagagcaatcatattgtatacacctaatagatttgtcgtcgatattatttacataaatatcattcagtttcagggaaatgtcaagtacagagaatcattaagagcttgtttttcagttgtaaattcagatttcagatacattcaaaatgatttaattttattcttttacttaaaaaaatgatccatcttataatgctatcacaactattttatacgctctacaagggtccatatgttacttcaatataaggatgcaatcatgaattcatcatatacaatacctctaagtgattcaccagtgatcccaaccctacaaggatcaacatcctcccattcactgagatgatctccaagctttatcaagtcccacacctgaagatgtccaaatttggcactgcagcttatactatacctgtgtatcaagttcaaactatgatatatcagatcataacatcagaaacaattgtttgagggaggcaaaacaaaatagcaaatccaggattcaacggaaaatcctaatacagtagagcgcaatgatgctatttcgtctgggctaacaccagcatccatgacttttaacccatgaacagaggcagaccagctcaaatttacagcatattgtagagtctgattaaatattttggatacataaactcctgcttatatcccattcctccaagctgattttagtgcctgtgtttaaaaccatgaaaataagaatcaagtcaaataataaccatgaatatgattttcaaacaatcatgaaaggattttgagtataatacatctatgtaagtgctgttcttgctagctggccctttcaccgtgatagcaagaattgatggcaacatagattttttttaaaagcaacaactaagagtttttttacctcaagcagtggaggcagctattcgttaagtttcagaagaagcacaggtacacgcccttgttgaactaagtattggggggaacaatatctaattctgtaacttaggaaatgagctgatgaatgaagccaaggaagtgtgcattgtctcccaggttatataatgtaggtacagaatagtgcatgtgagcctggatatcacaatagaacataatataagcatcaaactgtacacaggtggccttttcaggaagagtcatggctagaatagcgatgcattattcactccatgagtgaaattcatgaatttcatatatctttatccaacaaagttggtaatgaaaggtacatattaagacaataaccacattaattatttgtctaaaattttaagcaagaaaaatcacaaccaaactgttatgatccattttactttggttcttctacaatctctcagggtggctcaaatcaaactcaccacaaagaagaaaataaagtgcttgtagcatccccttcactaatagtgatcgacatagcaatgtatggctatgtacctcagtaataaggtagaaattttcttcaaccagcttctcgtggaagttcctcacctccttcctcgatcatgattgcatggcctgaaattttgcacacataactaagagccagtgccaacaaccctgctcttacgaaaaatccttttctccaatggaggatccggacctcgctctgccccatcaacggcatcccctggtataacgaattaatggatccttcaccggagccccttgttccaccgtgagaggcactggcatgaacaaatccaaagccaaacccagccattgatcaggacactcaaaatcgtaatcccagttgctaattaagcggccactctgtagattgctcacactactccacatggcagagggaaaggaggagaccttggatgttacagcggcggctgaggaggacgtcgaggaagttcgcccagagatcggcgccagcgccagcggcctccgtttttctctctccgccgccgtggcggtggcggtgaagtgggagtcacaggtgttgaatgtgccgtttggcttggagcagcggcggtggacttgccactcaaccactaactccacagaggtagcgctggccgcacgacagcgacggtgggttgcccgaggaggagatcttcgcgtctacgatgccggtgaggaggatgcgatattcctggcgccggcagggatgacccatggcgatgcgcagcatggagggctgcccacagcgatggggacgacggacagagggttggcgttccgatctggacagcgtcaccggtgagttggctgaggaggagatcttcgtgtcccgtcggcgcctcggcaatggcgatgcttctgttcgagtcggatcgaggggcgcggtgatgacggcgatggtgaccggcgtaggggcggcggactggacgacagagatcgcgatcggtgtacgggcggcgtggaggcggcgaaccagcgaggacgggaagatccaaaggggagagggaaagtgggaggtgcgtgaaggaagcgccggtcgggatcgcgtgacgaggacagccggcagccggcggcggtgaagggagggggtgcgggaagaatggactgggtgggggaggacggcgatggcggcgctgggtcggcgacgtggtggggggacggcgatggcggggaggatggaaggcgacggcggtggatacgatggatgcggtggatgcgggcgctgagatttaattggacgcagcgatgagagatggcgtacgacatggcggcgatcccggcttggttccctctcttcctcatctacggccggcggccccgccgaggcgccgacgtacgtcgccctcctcctcgacgaggccgcagccacggccacgatggcaaccggctcaccgtgacctcgtctacaacaacgtcatctccttcttcggtcgctttcactaatggccggtttggttgaggggagtttctaataagggattggaagtttgcagggatgaggctattaactgttttgtttggttaggagatatgaaaattttggtgggatagggatggggaattaataaatgaactctctcctttttaatacctgggtaggggctagtaattgggacttgggagggaatttctcgtttactttgcctaaacaaatctcaaccactcgttttcattaatgacctaatctccaactaaactccctatcaattttcaccacctctaccaaagaagatatcgggattaaaaattaaattctcatcttaatctcaccataattctcttgtgtaaactccaaatcatcttccctcaagttaccaaataagctgtaagctcttgatcctaatatcccatcattcagccacaaaaaggaaagaggaaaataattgaagagactaaaacacaacatagttggtattcactagtgattaagtagctaattatattttttaaaattacacagtaaaacgtagacactcacaacacacgcacactcacccttatgaaggcacgcacgcataccctacccctatgagcatcttcgaagactgggccggcaaatactagagattaacgaagtcaccatagccacctcggtgtcgacggatacgccgtctaccactgaaagcacaatgttgttaaatcctggaaaattcgcacctatggagagtcgaatctataatctaaggtgttacagaggctgaggctcttgtaatcattagactacaatcaatttgagagggtgagaaaattatactattagttggtgtatacagttgcatgaaagatgataaatggaaatgttaccagttatcacttggacgatcgtcctactgtgaataattttttacgaggaaaatgtccatcatggctccatcaactattggccaattttagtttgtatattatttaaccataaaatcgggtataccatctcccttaaatattaaaactgcaaaacacaatttgcacaggtatgcccaaaatagtcgaggaaatcattttgcgctatttttatatgtttgttggagatgatatacccaattttacggttaaagtatatatatcaaattcgatcaatagattttttttattacacggtaggcgtacacgcgtaaacatcactacatacataacaccacactcacacccccactctaagaggcagaaaccagtagtatatccctgatttcactaaacctcttgaaacttgaaaacacaccagcatgttcgtattatttttaggcaccagaattcgttgaagaagttaaaatggaacttttggcttttacaatagattacactaattgtgccttgcgttaattgaattagcacgggaagctcggcccaagaatgtaactgggccacccattcccgctgctaccagcgccgccatcaggttaggtcgccgtcgcctccatccaatccaatggaggaaccccggcggcgtcccgattggatcctcttggacaccaccgccgtcgccggccgccacagcggcagcagcaccaccaccaccgcgcgtgagagacagccggaggcatggattgctgctgttgatatgaagaatggctgagtgcaagctgtggagaagttttgtgatttttttttgccggtatgaccaaaggaggtaattcaatgtaattaagataggaagaaaaagttacaagaaaagttttacatcgacaactggttgtcgagtaaggatgtgcaccataacacacgccccgaaccatgtgccaactgcccaaacacacgatacagagagggaaaccaagcaccgaacaggccatcgttatgcgagaccgatcgccaccagaccaacaacaccaccacgacaagaagactctaaaacgacgccctcataagggtcacgacgccgaaagacgccatcgtcatctgtccaaagaactggacaaggtttttacctagagctccttgcccaggggtacctcaacaatgccctcaggagggttaccacgtgtcacgccctgaagttctcctttttagctttaaaatttgttaaataaatcgcctaaataaattgttgaattaacctagagttgaatccttaattaataaatgcaaataatcatcggaatcggcatgtgaaatttttcttggattctacatgtcaaaatatgctaacaggatttttagtggaatttttagagccttggaaataattttaaccaattaaaataagcaaagtgcaatattaaattcctaggaaaatcctttttcctttttatcttttcttttccctcctttttccttttcttgggccgccggcccatttcttcccgcgccggcccgctcctccctcccactcccgaagttcacccggcctccctctccctctcgggcgctgacaggtggggcccacctgtcagtcctttcctcttcctccatccgcccacgccggcaaccgccgaaaccgcgcgcgctgctgccgtttcccgtccttcccgcgcccactcctccccactccgtgccgcgcccacgtcgtcgccccctctccgctcctcccgctctcgcgcgtgccccgcaagggcggggtacggtttgaatcccccctccctctctctctccacctcccacgtagccggcgaaatcgggagcaccccggccacgtccgccactcccgagccccaataaagcttccccgcactcccttccacctttttcctctttccaccgctccctctcgtgccctctatcgctcccgcgccgctacactcgccgctacactcgccgccgccctcctgccgcgctccggctgccgctagccgtcgctagccgccgcgccgagcctcaccgtcgacgccgccgcattcaccatcccatgagccgtcgcgtccaccatccgcccggcaaatccaccgtcggggcccgcttctccccgcgcgccggtgagtaccaccattgccgccgccttcggccatggtttccgcccgccgtannganccacccctctccctctaatccttcccattttgttccctagaaggtcccggagatcgtctgcccgtcgccgtcgtcctcccgtcgcttgtcgtcgtcgttcgccgtcgtgtccactcgcgccggccaatctcggtgagaaactccccctcctccctctttccctctctctcgtgtgcgccgccgtcctccgcgcgcgcaccatcgtcttcggccaccgccgccgcttttcgcgccgtctgccgtcgccgtccgcgccgccagttgccgtcgccggcgaccgcgcgtgccgccgtcgctcgccatgcttggcctgccggctttgaagccgagccgagccaccagccgcgcccctcccgccttgtgccactgccagtggggcccacgtgccggcgcccctccctctctctctcttgagccgctgacccgtggggcccgcatatcggcgccgccccctgctgacgtcagccctggggcaatattgcgcaataaatacattaaggcttttctttaatagtaaaaacacagagaattttctaaaaatcataactaattcatccgagctccgtttaagtccattcaagtctcagtaaattcataaaaatgcatagaatccattaaaaatggttttgtttcctgttttagtagtcttatagcctgttttgcttgtgtgctttgtttgtcgcgtagatttcggccgtttcgtcgatccacggtttctcgaagacgttgctgtggtctcatcagtgcgagagcaaggcaagtcatgcattataattgatcatattgtacccaatttacaaatgtcccgcttttctattaaatattgcatcgttttacaatatcacgtgggatgagtcctactactcagccatatattgtttaccttatgccattgctaactcgggtattaaaatgactagatgttggtttgggaaatgcttagccatgcttagttctactagtacacaaaaagggaatcacattaaagcatagactttaattattggcaatagctttggatcagtgccaccgtaatggtgttggcttattaaaatacactacacggtgggctgtgggtgcatggttttgctagttgtgcccatggcgattaaggaccggttcgcgggaaaccctggaagaatttatcgtgcttaccacaagccagcgtgggcaacggctgggcttgtagtgtagcttttctctagccgacgtacccaggcgagggtgggcgtgatggagttgggtcggccgaggtgtccggttgatcggcttctggattcactgcggcacgaaaggggggctgcccgttgcctgctggggacgggggcgaaccctaaggtgtggtgcgatcggttagaggggggttatgcgaagggtcctgtcacggcctctttccggtatgtcgtggtggcatgtcggcgcacggaaacgtgtcgtggggttgtgtcttgtgggtacagttgtacacctctgatcagagtaaaactattcgaatagtcgtgcccgcggttatgggcgatcgaccagattcaccgtgattagtctcacccctagtttagcttaatgaactggtgtagttcaggtggttggttgggcctgttgcaacgtggtgtagcgttggacagtgacgggttaatactgcttaattactacaactgtttttactgttttcaactactggttttaaatgcctgctttatgcaaatgaaccccgtaacctcttttggttatatcctgcatcatacctcctcttccggtatgacttgctgagtacagtgggtagtactcagtcttcctctcttttcccccacaccagagttgaagtccttctcagttgaagatgtctcgaagaggttggtttcgtcgctgccgtcaaggatgcctgtggaatggagtcgtccgctgcaggagtcaagtcttcaggctcagctcgcttttatctttttccgctgcatttgtaatcttttatatttttgtaaaacgtggatctgtatgtcaatagttgtcgtttgtgtatcctggctggtcctggacaggggtttaatgcacattcagcttagaaattctggttcgtgaatttctgggcgtgacaccacgcctgaaggcgtagccactgttggcccaaagaaattgcgctaagctttcactcggaacccccaactgccgtggttcgtcgcccaatccgaatccaccatctaaacatcgcgtcaacagtggcacatggcttccgccacacccgaccgatgcccttccgccagctagcttcgagtcctgccaacaacaagactgccaccacaccgcaccgacgcccctccgtcggccgacttcatcaaaccgccaccctgagagctggcccggctagcttcgagtcctgccaacgacaagactgccaccacaccgcaccgacgcccctccgtcggccgacttcatcgaaccgccaccctgagagctggcctggctagcttcgagtcctgccaacaacaagattgccaccacaccgcaccaacgcccctccgttggccgacttcatcgaaccgccaccctgagaactggcccaggacccctccgttccaccacccgccggccgcctcgccaaatctggctgaaggagaacccgggactgggtggcactgcttcggtaccctgagcttcccccgctaatgagcagccacctcaatccagcctagaaactccccgcaaagaaggggaggagctccaggaaaggcgagggtgccgaccggcaacgaggaagacgaccaaccgccgccagctccctttgcactgccatctggccaccagcgcccccgtagcccggccgccgcacctcacgtagccatcgcggcggcattagcaaaaacggagcaagaggccgcacgccggcagtagcacccatggtgtgcacgtggcgggcgtgctctaccgtggctgagaaggacaagtagcagagggctagggtgccacccctagccgccgaggacacggccggccgccgcgcccaggctgcatcgctgagccgccgctgccctccgctgagccgccgccgccgcccccagacgcccaccgcgtccgcgccccgggctggccgcacgccgccaccaccacggccgcacaccgccaagccgcccctagccgccgccgcaccggatccaggcgagggatggccggatccgggctttggggcaccggatccgcctccctacacctccccgccgtcgccaaggacaaagccggtggaggcttcgtcgcgcgccctgtccacgtcgcgccgaggagtgagtcgccgcgaagaaaggaaggcctcaccgccggcgagagctccggcggcagtgaggtggggggaagaagtggaggcgggcagctagggtttcgtcacccccgagcagcccgcgcgagagcgaccgggggggaaaatatccgtgaagttttgtgatcaaagacagctttggttcagctatcatctatcgccaagtatatgaatacagatactacctcaggtaattagttagttagtttccccgcaaaaaaaaattagttagttagtttattgtattatttcttaaagaaaatgcttgctcctgcctcctgtgatttgcatgaaccatctatcgcgttagtatgatttccaagtatatatgagtccatattgtacctggttagtagtttattgtgttattgcttcaaaaataaatgcctacgcctgtgacttccatctgctcagcttgcttttcaataaactttttatccattacaattagtaatgcgtgagaaacacccatggttttctggctaacttgtggtaagctcattggtctggattcgaagtctcaccccttctatttatttggtattaggccattccttaatattcgtcgttgcacctatcagtgaaaatgcttttgttattatctgtttggttattctacatctctctctccaattgttcttttaatatttgcaatgtacccattggtaataatttcgtactgatctatggtggtagagagttaccatcaccacctactttttaaaaatcttttttaaaggttagtgtcactacattttttttatgcaacaaaatggcgcaagatagcatgttgcttgaattaatcgaccggatgatgaagcgaagttatatggtaacaaactaacaattgcagttttcttcttgagaaattaaaatccttactcgctgatttgcaaatacttgtggcatatatatacatgcaggggataacttttataaacatacaatgcaaatatttgactgcatagacattgacacatattttaaaaaacgcacgattacttatggagaaggaataagtctaggaaaaagtctaaatatccccccttaaactttagatgaaagtccgtttaacaccataaactttaaaaccggacatcatccaaccccttgaactttgttatgccatccatataccccctaaggtggtttgggttttggatgatggttttgcatgttttgaaagcttaaacgaccaattttgaataactaatataacttatttgcatatcatcagttataagtcattaatttatccttatacaatgatatcatgctattattaagttggtacttgtttataagtgagagccaataagaagcatgtgatcaaactcatccaacttatatacaagttagaaaaaaaaaccactatgcaaaaccaccttaggagttatataaatggtattataaagtttaggggttaaatgtccggtttcaaagttcagggtgttagatggacttccatccaaagtttagagggttatttggacttttttctaaagtctaatataaacattttacaacttttgtaggttcaggattccacacttatcatattaagtacaataggcactttgtgttcatcttaagagttaatattaaagtattaatagtattaaacgctcccagcactataccaccgaccattttgtttgtgttactaaaaataatagagccaacaggcccaattgtaagaaaatcactcgactctttgggaaaaaaactctaaattgggcccatatacttttggtatgatatatttgacctcattgctagctttgcattcctcaattaacatctttcaactttatttttagtttgcggcacattacattataccatgtgtgatgtgtctatgtgtttcaactccgccttcgatggaaaaatggttttataaaaattggtattatatttctctactacccacattcatcgtctcaggaccaatctttggagctccgtttttacatcaccaatagaaagttactttctatcacttttatcatagctagctgctttagacccatttttattcatctgattcgatgaatgtgggatgaagtagaaccccagggtttccaccacacatagccacaaggatttgccataggctttacttaatttcaagaattgaatcttgagatctatgagtggaatttggaagacacgaatgctcacttctccttttccaaggaccggagaaatgttcctagatcttgagaagccagataactgtacttatccactgtactgtgacataaaataaaattatactaattgggccttgcatttattgaattggcatgggaagctcagcccaataatgtaattggtccagcaccaggtaaccatcaaagcccacaaattttcaacttgatttcttacatttctcgattgtttttccttgatggtccccatttgtgatttataatattgagatttatggtgtggtagagttatcaccaccttcaactgaaaaagaaagtttagcaccgcctatatattttcaaacaataaaatgaaagaagagccatgttgcttgaattcaccggacactgaggcgaataagttatctggtaataattgctgatttcttctagagaaatcataatccgtaccagttgattggcagtactttggacgcacacaatatttcacaatgacatagacatgcagatgataactttttgacacatacaaaccggtacaaatgacagcatagagctgacacacacatattaaaaaacacaccacgtgattatttatggagaagaaaaaccttatattattatatatatcaagtctaatataagtattttatgactagccttttgtaggttcaggcctcaaagcttttcaaattaggcacatataaacacttcctattcatcttaagagttactccgtctgtcctaaataactttattttttatctatcccactcgtatcaatagaaaaaataaaatacccctactttattaaatctcaatgcaactaattctcactttatttcattcagtataattattttccactttcacaaattttgatgcgatgattagctaaggcatgttcggctggcagggcaaccagctacagtagcaagcaacacagccgcgcacaacatacatcgccgcagcgctgccacataaacggctaccaaacaaagagacagaggacgtaagattatagatttaaacagattatagatttaaacgctcctagcactatgccaccactcttaaggctcctttggattgaatttttttttaagaaaagtagtaaaaaccaattaatccaaaaaaataactcctatgtatgttacttatttggtatatagaattaattcgaaggaatttcaaaggacaggaaaaacttctccaaagggtgcctttatatttcttctctttgataattggcatggatctaattgaaaaacagttggaaaaaggaacccatatggatttgccactgccagccataccacgtagtgtaattaatccattgaacaaaactagctgactccctcgatggtgacaggtctgaagaagcttggattaataggacagatcacaaaattgttcattggaaaacttgacctgacatgcattggtataaggcagatatatatttaaaagtatatatatggcccagctaaatcttctgataggtgatggccaactctaaaaaaatgcagaaaactcctcctttttcctcttctacgttaacaaaaacatattggttgtgtgcccaggacggtaagcgaaaggtacttccattattaaaaattaagatactgtttgtgcaatcatgttattattaatctgagcttagtgggcttccttaattgtacatgtctctcttcattctgctgcatcaatgatatttatgtgtgtgacatgtatgtcgagttcgttaaccaactcgtctgcaatggaattctgtgacgatttgctcgtggagattctctcgaggctcccgttcaagtcgcttgcaagattcaagtgcgtctcccgctcatggcgcgcgctcatctccgcggcgacctccgccgccggctcccgctgctcgccgccggcttgttcgtcggcgacggcggcggcggcgagccgaggtacgccaccgcgtgctccggcgatggtgttgagttctgcgacatgagcttcttcccgctggcggagacggcggcgagggtcgtcgacgcgtgcgaggggttgctgctgtacaggtcgctcgccgcggcgtcggcgatgtacgtcgcctgcccggcgacgaggaggtgggcggcgctgccggtgccgcggagggaggcgcagctcccgctgctggcgttcgacccggccgacggcggcggcggctcgccgcgctaccacgtcgtctgcttcgtggcgtggcaggagcgcggcgccaccgtggacgtcttctcgtcggagaccggcgcgtgggcggagcgcgacgcggcgttcggcggcgtcgaggcctcgtcgctgtcccccaccacgcactaccgcggcggcgtcctccacgtgctcgcgtacccggaccgcgtcgtgctcatggacctcgccgccacgaccacgacgacgacgtcggtggcgccgggcaggctcgcgccacggctgcccgacgacgtcgacgccggcgcgcgcctcggccactcccgcggccggctccactacgccaagtgcgacggcgagcggctgagggtctgggccctcgacgtcgacgccgcctcgccgggctcatgccaatggatcttgacgaacaccgtctgtgtcaacgagatgaccatcaatggcgggctctgggcggcaagcgaggtcaagttcttggcgttccacccggacatggccgacgtggtgtacctctcgtcgccggaggggaaggtggcgagctgtgacatgaggaggaaggagatggtgagctcgtggaagctgggagctgagcaccatgtcgtcaggttttggttgcttggtttctcctcgggtttgatgagctgcctgggtggcgagcaagcatgccagattgccggtgctagctagctatagtatactagtatattttttttctgctatttcttttccatttgaccttcgatttgattgcttcagaactcatatatcaaaacgcagttttgaagaaaaagttaaatggatggtggcggcgtgtggcaacgataacataagcccttttgaattgtgctttggtttgggtcggataggtgttgtgtgacttagtgtttcttggtggagttggagttgccgatcacatgggtgatggtgtgatgataataacgtcgcgtttttgccagtgtgggagttttgtttacttcttgcttgttgcttggctttatcgttcttgtgttgagcagcattgttaagtgttgcgcttgcctaaccttgcttcattgcgttggcaggttaagtttcttggagtatttgctgctgtagttttcgctcaatttttcttaattaattatctgtttttttaaatgggacatcttcttcttcttatatgtaaaacatcggcaatggtctgtccgttcgtaaacaaatagtcaattatttatcaaagttcatacatttcagcagtgttatactcccccttataaaatatactatctccattctcgtccacaagtgaattgtctttgtttttaaaaaggaaaaagtacgaattaccccccctccaaaaaaaactagcgcggtcgtccgaattaccccctgaaccaaaaaaaccggacattcttcacccctatctatgcaaaccggacgaattacccccctcgacctaatccacaatggttttggtctacgtggcgtacgcgtggcagtccagtcagcattttatttattaaaaaaaatgtgagacccacctgtcatactcctattccactattcctatctgtcactcttcccctctctctctcttctctctctatgtctcactcaggcgcacggcagtaggcgggggatagggagcggcggcggcagggtgcggcggaggaggcgagcggcggcgggagctcacgctgctgttgacagaaaacacgaggcctgggagatctgcttaactccagtgcaggtccaaagctcgccttcgaatgtatgagcgtgccagttgatttgatcctgtaaccaacaagaaatagagacaaagaattcgtggttaaatctataaatgatagccgatcggctaggtgccgatgacaatcatttatctttgagccgatgtcatttatgaatcgatcggcggttataaatagacagtaaggaactaaatctattcgatcggctgtagatattaacgatatatagttcttatattaatatatacttaaatcaagtgattggaatagatcggtcaccatgccgagacagtataaatcacttagatcgaaatatatattaataacaggattatatatgtttatagcatagccgatcagatagatctagcatgtatcagctaatactccgatactactctatataaagatatcaaaacaggtataatataccaaacaaaagcttaatatacttaaatgcaataagatcttgacataaagggcggatttaacatgtcactgaagcatatagatcgaatatggttaaattagataagatcggctgaaactccgatactaccctaatcggcaaccagatgacaggctagagattgatattctaagcacgacttaatagatcaaactcaactgatgcagcattaagtatgaaaagaagaacaatatctagacaatcaagccgttgggtgtttcataaagtggcagatatcttatataatctaggacaacgtcgctatttaacctaatcggctgtcttctattaacagatgttagccgattgtaggttagatgacaatattgccaaagattatgtaagacatatgataactcgacgaattatatagacaagattagagtgtcataaagatggaagtactcatctcgagaacacaagtcgtcataacaagttttacctcttgttgaagatcgaaaccgatgcagctcaacccgaaagcaagaactcgtcgaaacaaaactaaagcaaaaaggtggcgatgcgccgaaattgtattgaacatgtgtgtcttaaaaattacatagggctcggggtctatttatacccgagaattacaagatatgtccataccggacacgaccactatctctaacaaactctaagataccataagtctttgcggcagacttttgcccaaatatatctctaaggaagttacataaaacatcctaattaatagatacaattgccttcttaggactctatccatgtgcggcaatcatcttgaagcacctcaattcaacccgatgtcatacaccaaattacactgtcggaatcggctgcatcggcttacctagtccgactcggacctagccaatcctaaccgtagtcgatctggacttcagccgattcttgctctattctcggatcaagctccgccttcgactccacctcgatctaatctccttttccgatgctgatattaccaaatttggtcgttaacagctgctcaaggcaaggcgaggcggcggcggcg

SEQ ID NO: 79695 - DNA, 24988 bp, Oryza sativa
cgcagccgcagctgagaaaatgacagcgaacacacctattagatgtatttggtcaagacacgtagggataactcatatatagggataactcatatatatgtataattagtgatagataattaaagggctatgcattgggtccaggcgtctaggtataactattcaataattggatcatactttgcgttttactatgcaatatatgaatatatatgaataaagtattaaaaatgatggatagacatgtagaaatattataaaaatcatgtgttggattaatagtcagtaataatgggtgcacgagccccctctgtactggagctggaaacattacatttggaatccaagaattatatcttatatacccactaaatagcaattctgttttttttttcgagccaaggaaataatatttctctccttttttgggaactatgtaaatgtcactttactgaatttttatttgtggttcgaatagaattcagagatggagttttacaatgacacatttaattttagaaaaattacaatgaagtcatttaattttaccacttaagtattaatccaacaagcaaaatagttcttaattagtggggaagtcatgtggcggtagagttatgggtgtataatttcactccaccaggtttaaatcccagtgtctagaagtattacacacataagtgggtttttaacataaatttagtgagataagatatgtatagttgttttatttttataaaaaagatcgttgttatacttcaagctttcaagctctgccactcaatccaagtatagagtagacatatctgctgggtcaaatatggcaaattaagcgaaacaaaacgagtaacatttgagaatgaccagaacgaatatataactttacataataaatagatacatacatgtagataaagaacaataacactagtggattaatccgttcgatcacaaatatatatcatttaactttttttaaaaaaattgaggaagtacgaagaaaatagaaaaaaaatacatgttacttgatggaatataaaaactcaacccaactttttagaatactaaagtttattttcattttttattttcaaaatggtaacttaaggcaacttatcatttttcaagtgtgtaaaatccattgcgggcgcaccgccactcgacctacgcgttgaaggcggtggcagcgcagcagggtagcggtgggcgcatgcattccaggggttgtcggcatcgggtgcagagtcacggagcgcacgccagacgttactgcaagccttgaagccggtgccgaaggcaagcatccagaggcggtcaccggcacggacgcgacgcttggcctcaaagtaggcgagctcgtagaagacgaggctgctcgacgtgttgccgaacctatgcagtgtggcgcgcgccggctctacgacctgtggcccaaacgccatcagcttcaccaccgcgtcaatcaccgccttcccgccggagtggatgcacatgtgctcgaacgcgcgttggaaatctggcacaatcgccgccacggcctttgggttcccggcgacatatgcgcgcgccacccgccacacgtacctgcgtcatgcaccccaattcatcactgaattagtagcaaaataactataagttaaccaataaattaaattaatcattaattatgtgtttgctggctcggcagctacctactctatcccacagaaaagagttcattcatagcaattcccgctcaaatgaaccgtggtgagaaaagactaatgtgcccctcgtcagtacacttaaccacattttctagaggctcgaaataaatacaaatgtgaaatgtcttaatctgattggtttttttaacacagtggctaaattcggcatctgcttgaagctataaccccgtagcctaatcggtactactccctttattccaaaatataagacacaaccacttttctatcacgtcttatgccattcccaacccaaaacactagatatgatttccataaactccacatcatcaagaaactagtactagacactactcttccaatgcaaacactaccattccatacttaaatttaatgctccttattacacatgatgtcttgtatgttgtgtagaaactatgtcttatgcaagacatagtttccttctctttcctcatttattcacttgccacatcatttttcatcctaggtggcaccttatttaatgctatggacactatcctagccattgagttgggaatggcctaatataaaacgtgcatgcatgtatacattaactagcatctcttggtcctataaaattaatttgttttaaatcttatatcattaagcctcacaatcatattacttgtatgtattaaggtgatccaatcaagaaggtgattaaatgttttcttgatcttgtgttataagtggttatgtgttatattttttatattttgatatagagggagtactctcttagcataaagtttctgtgggacaaattttacaggataaagtctgtgggatggaaggagtatgattctcgaagacaaaaaaaaccaatgctgtacatgtggggcgtgtggtattaaatgtgcacagaaatggcataccacgtagcactgtataccaattaaaagtttgagattgtacctaaatttgtactacagtgcatcaattaattcgtcctgataaactagtgaaaaaatatacttgctctatcctaaaatataagaatttttaggtagatgcatgagatatattctagtactacgaatttaaacgaagctgtccagattcatagtacttaaaaatatgctcatccacctaaaatcccttatattttggaacgggggagtaaggtaacatagcaaaaaaaaataaaattcacttattaagggggaaaagattgacgatctgtctagggagtgactagccatttaaggatagatctaactatccacaggagaagtccgtggagttgtctattttaaatcaagatcataccaaatctacgatatatcacaaccatgaaaagtgatctggctttaacagcaaaatagaataacactgtgtaaaaatgggtaaaatctgatgtagttaatgtgaaaaaaacgattggtgctaggcgagaactaattaaagaccatggctcagtttctataattgggactacctatacatttgtcgacaaatttttcccccaaaatttgatagatgtaattacagtacaatcgtagtgtaattacactgtaacttgcatgtaactacagtgtaacttatatgtaagtttcacgtagatctattacaagatttgttttggtaaggaagaaaaaaaatcatagcacacacatatatgaaagaatttgttcccacgacctccattttaccgaaataacatgttacagagagatttttgaaagttacatataagttacactatagttatagtgtaattacatgcaagttacagtgtaattacactacgattgtactgtaattacatctgtcaaatttttggggaaaaatttatcgacaaatatatagcaaaatcgctataattttatatgcatgtcttgagagttgaccgatttgatttataaatattttggatttttggttctaaagacgggagccagtgataatttaatggggaggggactgtttctagagatgacaagtacaattaaagcatcaaaactcgttacatactccctcgtcaaaaaaaaaaaatactcatgagtttgaatccgttcggattttttgttacggagggtgtatataattgtagagtacaaacaactttaaatgtgctcatcagagaacaagttgtcgtcctataatagtaacatctaatcaaataaaactaactttaactgaaatatctcttcgagattatataaaataagatattgtaaaaaataagtagttcaaatgcatgggaaaggtcactgaaaaattttgttgccaaaatatttggataatattgcattgttaaaaaaacaacgtcaaatatatggtactaaaatttatcaatttattgaccaaagtgataatgttaacttttagtttcacctcctgtactgttcaataactgacagtgatgactgttctatccaaactttaatcaataatagtttttgttttattttgtttatatgttaaaacttgtatatacgttggagagccccaagtatttataaatgcattgttggaagaatagtgatcgaattgtatattttagtcgatgcttaatcatgtactgaagtgattttgtacacatttataagttggtttgtctaagttgtagaataattatttatatttgcaaatataacttgattagctatgagaacatatcctatgcacacaagattcccgtgcacactccatacaaaccaactagcaaatgtcacagaaaattctagaaaaaattagacacatacttccaagagtattacaccaacatgttaaatcttatcttcaaatttattatattttaactgtaaaaagaagataaaattctgacatatttttaccctaacaattggtagattttttatttttatgggtaaaatataatgaattacgagactttgcagatatgtataatactattaaaaaattgccatttttttctagaatattttgtgacatttgctagttgatgtacatggagtgcgcacgaaaaaattatgtgcataggatatattcccttagctatagcacatcttcacgggcaatatcataaacatagaatattgttctccttgattatttcgtaaactcgttcgcatcttagatctacacacctcagggaattgaaaaataatatactgcctccatcataaatggagttactttaattagtatatacgtaaagcttggtttattatatatatttttatctcaaaattatacatgtacttttcttacaaaattaaagcttcttcaaatcaaaattttcgtatgtcgtcgttatagcaatgttacaagcatgagaaaatttcatgtgcatcactgagagttcacctaattgctcttctatgttttcgagttttgctcattctcttacaaactcttaaattttagtttggattctgccatgatcttttcgttagttgaacgttttgtcctttgctatgaagaaacaaataaataaatatagaaatttgttggatggaactattatatttatgaatttattatgcgttatatcatttgaatactactctcttcgtcaaaaaaaactcaacctgtgatctctcctagaacagcattctaggagaatttggacatcacatcttctctaggttgagtttcttctctaggttaagtttttttcttgagagagggattactcattttaagagtgtagtaccacataagctctgtttttcagctcagatatttgatatgttgcagcaaaaagagcaaattttcatgtccatttaaggcgtctgaaatctgtgaaagcctgaacgcaatcaaaggctgcatgcttcgttcagctagccattatggcggcgaagagcaaaggagagagagagagagagagagagagagagagagagacctgacctgaggagctcggagacggggaggacgtgcggcgcgagcgtggcgatgtgctggcggaggcccgcgccggcgacgcggacgaggtccttggtgagcgcgacgccgacgttcccctcctcgtcctccatctgcacggcggcgttgtacgccgcgtcgtcgccgccgtggtgcgtccgcagcgtgcgcaccagctcgtacttggcgtcgccgcgccgcgccgccacgtcggtcaccagcgccgccgcgctgcccacccggaagatgcagtttgtcaccagcatgtgcttgttctcgccgaagtaccagttcaggctcatgttctccgtcaccaccaccagcgcgtacccgccccgccgcgacacccgcagcgccctcgccgccatgtcgatccccaccgtgccggcgctgcaccccatcccggcgaggctgtacgtcctcgtccccggcggcatcccgaaccgccgcacgatcatcgacgccagcgacggcgccggcgagaacatggagcaggcgacgacgacgaacccgacgtcgcgcgggcgcacgtcggacttcgccagcaggtgcgccaccgtggcaaacagcccctcctccgcctcctgcaccgcgaacgcctgcgtcttctggaactcgccggagaagatgaagggcggcgcgtacgtctcctggccgaggccggacttgcggtagatgagccgcatgaagtcggcggtgtcgtcggagtagtggcggcagcgctggccgaagtactcgcacacctccaggttcaccttccggtccacgtccgggaggtggcagctgtagttcagcaggtacaccggccgccgccgccgccgcagcacgacggccaccacgaagaggagcgccgacgcgacgagtggcactagggcgtgtgccgagagggagcgcagcgacgtcaccagcgacgccgccatggatgaggacatggtggtggtggtggcggccatgctcggagaagcaagctagctagaagctagaggtgtgtgttgcactacctagctaggggaagtgagagtagctgcactatttataggggtcaagaattttttttactactgtagcttattattactccctccgttccataatataatactccctctgtcccgttatatttgacactgtagttcattttaaaaggagtctaaatgtttgacgtcgtagtacaatcagaaaaaccgtttccatctttatccctctgtcatcctccactggtcgctagcctgctgagtgtctacctccgccacctgaggatgaggctgctaggggaacggcgccgtgacatcggccgatgatccgccgccgctgatgccttcctgcgccatcttcttccatggcgtgaggaatttccgccgcctacccaccccaccattcatggtcgcagcttgtcgtggcggtgagcttaggcaacgacttcaggagtgggagcagcggcgcaggaggaggactcgccagtgtcttggggatgctggggcttgaaagaacgtcactggtgccacagcggcgtcgggagagagcgtctgcggcttaggagaatggcgccgccgacggctctggcaaggaggggtggcggcggcggctccggcgagtacaggtggcggcgacagcgtttaccggctcgagaggaatgccgccggtgccgcagcagtgttgggggagggtgccggcggctccgaccaattgggatggcggcggtagcggcggcgcttttgttttcttccgatgatgaagccgatgcgggatctccctcctccggggtgcttggagcaggaggagggcctcgccgacgtcttaggggtgagccccggcggctggcgcggcggccggcgtttccggtgttaggggtggagacgcctctttcttccagtgttggggatttctcccgcgtgtatcacgcattcacgtgttgacgaggagaaggcacataggcaaatatgtactttcatagcttccttaattttcacaagcctgttagaaacgacaaacattacaggacagacggagtataatgcacaactattttttttaacgtttcataatataaggcatggataaatgcatgacattaactagcacctcttttctattaaattattattatttaaatccttcattctcaagatttttaattctattgggtacatgctttatatttatttgggtgatccaaacaataaggtaataataaatatttcttggtctttagattaagagtggttgagtctggtattttggaatggagggaattatgtttgacaactatagtatgggtgaaaacgggacgggtattttccactcgtctgcataacccaaggctggtgagaaggatataggagactatacaaattcgaattcaaaaaatttttatagggttagagtacttcaagagttgaatcagcccgtatatcccatattatcaaacatatgcatatcgattaattattattttacgagctcacaagtaatattgcataattttccttgatgtattagcatttaacacttttttatcttcaaactctcgtttatttgccaggttagttagatactgccttcgatcccttgcatttcttttttaaggcaaccttcctatttatttaattaattaagggacccctcatatatccgttccctatccaattcggaggaaaaaaatatgggatatgatagaatgtaggatgggtcatatgttattagcactatctatacccaattctaaatttgaattaaaaataagggttaggatataagaatactatgatccgaacgtcttcgacccaacttcagcccctaaaaatagggattttttatttgtcaaacaactgattttttttcttatctatatcaattacctttgggactagctaagtttatgatgtcacatttttttaaaaaaaggtcaaatcaaacattgtaaattacccatatttaaattgttgttacactataaatttgaaaatataaatacactgtaaatgtcagtaattaaattgtattttttaatacacactatatatataaaagaagtataggtactcggtataagaaataagatatatagaaacatactatcgtataagagagatagcaattgatatcacataagggaagaagtgactaaaatggtaaaaagaaacagtaaggctgacatatttttcgagaaacgtaacactagatcactaccaacaactcacactacttatgtatatttttttattgaggtgaagcaaataatgtctaaaagaaaaaaaaacttttgtgctaaattcttaccggtatgaaactgaaaattatgaattacagaagcataataatacgtccagaaaacaaaaaaaaaacaaagaaagtaaaaaaaatgtgcttcattatactgaagttgttgttttttctatatattgtgaaagtttagtaaataagctcgtacaaatttaggtgacagataaataagtagaaatcaggctgctgataaataccaaaactgtttaatattagcaaatggatggtctgcgcaggaaagacagcaagagatttgtagaaccctgacgaccgtaaggacggattaaaaagaaaaaagtccgccgatgtcatggatgacccattaatgttaatgttattcaacatatgaaattatgttctatgtatatgtagagtgttttcatcctttgaggggatatctactcgatatctactcattttatgcatgtcacataaataatcactagataaattgaagaaaactgacaagatatattaatatgaaatatatcactatacaaatatgcaagttgaaatttaacatgtatgtgttgtaacaagaataagaaatatagttgtgaatgtacgataattatttttaatttaatttgttctttttttttgcatattttagaagttaaatttggtcttacatgtttgtggagtgatatattttatattaatttatactactatttttttcagattttttattgttatttagatgacatgtaagtaatgagggacatcttctcaagcgatgaaaatccatatctgtatgcgtaataaatagattttaccgaagattgtagaggaggcgaggcagcaaaccgaatccaaaattaatgtcgtgctttcctgctttatcatatacttgaaaaattcctgtgtgttacaacgggtggatgctattttaatcttattattatcgttatacagtttagctaaaataaaattcactgtgtgaattcgtttgaaattttttttaagaaaataatgagccgcaattaggagttcgactttcatctcaagttagcgtacggagttttttaaaagagatttcttatacgacttcttttgtatttccaaaagcaaatgagtttaaaatctaatttaaacacggatttgtatttccaaaagcgaactattttaaaaaccggctcaaatacggataacgtactaaagtaccgacaaaaatatattcaatttttataatagtaaaaataatgtaatcttcttgcctttcttttaaaaaaatagcgttgtgccgtggatagtccttgcctccttggtgggcatgcatcatcgacattgataataaggcaacggagaggatgctcgtaggtaaaggaggtgtactgagtactgtgccggtgaatgggcagcttggtttatgagggttagttactgtgatggtcaggataggcacagtcgtacagatcggatgaaatatggaccgttatatattcatcgaaggaccacaaatctatctgtatttttgatagaaactagaatattgatttgcaaccatattgaaatgtatatgtcgaaatgtatggaaatgttgcattttcatttgtgagttaacatacgcatcttcacccataattccatatgcattttcatttgcgagttaacatatgcatctttgcgagttatagaagtagatttctaaaggcgatctgttggaactagagcttatttgaaaagttactacatttgcatccactgatttattgcggaataaagtgtaccggtttatcctaaacttatacgagtatgtcatccagatacctaaactttcaaattatatctccggatgcttaaacttgtcttgggtatcatataggtctaaacgggcgtcaacctactctgtgcacttacatggcatgccacatcaacacctatgtgtcagtggaacctacatagctacatgtcattcacattataaaatataaagttaaaaacattttggtatccctatcccccctaatcttatgatttattatttttttaagaaaaaatggttggtttttcctagtagaaggacgcccaatgatggttcagctatgccagcagtgagagaggcggtgaagcagcgaggggaggctggttccacggtccttgagcaacaaagaacccaatctgtggcttctccccacgcgcgtggcaacggcggtggcgttagcagtaactcccagtaactcccatgacctaggctttgaggagggggtggtgagcatcatggtatcgagatgaagcggatggaggcagcggcttcgcacaaggtggtgtagaacaacgcatgatgtgtggtcaaaatagggtggcagcgaggaggggtggctccggcgagatctggaggtggttaggttggaaaagtttgatattttcgctcggattttataccacggatgtcgttttcattatgcaacaaactttgttgtcaaagttatttgctatgtgatctttatgcattatagcttaggctgtgcatatttttaaaccacttaggtggatcataggtggatatatattatttatccttgactatatgcttaatttgtttaattaaacacattgtcaggggctacacctaattaggtacatctaattgatacacctaggtatatttttttttctaatcttttaaattttcagcccttcaaagcttgttgaattggtaaaggcactcagtagactaaggcagagatgattgaagcactcggttcgatttgatacgttcgagagaagattatcttatcgactataaaggtctcaggggctatttatgaagattatgggtactatgcatctgcgcacacggctgggctatcggactggttataggggatagatcatgtatatggaatatgtaaaggattgggactcaggtattacgtttacttgtgtatcgaggaaacgacttatagtgctggttcggcaagattttaaagtagttgtaggagatttcaacgggattgggttgaatctctattttgtaaacatatctcctccgcctatataaagaggacagcgtgtgtcccttgagagcataaccacaatccaaattgtcggatcaatgcaacaataggcagattcaatccctaaatagaagtaaggtattacttctcatcaagaaggtctgaacctgtataaacccttgtcttatcacccatccactttagatactttgcgcaacctttttttttatgttaccaagttctagttcgataattttgaaggtccagaaaactagataccctattcaatttaagataacttagaccattctcaacccaagacactagacataattttcataaattccacatcatcaagaaactagtactaaacactaccctcccaatgcaaacaccactattccataattaaatttaatgctacttatctcacatgatgtcttggatgttgtgtagaaaccatgtctcatgcaagacatggtttccttctctttccttatttattcacttgccacatcatttttcatcttaggtgacagcttatttaatactatggacatcatcctagtcattgggttgggaatggccttatacacttcgctcttgacagctctcgcccccgtacgtgccgattagccacaccggtcgccgctctcgttctcctcaccgttgtccccctcctaccaaatttagtggatagccagtacaagcatttgatgcaaagaaataatcgtacgtttcatccatgcattcacatgggcacgggggtgaacgtggcaatcgggggttcaattctcgatcctccttcattaaacatgatgactgtaccgtactgttgcttgcgccatactactgaatcatgcaatgctcattaattaaacaaaccaaacaacaatccatcactaaaccggctgtaggggccttcctaacattgggctatttggatgtaggataggcagcggcagggtgggctctcagatctagtcccacgtcacacggattcgtttctctctgcatgtcgtatggatttgtttcgcttgtgttatggtatgttactgtatctaggagaaactttatagccaatacgtggtttagttggtaggtatcttactgttagagcttcaatccgttctagacacaaaccagtacacccttgatatgtttgacagcttgatcaaatattgatggggagtaacaaacatcaaaaaaattgtaaatgtgcaagggaaagacaatgcgacgtgtccctttttgtgttattatcgggcatgattttgaatgcatagagtagtggttattcaaactacggatgctaaattaaacagagacaatgggttgaacaataactatgctactctttcagccgttcatttgaggttttcattgtttgctagctcatttgttaaacataggtcaacccctactaaataattatttttttgtgagaccctctttatattgcaggtggaccataactgctccagctgtagaaattgtttacacggggtcggttcaagggccgcattcgaaaattcgacttacttttgcaggcgggcaaaatgcattttcgcatgtgggcctcttaaatacctgcctacgagtctaaccttcctactctcttccctctcaatatcttcaaaattttaagtcttcattcttatctcctcaccttctctctcccacttactcctggatcccaatgacaggctcgagctggcgttggcaatggcgggagcagtggcgggaggcttctactccatcatgcatacatgctcattaattaaacaaccaaacaataatccatatcactaaaaccggctgtaggggaacattgggctatatgaatggaggataggcagcagggtgggttctcagatctagcctcacgtcacacggatttgtttctctgcacgtcgtatggtttttgtttcactcgtattatggtatgttattgtacctaggagaaacattatagctaatagtggtttagttggtagattgttgttggagattaattcaatccactccagataggaaccagtacaccaatatgcatgtttgacagcttgataaaacattaattgatagatagtaacaaacaatatcaacaaaatttgtgaatgtgcgagggaaagacaatgcctttttgggttattgttgggcatgattttgaacgcatagagtagttacattcaaactacggatgctttagccaatgcaaacacttaacaaattaaacagagacaatgagttgaaaaataactatgctaatccttgagccgttcatttgaagctttgatcgtctgctagctcattggttaaccgtaggtcaaccactactaaataattgatttttttacgagaccctttttagactgtaggtggaccataacggctctctgcaaaaatcgtttacgcggggtcggttcgtgggccacatacaaaagtccgacttattgcaggcggcaaaatgcatttttgcacgtgggtctcttaaagacctgcctacgagtctaaccttcctactctcttccctctcaacatcttcaaaattttaagtcttcatccatatctcctcaccttttctctctcacttcctcctggatcccgacgacaggctcgggcaagcattggtgatgacgagcgcggcgcggtgggtggtggatctggaggtggggaggcacagtggtagcggatctagcggtgggaaggcgcagagtggtggcagcctcagcgatgacctcgggggtcgggaggcgcggaggcggtggccctggtgacgacgaccggctgcagactgcggcgacgatgatgatgagctgctgggctttggcgacggtgatgaagagcagcggcgatggtgacgatgagcggtggcggatgggggttttggggaatttttttttcacgaattttatttttgcgtgcagacgacataatcacccccataaaatagcaatttccgcatatacttttggttggacggccggctcaaccgcttggataaatgggctcttaccgcatgaaaaatattttttttataaatgagcctgaggttctaattggaatcatctgaccacgctgctagtaacttcgaaacattaccaaaacatccaataaaatataaaccaacacaaattaatcaatcatacgatcgactgtttggatgggacttaaaaaattttcgctatcacatcagatgtttgaacactaattagaagtattaaacgtagactattgttaaaagtcattccataaccctggattaattcacgagactaatctattgagcctaattaatacatgattagtctatgtgatgctacagtaaatatgtgctaattatagattaattaagcttaaaaaaatatcacgtgaattagcttttatttatgtaattagttttataaataatctatatttaatactttaaattaatattaaatattctatgtgacaggaactaaagttagtctcgggatcaaacaccacctgaagctagctgtagtagtctagtctggagtctggaccatattgcagagagagcaagatgatcactgctgctttctgcgtctctctgcgtcagtgccggccggttgccggcacggccgccgagggcaggcactcatatcgttgcagcgacgatgaccgatcgaccagcgagctgcagtacgtgcgggggcgtgcacggccgcgcgctagctgccactgtcgagcgtcgccccgttccaacctcatcggagtacatagctagtgggatttgaagttggctcagagaggtagtacgtactatatgcacactgctataaaagttggcatatgcaattcaacccattgccatattgcagccatagcgaaccagaaaacgaccttacagtcactgccggacaaaccatctttcatctttcatgtgttggatagaaatcacaataattccggttgaatcaaaaaccgggactaaaaactatttttagtcctggggtataagttcagaggtatttttttatctgtagtcccggttaatgagattatttttagtcccggttcattcattgtcaggatatggcaagcccccctaatatctttagtcccgattggtgtcaacaattgggactaaagattaaaaaaatcacgcataggaaggggagagagaaaaatttcagagattccctcctctcatctttatcttcttctatcttttccctcctctcatccttatctctttctctccctcacatcctctatcttttcctcccctccttcccttgccgactttccctctccgtctaacctcacattagcgggcaacaaccggaggcgttggcggcgcgtggtgcccagcgcggccgtcgtggagggcggcggcgtggcctcatgggggccctgccattgtaaagggcggcggccggtggcgtagcctccgctatgcgtgcaacggttgaggcagaggcggaagcgggacaccccgcgtcgtcggcgttctggatgagctcctgcagcgtggttgtgccctccgggtagttggcaagcacggagggcgggcggccaatggcgtggccacgcggagggcggcgcccagagcggcggtcgccggtgtgaccgtcgtggagcagaaaaggtagaagaataggggttgctttttagttgtttttgtgaatgattttctgatgtaattttgtggatgattttgtgatgtttttgtaaatgtggatgattttgttgttgaatttttaaatgtggatgattttgttattgaatttgtggatgattctgtgaatgaggacggtttgaaatcaatattcaagtagcaaaaaaagaaaagaaaatctttagtcccggttggtaacacccaaccaggattaaagatggatcttttgtcccaggtatttgaaccgggactaaagatcagatctttaaccctgtaactgggagtacaaatgctttctctaggagtgagtacttttggagaaggaagagatcctgtgcaatccctactttactccttcaatccttgaaaactcaattagcttatcagattcattgttttagaataaatcacattatcctaggttgagttttcttttactagcaaaaatgcccatgcgttgcaacgggtaaaaaaattctaatgataatatatgtttttcatgcataatcatgtcaatgatgtttctattttaataagcggcttgtttattataaacagtgtttttttccttgcacgattttctcaaaccatttttcagaaatggcgcatttctttctaaaagttttttcctagcatgttttgtttctttttttactgatgaagaaaaccatatttttctccttttttttgcttttcttttctcgtgtgtttttttgcatgttttctcgcatgttgtttttgcttgtttttttcgaatgcttttttcttttttccaatacaagagaatatatgacgaaataaagccatgtagtagatggcaaaaaatcaatgatcctatccgattcaagcgtccatcaatttagcttttttctgacaattttttcaaagcgatttgttttttaatagaccttgtttttttttgtgcagttttttaaagcattttttttagaaatggtgcgttttttcagacaagtttttcctcgcatgtttttttaaaatatattttaccgacgatggaaataatttttctcgcgcgttttttattttttttattgaagatggaaaacctttttagcgtgttttttttgcttttttctgacttttgcctcacgcattttttttgaactgttttattttctcgtgcattttttcttttaaaatagttagattagattagagatagagaagagatatatactggttagaaatcggattttgtttcaccacttttttagggaatcggacgaactcttttagatattttttagatttttttttggcctttataggaataagactttttttcagtttataaaggaatcggatctagcatttttttcaccactttttttgccttttatataaatcagattttttccgttcggatctacagtttttttcgccacttaggggaaaaagacttttgttgttgttgttgtttttctttattttcttttttgtgcggcttttctttttctttttatgcacatttctgcctttgttctctctcttttattatttttttaacaaaaacgaccttaagtaccttattgcaagattatagggactcaaatgcaaatataaaaattacagggactctaatgcaaaagtacaaaccaaaaataaaatacatataaaaatggaatgctctcgacacgtaggttccgtttttgcaaacagattttcaatccggcacatcaatttttttcaccaatgtagagtttggaatcggacatattttttttcatcctctttttaccgcgttgacagagtcggattcgtttttcttttaacttattttcgccctttttttggatcggaccgattcggttttcttttcttttttcggtttttattcgcctgggtttttttggatcggacatttttttcgcccggttttattgacgtttggtttttcttttctttttctggtttttttcgcccggtttttttggatcggatagattcggtttttttcgcccggtttttttaacggacgatggaagcacctcttactttttaagtagtagagaagagagagtatgtagggaattcaggtggttgtaacttgtaaggtttcattaatgttggatcgagtgaattagcagtacagatccatactacagcggttttacataattattaacaactactttgaaacgcaggattaaaaaaacatagaaatgtagtttggttgtcatgcttggttgaataactttaagggaaatcgatagacctcgtttggtagcatctaaggaaaaccatagaaataacctctttaggacttaaagaagagcaaagaaatgatagacctcctgtcagttttcatgcaaagtttccatgaaatgagtgaatattcaaggatttttgtggaaactaaccctttggttcaaagggccaagtagatttaagaaccaacatcttaaggttctaggaataaaaaaaaaagaagacaactcaatccatcagctcaattcaaagcctatgcatcaagcagctccctatcacccccagaccatcccatactcaagaacaccttcatgattcagccacataccaccatcgatccatccaacaacaacatcccctgcacaaatcaccattgatccatctaacaacaacattccccgcacaaattacaatagatccatctagcaacaacatcccctaacccccccccccccttttaccccactaccaccaccaacacacacaaacacaaataacagaaattgattcacaaatctcggcacaaatgaatagttccatcactcaatttagacttcaattagaagtcccctgttgtggagtaatctgcacctcaccgtcgttctggttggatccagtggccaccactccaggccagtgaatagaagaggcggttgtcgccatgccgtgccatgatggggagaggagtgataggagacgggagatggtgaacgaaggggatggagagacggagggaaaacgctccatgagcactagccgtcatcggctttgctcggctcccggtaaaagtgccggcttttctaaaactggcacttttatctcaagtataggtgccggcttattaaaaattgacacttatattgttgagaaaatttcttgtgtacccctaaaactttacaaaatccctaatatgtccctaagttttgctcatccccttgcgtacctcccaaatattagtttgggccccttccatatccttttcattagttgaccattaaattcttagtaaaatttccattttaccctttggtacgaagaaacatataaattggcggagtataaaaatttattgtataagaattttatattatgattttattatgtgagatactatttacaacaaaatttatttttagatatgacataaagtactagcatttattgtttaattattaaaaaattatataagaagtatttttttgttgattatagcacaacatatttggtgtataagacaaatctatttatatgctacataaacaatttttaataaataataaacaaatattaattttatggcatatttataaataaattttcataaataatatcctgcataacaagctcataaatacaatagtctcatataacaaatttctaccatccaataatatacttcataaatatatatgtttctaacgaatactatattccataaatatatatatgttttttcatacccaagagcaaaatagacttttagactttttataggaatttaatgtttaactcacggtcaactaaagagtatgaaagggatcctaactaaaattcgaaattacataaagaaatgaccaaataactccatgatatatataaagaattagataaaagttttagggatacataggaattttctcaatacagttaactgatgaatagttggtccctttcacttttggtgggtgtcgatttatgatcatggttgtgtttctgtacctctggctaaggtggctagttaattggctactcgtacttctatagctctaagatgacataccctagaatggccacttcatgactcttgccacttgccataagggtacaagcgactacccgcgaaaacccacttataggctaaactaatctacgaacttacttattttgacttatatgtaggttcgtgggtgacccacttgaacctctaacttgccatacttctttcagctgctagcccaacaagtagcctgtggatttgtactacctactgcatgtagtacataccatgggacatgaatggtggcaacagattcctgtttgggcagctcgatctatccatgcaagggagaagggaccaaccagtatgcgtgagaacggtgtggtaattttcgaccgtaccactgccgtttacgtaaaaataatatagtttaaatttttttagcatatataaagtttagtttttttttatttctgttggcgtcgcattgaagttgatcgtcaatgaacagttaaatttataaatataaataattttgatcacgatgatattgttttcgtaataataataatatatatcgttttcgaccgttttcatccacccaatagggatctggctagtaggaatttcgatatgaaacatttcaattcccgcttcaagaaaattaccgtcacttccaataggggatgttgtaactcaaaccagacaccttatacttggtatcaaaattttaatagggtagtaaaacatgtaatagaaaggggaatatgattttttgcctatcattctaattaaaggcgtgcatgcatacggtgaaggattcattgcgctcccaactgtctggaggtctggaccatgcctgtaaatgttaaagctggaagtaagtataggcactaacttctgtgaggccaaaacccagatctaggcatctctactgttggagaaaatacaaaccaaaactggatatctctgagagctggaacacatgcatctacttgtaggccttattgcaatattttttctgttgggttggcatcagatgttatgcaataaatgttggacctatagaagtatataaataggctcactgctaaataacgaacgtagctcaactggttaggttctttatggtgaaaccaactcaccttgtcggttaagttttagatttgatatggatgcttgcatttatggttaattattcttccaatggtaggcaataacatacccactgatagcgaggtgcttgtgccgacttcatcaatatcaagataaaccgacccagtcttctggaggtgctaatagatgtatggatacgtgatgagtgtgtgtgcgttatgagggccgcatttacattgtgtttataaaaaaatgtaaataggctcactgctaacaagaacttaagtaagtttagagtaaattgcacccacagtacaacaacttggcaggtgggtgcgatatagtgaaagaacttgagaattgaacgtccgagtgcaacataatgacaagtgggtgcgttctactataagaacttgacaatttaatattttggtgcatcaacttggctaagcatatgctagctgagtttttttcacgatgtaaatatgccattacacaatattcctacggatattaccttataatattgaatttaatctttaagaattatactgcacatacaatttacatccaattacctttaagattttttttattttcttcaccttctcaaatatcaaccaaaatataataatttctacatccagtttaattgactttaagttattagttattaggataaaaatataaacatgcttatacaaatccacgctagtatattgtcaaaataagtacttaaaaaattgaatttatataaaaaaatgctctaaataattaagttgtcacgtaacttcttaatttattgtatcaaaatcgtacctaccttacaagttgttgcatttatacgatcacttataatagttttatactaaattgcaccttcctaccaagttgttatactagaacgctcatttctcaatttatggcaccaaattacacccacatgccaaggttgttgcatcgtgggtgcaatttactcgtaagtttatttatccattttaaactaaatcgtagcactactgcaaaacatcaaatagggaccagcctcgtaggtgcagatttatctaaaaccggcacctatgagacgtcgtccaccctcccaacctctcaagcaggcctagaaaaagcaggtataacttcttacccaataataggaatacaatgatttataccagtactaataatagtatggctagtaggaattaaaaccggcactaataataagaattcattttattttataccattgagtttactttaatccaatgatttatcatcgactttatcccctctaaaatacaccattgattttatcgattttttttacaatatactgtcggagtggatagttttttttaaaaaaaaaagtaaaatatcctttaatagagcaattgatttacagaagtttaaagaaaatatgaaaactttatgtagactccttacacaatatataagtgtatgtatatttcaagatttttaatttacatatattatttttttctgaaaatatattttatgttttatatgctaatggaatactttttttatgttgatgttcttttatctaaataatctttcatatgctataaaaatatttttccactacggctatcttttgtgtatgtgattcctttttccatatgctacataaaaatagttttttttaaagaaaagcatatacaaaatcttaaaatacacacacaaacttctatacagtatacaccctctattccatattgatcatccatataagtctttttttatcaagacaaaaacagcttaactttttttttgtatttcatttaatgtaagtatgtagtgggaaaaaaatcaagaaacatataaaatataactcccccgcatgcacaagaaaccagtgttttacttcccctaatgcttgcatgcatgcatgcatgcatgtagactcaatttgcatgtataaaaacaataatgcttcacgtcaaataaaaacgcaagggttatatgatgatcaacaagaacggaggaagtattatttaaggagactacgcaaaaactttcatatattttttcaaaaattctaatgggtcaattaattgccaagtattcaaggacattttaagcttttttttaaaaaagtatttacttcactggcatattgtattgtaaaggaagataaagtcgatcgtaaatcgttaaactagagtaaattaaatcaatgacatactccgtaggacatattctctcattatcccaatccacacccctctcctcagtgagtccacacccttcctgaattatccgccgccactctctcgatccccaccacttcgcctacatgcgtcaccctcccttctcctcccccacctttaccggatctaccaatgacatcgtattttccaggtgtcatcaagtccagcaagattatccacaccaggcctcctaaactacatgacctcctttgtgttataaaaactagctctgatatatgtagacctcaatagctgacgtagaagatccaatcttaatgacgatgccaaggtatgaaaattttttaacgaggtttagcctacacttgtatccccgatacactgattatagatgctctttctcgatccagcgtaattacagagtattaggatatcagtgatcctcgactagttaggccgccaacagataggggtgaaaatagggcgggtattttccgtccacccacccggccacattatttcgggacaaattcgggtcaaaaattcgggtacctaggactttttacggatattgggtccgaatacgggtcttttgtggatacgagatcgggttcgggaacataatatctgacggatacggattatccggcaaaaaatccgggtattacccggataaatattcggatattacccgtattacgtttctgtgaggcaaaaaaatctcagaatgaattcaaaggtctgatagcttgtaatgctgtataatgcctctaatttggtagtgcctaattattaagcttgtttttatgcacctgttacttaaaaatatatcccctcgtacaaaattttcttatagttgctcaatagctgtaggtttaattgtttaaactacagctttgttagggtactgacagttgtggcttgtaggatacctggcctgtgtgctcgctgttcaagtaccggaactctggtgcttactgaaccggtttcaacattcagcgatggtgatcagcctttatctacgccaagaacagagacgtgcccaaattgttcgggtgcaggaaaggtaaattagccttctgcacaatgatgtattgtattatgtattggttctactatgatgtattgcaccctatttattttctaaagtcttaatggcccaatataattatattatagatatatgggattgttaaatggttcttgtctacttcctccgttttataatgtaagactttctagcattgaccatattcata

SEQ ID NO: 79696 - DNA, 1185 bp, Oryza sativa
taaatcggagctaagatgaattagttatgaatttttaaagattaaatcggattacaacacttaaatcggtttaaattgaattatgacgcaataatgaattatttttgaaaaggaaaagaggatttattgcgtcagcgggctagggtttggtggaccgggcgcacgggcgacggttcacgcgaacggacggccgagattgatccgatccaaatcggacggccgagatcgaacgagtccacggcggctcacgggagaggggcttgatgacgccagcgatgacgtcaccgacggcggcggcggctcggcaaagaagacggctcgggcggcggacactcgccggcgaacggcggcactaggacgcaaacggaggacaccaacgggtagcggacggcacggcgaactcaccgacgaccaaggcgacggcggacgaccaacggacggcgacggcgacgaggaggaagcggcggctaccttcggcttgacgacggcgacgatgctccggcggtctccgacggcagcgaaggggcggacgaggacggcggcgacttggcgatgacgacggcggccttcccgagtgacggcgacggctggaacgacggcggcgcacggctggagcggcggcggcgacagcgaagctagggcgcacggcgctaggacgactccggcgacgagaggcgaaggcgagggtggcggcgagaagagaagagcacggggatccttttaaaggggctcggaggcggtggcgaaggcccacggcgacggcaacggcgaaggaaaccttcgggaagaacgaatccgagacgaactcgaatccaactcattccaaaccgattgagccaaagattccaaaggagaaaaggtagaggagatcatttcccctctattgattcggccggagaaggaaaggaacggccggattggaaaggaaacagcggcggcggctcggcggcgcgaaactagggtttcggcccgaggaagacgacgggcctgacaggtgggacccacctgtcagcggctgcgagggcgcgcgcgcgcgcgggcggctgcagactgggccggactgggccgagaagagagagaaggcggttttgggccgactttcggcccaaagccaaaagaagactttttaaaactttttcaatttaaattatttcttaaatgcaattccatttattaaaaatactt

SEQ ID NO: 79697 - DNA, 26043 bp, Oryza sativa
taaatgtatttctatatggactctagtctcctattctaatattctttattttttagttccgaattttagctatttctaaattgtatttctatatggactctgttttttctttttctccgattaatgtgagaatttctaggccatgagagcgaacgtggaggctcctttttctatggactctattctcctcttctaatattcctttttttttaattccgaatttcagttatttcctaattgtatttctatatggactctagtctcctcttctaatattccttatttttaattccgaatttcagttatttcctaattgtatttctatatggactctagtctcctcttctaatattccttattttttgattccgaattttagctatttctaaattgtatttctataaggactctgttttttcttttttagttatttcctaattgtatttctatatggactctagtctcctcttctaatattccttatttttaattccgaatttcagttatttcctaaatgtatttctatatggactctagtctcctcttctaatattctttattttttaattccaaattttagctatttctaaattgtatttctatatggactctgttttttctttttctccgattaatgtgagaatttctaggccatgagagcgaacgtggaggctcctttttctattcctttaataatataatagattatctcatgtctgatttggacttgtacaaacctgaggatataaatatgaagggacctctagagtcttagtccaggcagatgaatacaatcatatttcggcgcatcgtcaccctagccatagtttcgatgggttcttaccctccagcagggctgcatcggttaagtttgatctccagcgaagggataagccctgtcatcctggtaatcgtatcggtacaattagaattttcccgtatttcgcttgatattctgactagtctttatagtcgtcggtttatctttgatataccaacttttgctaaggctgtatcgcttcgatctcttggttcgatatggtatatccatcacgtttacatagatctatctattacattgttgctaataagtttaattctactaaatcaataagtttaatgtactgttcattggagttttaaccgatgagttatcattattcaaagcttcaattagcagacatatcggcttagttagccgatatacatttaaatctacatgtattagacattaagccaatgtatgttttaatcattggacctgcatctatcatattacactatatctatcagtattggttgatttattcattggttcaattattcatatcatcatggttagttgcatgataaaactaactaacacgctttgagcctaacttttatgacctacattagacttaagcaaatctcttacacctctgtgagttggacaaaatttgtggcaacaaaaaaattgaattcccattgaaattcttagcgataattaaatcggaaagattgaaactccacaggtagacttcctaaaaattgtaatttgattttctatctttcagatgcacaatttatttttcatttatgtacaattttgaaattttcaactacaaccattttcaaatttttgcaccgatgggcgatatctttctcgaggtcagcaatgaaaaaaaaagtggaatttgtgtggtgccaagcacgagggtaccagttatgctttggtcagcaacaagaaattagtaacactctaaaagtcataggagcactggtgcatgccaaactttgtgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtaggggtagcgtcaagcttttcgccgatcagtgcaatgggtcctttctccggcatcgacgacctcgtcttcccacccgggcagacgtttcggttcggcagcctcgacttcgtcaccaacaacttcggcaagatttctctccttgactcggaatcggaccagtcgggagagaaccggatctcagtcccgtttggattcccaaacgcgggtgaaacctacttcaagaccatctcaatcgagtcggcttcaaaccactcggctgagatcgcatcttctccaacgacaccagatcaagatgatggggcttacccaccagtcctgatgaagctccccgacgatttagcggccgtctccacctcgacagggtcttcatcccgtaggcctaggcggaagtcggctccaacaccgattccgcctagcttcagggaagtcggcgtcatcctccagccactcggcacggtttcgacggatcagctagatgactacaacagctctcccaccgtcgactcacgtcctactgacatcgtggagtacgacgaatttagctctcgctacaacgacttcgacgactacgacgacttcgacggaagcctagatgacaactacacccctctctactttggcgttttcatggccaataatgagacggaggagcaacgccaagcccgggagactgaagaacgtcgccgactggaggaggagcatcaagcacgagaacaagaacggctacggcgtgagcagcaggaccgtgagcggatcgccaaggaggctgaagatcgacgtcagcgagctttggaagcagggcgccgagcgcgtgatctcatcggccaacaagacgtcgaagggacaccggttttccgcacccctcaacagaatgcggttgccgcgatcaccctcctcgacaccctcctcaaccaaaacgagctcaatcgttccgaccacgtcgtcaacatcttgaaccagacgaagaccatgatcgcggcttcggtcccagttaactccgaaagcgtccacacgccgactggcagccgagtcccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcaccggaccgccacgacgacgaccttgacggagtagcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccggtggctttagcagattccgcccgatcttggctccatggattgccccgtggtacgatcggatcttgggctgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgatgacgtcatcatcgccgcattcaccaaagggattcgccacgaagaattggtcggcaaatttgggcgcaaacctcccagaacagtcaagctcatgttcgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgttaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatatcttcggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcaggaccctcattgatggtggcagtgcactcaatatcctcttcgccaagaccctggatgatatgcagattcctcgctccgagctaaaaccaagcaatgcgccttttcacggagtaattccaggattatccgcaactccactcggccagatcaccctcccagtcacttttggcactcgggaaaatttccgcacagagaatatcagctttgaagtcgccgatttcgagacagcataccatgccatactcggacgcccggcgttagccaagttcatggccgtcccgcactacacttacatgatgatgaagatgcctggtccccgtggagtcctatccctacggagcgacatcaagcaagccgtcacatgcgacaaggagagttgcgacatggcccaaacccgcgagatggcgtctgcccaagaggaaatccgactggctgcaaccacggtgagcgaaggagaagtgcccgctgccaagatttcaaaaagtggagaaaccgaagccgagactaaaaagattcccttagacccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggatgcgatcaaggaggagttaaccaagctgttagcagcaggcttcatcaaagaagtccttcatcccgactggctggcaaacccggttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttttggactgctactcggggtatcatcagatccgactgaaggaatccgactgcttgaagacttcattcatcacgccttttggtgcatactgctacgtcaccatgccgtttggattaaaaaatgcgggagcaacttatcaacgtatgattcagagatgcttctcaacacaaattggccgcaacgttgaagcctatgtggatgatgtagtcgtcaagaccaagcaaaaggatgatttgatctcggatctagaagaaacctttgcaagcatccgtgctttcaggatgaaattgaatcctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagactcggcgagcgggggatgcccttcttcaagctactgaagaaaacagataatttccaatggggacccgaagcacagaaggccttcgaagatttcaaacaactcctcaccaagccgccggtcttagcttcaccacacccgcaggagccgttgttgctgtatgtatcagccacctcccaggtcgtgagcacagtcttggttgtcgagcgtgaggaagaaggtcatgtccagaaagttcagcgaccaatctacttcgtcagcgaggtcctggccgactccaaaacgaggtaccctcaggttcagaagctgttatatggtattttaattactaccaggaagctgtctcattactttcaaggtcacccggtaacggtggtcacatcgtttccactcggcgatgtactgcacaaccgcgaagcaaatgggcggattgctaagtgggctttggagttgatgtccttggacatatcattcaagcctcgcacttcaatcaagtctcaagcgttagctgattttgtcgccgagtggaccgagtaccaagaggatacccccgtggagaaaatagagcactggaccatgcattttgacgggtcaaaaagactttcgggcactggagctggagtggttttaatttccccaactggagaaagattaagctatgtgctttggatacacttttcggcgtcccacaacgtcgccgagtatgaagccctccttcatgggctacggattgcaatttccctagggataaagcgtttaatagttcgaggcgattcacagctggttgttaaccaagttatgaaagagtggtcctgcattgacgacaacatgatggcatatcgacaagaggtacgcaaattggaagacaaatttgacggactcgagctcagtcacgttcttcgacacaacaatgaagccgccgacagacttgccaattttggatccaagcgtgaggcggcgccctcagatgttttcgtcgaacacctttatacaccgacagtacctcacaaagatgctactcaagttgtgggcacccatgacgtagctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaatcctgcaacgctgtgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagcgttgcaaacaatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgcgatttcttcatcaacattgtgcacagattcggagtacccaatcggatcatcactgataatggcacacaattcaccggcggagttttcaaagacttttgtgaagactttggaatcaagatttgctatgcctcagtagcacacccaatgagcaatggacaggtggagagggccaacggcatgatacttcaggggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgagaagaacgctatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgacttaagcgcgaagacggcactctcgtcgacaattcttggaacattgaacatcttcgtcgtttctacgcttaactttatcattgtatttccctattttgactgtcaaacatcaagttttctccttgaagttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaacttcgcaagaatcatcaagcacagcataaatacaccagtatcgtacaaattgagcctccatgtattacattcaaactcagtcagaatcagtcctttcatcatcagagtcttcattactcggttggaggtcgttgttgcgaaattgctctacaacatcgctcgcaattttgtcagccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgaatgcactcggaccaccattattgaggaacatggcttggataattggtgcagcggcattggcgacgttatcccttgctccttcaagcctcttgatcttaccaaccaagacgtcaaattgggcttgcgattttattttgcgatctacaaaacacatttatgatgaggatttattgcattataaagagagaagctcagattgtctgctagcggtaccttcaacttcctttaaggctgagtccctttgcgcagccagttctgtcttgtctctctccagggcttcaatttgcttcgccatctgttccatcctggcggcttgcgctgtttgaaattcagatggttgaggatgcaattatgacagcataaatcaatggaacagatctggatgattaccttttgatgaaccactcagctcgaagttggagtcctggagctgtgcaattctttcccttaattccttctccgttttcttggcatactccttggcctcgtgtagctgttccctaacggattcaagagttcccaaatgtggaaccagcttttctaaggttgtagtcttggcctcattacgaagatggattctctgcacggtggttcatggattagtttgctaacaagaaaacaaagttattaaaggcagtcacccggaggacttacatttacaatacgagtggcttctccgagcgctttcttcagctggcacacttcttcatcttctttttgacggtttatgactataccggcggcttgtgagttctcgtcccaccatttgatcaagataggaggacgagagtcgtcggttgcctttatgcgagggatttcctctccgtcatcacctgatggtcctgatgcgtttccaagacattagacggatatactgaggttatttaaatcgccgttgtttgagaagacaactaacctgaagatgtacttagctgagcgtgaggtgatctttgttctttacctgaagacccagctatcgagtcgttaccagcctctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggtcctatcgcccgaagtatgggcgccagtcggctggccttcagcagtcggctggttttcagcagtcggctcggggtccttggatatattttgctctgtcatggcaggatcggggtcttttccagatggatctatatcagatggtttcctgcagagtgttgtttcaatattcagcattattttcatcggaaaacattccgaagcggaatcataccgagaggtctgatacctggaagatgttctgatctttggcattgcacggccagccagttttttcctgggcatggtacgctttgggggtttattaggcgagcccttatccccagatttatcatcgtcgccttcatcgtcatcaagtaccagcttcctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaccaagatgcctccatagttagtcaactcagcatgaagataaaattatgttctgatcacggtttgagggtttccgatgcatacctgtggaggcggattgaatgcattatatggcacaactggcagttggtgagagtagttgactacaattgcatttgagaagattttatacatcctctccttcatgattttgaaatccagggaatctggttcttcacggttgggatcatgtttgccgtcgaactcgaatgctgtgcgggatctttccttgattggcgccagtcggcattttatgaagtgccgagtgatttgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagttcgcatgccatcctttgttcgaagtcttgaagggcatcgagaaatatttttggctcagagttcctcttagttggaatcctgcccccccgactacacaaggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccacggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacgtcggatgacgcccattggccttcgaagctttctctctcttccgccattggtttcgctcaaatgtgctgatttgattcgagggatggcttgggagaggtgagggattgaggcggtggatcacgggaaggattttgatgcacttttcgaaggtggatttggccggagttgtgaaccctagttcgccggcgcaactttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcgagcttttttaggctacaaaagctgtttgggattaactaggaatgacttgtttttattatagtcatttccttggcgtcttatatgcctgtttttatggtaaatagtcatggcctaggctattcgacttatttattaccataatctttataatacttgatgggtaatctttggagtttttatattcggatgcctgtcgagtgtgttcattcgtgaaccttttagagtgtaaaccactcagatttcttttattgtggctaaaaagcagtcggctagcatgcctatttaggcgccgcgtacgcttttgtcatataatgcacgattgtgttattattttgtctttcaactatatgtttagtttgttaactaatcacatagttgggggctacacctaattaggtgcatctattcgatgcaccatattctttatcttttcgccctttacagtcttcgtcttcgctactcggcaggccttggcatgaataatttgaagcactcggattactatctttgagaaggctatgatggtcgactgcaaaggactcgggggctactgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacactttgatatggagattagaaagcaactgatttgtaacaatagtctggaactaatgaagtgtgtagagagaagaggacaagaggatggtgcaaaagggacaaaatgaattgagtaagcctttgcccaattccaaaggtgagcgtgaataaccctagtacaaaagcgattttcgtatgcggtcaaaagcgattttcgtgtgtagatcttccaaccgtctgtaaggaagtgtccgtaaaaatcacgcggaaatcagatttttcacgtgcgggatggttatgtcgaccgcacgcaaaaataaaaaacccaaaaagaaaactaaccctaaagctgccgctgccgccctccttgcggtcgccgtctccgtcgtcgtagccggattcgccgcctccccaccgtccgagccggccggccgcccaccgccaccgccagatccgagcgaggggctgccgcctccgccggatccgagcgggggcggttgtccgccgctgcgcgcacgccgccgagccacgtggtgccgcctgctgcgcccgccgccgagccgcgcgcgggagtgagagagaggtgagagaggatagagaggtgaaagagtgagatagaatagaaagaataagtatgaggatgggtggataaggataaaattttgaagtgtcgaggagggaaagaggaggaagaatagacttgtaggcaggtctttaagagatccgtacgtgaaaataagctttcgcgtgcggtcctcttaagggtcagcacgtgaaaatgaaatgccgatttttacgtgcggacgtgaaaatggtatgtctatgatctaaatagctcattgtccagaaaaatcatttctttactggtggcagtacgcagctccaagcctccaacgtccaaatgcataggtaatcgatcgatctccttcccttaaaaaaaaataattgatcgatctcccaagtccaagcatggtcggcgtgagcttagcgctggtatacgtgaaacactgaactcctacatcgtaagctagaatgactaacacgtcggctgggttactctgcttcatctctaccacacatacgtggcatgcgaccatgctccatttttgtgtgcaacacgttttatttggctcgacgtacttctggtgtcggacggaccacgcgcgcggccgaattatctacaacggtgtcgcagggtcgtagccctgggaacggccgtccaccctctgttaccttttcagccgcacccgttccctcagctagacgcgcggcacttcgctgggacacgttcctcaccatctttttactgaggcaccgagccgggagacacattgcgagggtgagtgtcccttggccaccactcctacacctagagttcctcttccaccccttgcctcgtcgtcgtcctcacgactcgtgagagggcggcggcgctaggaccggcggtggaggtgacgccgggggttggcggcgtgccagaactgggagagagaggcggtgaagaggaggttcgtcggcgacggcgacgatgagctctgtcggcgacggctggaggaagagaggggagcgggaggagggcaactgggtgctgccctcgccggcgagccgccccgttgctgcccgaggccagatctagcaagcccagactggatccggccaccccgccgccactcctctcgcgtggtcgctgcttgccgccactgctcgatgtcgggggaaagggaggcaccgctgccactccgctgcactgctcgatgccaccgccgtcattcgtcgcgccgctcaacgccgcgcgccgtccgccgccgcgacctgcgaccaccctgtgcgccactcgctgtgtggagggagagagagaggcaacgacgagtggaaggagagttgcggagtcggtggcgggcgcgacggaggcggcgacaggtagagggagaggggcggagtcgccagagagggagaggggcagagttggcagagagagagaggggcgagcggcgatctggatgacgtggctggggtggatgattttctcgagggcatcggtgggctggtgggaggggtatggaagtaatttgtcatctatggtctttttggctgtgacacctgtcttggaccctagattttaaagagtctatccaaagacactctccattggaagataattatcgtagagagtgctctcaggtagtgagggtatttaaaaatggcttatattatagatgcccttaatattcccaacaaacatacaaacgttactacgtacgtacactgctttcatactctcaacggtcacacgtcacgacctgagaaaggatcgatctggcagtaaaagtacgaaaccgacggatgaaattgtcaacgcgaaggctagcactgtcaatgcacagtcgcacacaacaacaacatatcgacactgggtgtgtttaggctgtcaatgcacagtcgcacacaacaacaacatatcgacactgggtgtgtttaggctgtgtttagttcacaccaaaattaaaagtttagttgaaattggaataatgtgatggaaaagtttaaagtttgtgtgtgtaggaaagttttgatgtgatggaaaagttggaagtttgaagaactattttggaactaaacacggcattagttccacgctaaaattgaaagtttgaagaaaaaaattgaaagtttagggctgtgtttagtttctgaaattgaggagaagtttggggaaagttggtagtttggaaaaaaagttgagagcttatgtgagtaggaaagttttggatgtgatgtgatttaatggaaagttgggagtttgggggaagtttagtgtgaacttatgtatgtagaaaagttttgatgtgatggaaaagttaaaagtttgaagaaaaaagttagtaactagacacggtgactgttcgaagccacataaacatagtagtactagtacgtactctctctgtctcaaaatataagtattttttagacttcgacacagtcttcgaaatgttagtttgaccaacaatatctttaaaaataaaatattttaaataaaaatgattatatagtatgatatttttttaatgataaatctagtaacatcaattttacattattgatctcttttacttttttaaagttaaaaatatttgactttatactatgctaaaaatgtttatattttaaaacagagggagtaccaaacttattgaggaaaaaaatgtttcccaaattaaagcctcggtatatatcgattctgcccccgtctttacatacacgcatgcttgttacgacaacaaattggcaacagcctattttgacgctaaaacagcctcactggcaactagcaaccatggccgttaataggagcaggccggaatgactccggtaataggttataggtaggcaggtggagtagtggtgttttgtactccctgggtaaaaaaaaaaaaataaatgatgtgatatattctagtacaataaatctgaacaaatatatttagattcgttgtaatataatatatcatatctagtatagattggttttttatatgatggagtacacgggttgtcactaaaggaataaaaacagcggccgtggggctgtcgcacagtcgcaggagagactgtactagtgctcgcgagcagattgagcggggagggaggccgcagaggtgggcaccgtgtaggcggcggcggcggagtaacggctgggcttatgtcagaaaagcccagcccagccaggaagcaaatttgcaaaaggaataagtctattttgtcttcctcatctgttgctcttggttgaacttgaattctatctcaaaaccacaaaaccgggtataacacctccactaattttaaaaaccggtccaaattgactccttaagtggtttcgaaagcggttttggtgacatagcaagttgacttggtctaagtgtgttgacgtggcagcccattatcgaaagagttaaatatagaagtgggtagccccatatttcagcgacacgcatgtctgatgtttctcctcccttctctttatttcccctgcattttctgactccaatggcgatggtgagctcttccatcaatttgcccctatcccatgtctccaaaaacgacaattcgctggagtgaagcttgcccagcggaaagcaatacacggaaggaggaggacttgccccatactacgcttccatccgggagctcatgaccaatctgataagaacaccaaaaaaaagtcatgaacatcacatgaatatggcaaattaggatagttgctgagaagtgagaagcttaatgcatgttctgttagtgttcttactccctattcggccagaagaagagtggtcgagccaaaagacaccgccggggcgaagcatcaggtagacgccgtaatggtggggctctgcgccgccgcctgcttcggtttgtacccgtcgaaaaactgcgtggtgtagtcgttaccgtcgaaatcgctgaggacgaacgacgacttggacaggtatgacttgcacgggaaggaaatataatggttagtgaggtggtcggagttaatggaggctcggcgccggcagcgaggtgggaagtggtggtagagttacatgagacacagatggagggcatgagctgctggaactactggatgcgggtgttgaggggcccgttgttcccgatcttgtcgccgatgccgagggactagaaaatccatggtggtgacgccgatgatcgccatggtcgcgcctcgccagaagtcgaagccgcccctgggcagaagcggcagcctaaacttctccgcaaggtcgtcctcggcgccgagagaagagaggagagagagaggcgaggaagaagaagagatgagatagaggtcgctgacacgtaggtcccatttgctgactcagcgagtcaagtcaactgtggtcaacctatcacatcagcaaaaattgcttcccaaaccgctaaaggaggtgatttgcactggtttttaatgatggaggaggtgttgtatctggttttatggttgagggaggcgattcaaccatgggcaagagatgaggaaggcaaaatggacttattcctttgcgaaacacaactaagacccaagagtaaatctagaaaggaataagtctactttgactccctcaattacagcacccatcttatttgtatcctcaattgaaataccatatatcttgacctcttactatgaaaagtggtgaagattgacttcctgagtgattttgagggtgcttttttcgctgactcaacatgtgagacccacttcagcgtcgacttctgtcttttctttcctccctctccctgtccctacaaaatcacacggcgactttaggcgaagcggtggcggcgtggcctcgaggtggagcgcggccaaatactaagggcctgtttggcacagctccagctccagctccacccctcctggagctggagctcagccaaacagtttcagctccaccaaaactgggagtggagttgggtggagctctctcacaaaatgtactagagttgtggagctgggtttaggcagctccacaactccactccagactcaactcctggagttatatataggagttggagctgtaccaaacaggccctaagcggtgtagcttaggagatcaaaatcatcacccacttcaccaggtcggcgacaccggcaccaaattgaacggagagcagagggagccataacccaggcctgcgtcgtcgaccgtgccgtgcaacagccctgcgacgatgacaacaaggcccgcgccgacctccgcaagcagtgccactgccaccgtctccatgcagtacgtgctgcatgtaagggtcaccactcgcgtgcaatctgaagaaaccaaatgccaaagacaagcagctcggtcgcttcaacatctcaaaagctaacgcatagacaaaacgaaggaagcaagaggatgggacaaagtcgaacatatctgcccgtggtgagccgccttggtggcattgaaggccctcctcacgaactcgtcgatatagtgttggaatataaagtgaattgttcatcttttcctatcagattaagctcttgggttgaattggttagcgcatgcaacttaatatggtatcagagctagaaaactcgagttcgaatcctggttggtacgcaattaaacaaaaattacagctcacttctattccacactaaggcttaagggaggctcgtgtaagggagagtgttagaatataaagtgaattgtccgtctttccccatcagcttgagctttttatttgaactatttagtgcatgcaactcgatacatcgcgcatttgatcgcataggatatcatcggcgccgacgccatcgcctacccgctggagaggaaggggtgatgatggaaagaagaggatgacatatgggcccacacgccaactcactcggttagactaggtcaatgatccacgtcagtgaaaaaccaccaccaaaaccactaagggagctattttacaggttttaaaagttggataacctatttggtattttggttcaaggaaataaatcagattgcatctgtattgagggacttaatgtggacttattccattcggaaatcatgtaaagaggtcatcattaggggaagcccatatgtaaaagttatgctgggctgttactcagacacgtaacccaagaattcagacttgcaatttcaataatttattcatgtcaaaattgcttttcggtgaaaaatgcttttatggatagagatattctccaaaatacaaattgatcccattgtcatataataaaaaaatgaaaaaaatataagtactttaaaattagagtgaaaatacactattgataactgatactccctccatcccaaaatataagaatatagtaccggataggacattttctagtactatgaatctggacagtctgtttgtctggattcatagtactataaaatatcacatctagttttagattcttatattgtgggacagagggagtaccaaaacttgcaacttggtgtaatttattcaattcgttttgcaaattacttaaacgagtcacctgtttaatttgtcgtctttttattacttctctagaaacactgaagtttgctatgcccatcagaactttcagacttgcaatctcaataatttcaggtaacaattgctaccgtcataaatatgttactctctccattttatatttttctaaatttagcaacatttaaaatataaaattagtttcattaaacttagcattgaatatattttaacaacatgtttgttttgtgttggaaaagctactatatttttctataagtttgattaaatttaagtaagtttaactagagaaaaaaataaaaacaacttataatatgaaatagagaaagaatatattttattaagaaaaaaccacacaatattcatgtatccaatctaatcttcttctctcttttttttgaaaaaaaatataattgatgaatgtaatctcgaaaatttgacctgatgtatgcctaaagatatttttacgatcactggtacatatatacccaaatttatttatctttttgttcgaatttcgtgtcgatgtgtttcgcctttatacatgcattaatttgaaagggactacagtaaatcattttcagaaaaaaaataacgattgcccaataattgtgtttctactgaaaaaaaaatagtacggccttctcttattcattatacatgactctactgaaaaaaaaattaaaaagcgcagttcatcccaaaattgctatctgtatatcctccgttcatatttctctggatcctgatgaaagagagttctgaatatccggttcttagaaaattctaaaaaaaagggcatataatcagctccaactgatcaaccacgccatggtgtttcaattgcttctggatgacacatctttccataattccatcgatcatattcgcgcgtgttcttactcctctgcttttcgcttcgccttgctagaactagaagggaacgctagctatctagaacaactagaactagatcggtcaaaaaaaaaaaaagagataaacccaaccaagagagatcgactagaaggtctaataacccgtttactttagaacgaagcagtgcgagcaccgatcagcaagaaaaacccccatgagccattgtttactcagttgacactggctagctggcgtccaccagctgaactagaagccgcagtgctacggaatgtgaagcaacttcctcctgccggctgccgctgcagtgcgcttcttgatccgcaaggcgctcggtctaggtcttcgtctacgtctagaaggaaaactacttgcgtgacatgaaacacatccccggaatatactattactccattgacaaaataagaacgggtaatataattaaaagattgtggtgtagtcttcagagaaggaaaagaaaattaaagattgtgatgtgtttcccgtatttctactggtaggagtacgacccatggaaggttctgtctagtatggcgaggtgggaccctcgccgttttgtcaaagctcgcctactactttatccactcagttgagccagctgctcctatagaatatttcagtttgtcggatttgccggagttttgttggctaaacaggtcaattcgaaaaattctagcgtcagtcctggcgcaacaacgatccatgctcctcgtctttggctgtttggcacggactggtaggtagaatggtagatggatgcaacttgcacagatcaaatgggaggcaaaacaccaagtgcatcaattctaatcaattactccatattttaatgtatgacgtcattgattttttaatcaatgtttgattattcgtcttatttaaaatttttatgtaaatattaaaaaatatatgtcatgtttaaaaaacatttgataataaatcaagtcatgataaaataaatgatagtaacataaatcttttaaataagatgaatggtaaaatattcataaaaagtcaatggcgtcatatgttaaaatacaaagggagtatatatcaaccagtagctagtttggccgcacgcggtaggttagtttctccccccataaaacattactaccacttctagttcactaattgctgtatctaatcacgtgggcaggggaatttgtctcgattttagtctcattttttaaaaccaaattcgttttcttagtttcaactactagtaacatgtctatccttgctaggtctccactgaccaattgggtgtactcgcccatccgcaaaaacacacaaccaccaacgcttctggattgctgccctttttttcttcctgagacgatcgtgacattattgcctggtcgggtctagaattccaacttcctagttattactagtcgggtagtcaaatgcattgcatctgagacgaactggcgcaagacattccatgcacgctcgcacgcgtgacaggtttatgatacggcctaactgcttaccggagcatcagtcacctgataaacggaatcggcgagaaaagcatggaattatccaccacctccgccgccgcgacagaccggcgccggaggggtgagtggtgggtgcgagtggggtggtgtaaccgtgcaagcgactatccggcggcgatatgatggcctaatccccctactaaacccatgtggactgatggcgatcgattgatctgtgacaagagatacatgccgaatccattaatcaggtttgtgtgatcggtttggactggtgcctcagaatcgcttggtttggttggacaaacagaagcgacaacggggtactttttgtgcaatttggtgctgcgcttcctttctgaattgatgctatagtgggtgacgaatttctattgtacagtattgtttgaacaagttatgcgtgtaaaacggtttggagaggaaggggaggtcacatgtctcgattatctatattactctagaagattaaattggtagtgaaaattaatgagtagcggatctgttaattactactcaataattaacatggggatcacgaagttggtgaatgttgtgctaccacctattcctaccatgagttgacattttttttaattgcacacaagatataagagcaaaaggaccaccaccacacaagcacgtcacactcacacatctgctaacacatgctcaaaagacgaaaaacaacggcatatccttgatcacactaaattcttataaaaaaacgtactcacttgtgtataatgtttatgaacatcaagatttaaactttaatagatggagtcaatgtacccataatcccatcttccggtgcttcccctatgagttgacatttaggatccactaaataatgcaccatccatttccaaagctgtggaggatgggtggaatcatattcaacctgctccttaaacacatgggtatttagttagtaggattgtaggaacataagaaaacaataatcagcattgtgttagagttattgattggctatagatgaagttaaagaaatttatgcttatattaaatttgttgttccaaacttgtaatagtgtttcggagagtcccttgttgatatggacaaattgtagagagaatagttgactctgtttttatatgtgccctcatatattcaatgttattgctaaaagaaactttccacccacatattgaccacatttgttttaactagagaagggatttacattttatatatataactagttgactatgcttttatatatgcccttgtatattcaatgttattgttaataaaaatctttccacccacatattataaaaatagatcgtgagccaattattcaatatatagctcacaaaaataagctaggttgtccaatctatatagaataagtgataatttttaagatttttatttaagtacatcttttaaaaattgaaaatagtttcattcttaattaaacctcaatgccatgtcactcaaaaactgctttgaatttggtcaaacattgaaattgaatggcgtaatgcttaggggcctagggctgaatactgtccggtctttcaagtttatggatgaatttaacttaggactttcattgaagtttagagatgtcaaatattgttttttttccttttcattactagaattgtagtcctgggacaaagttttttacacatttctgatatctacaaaccattttgttttcataacagcattgagattttgtatgttgtctccccgcaaaaaaaaaaaaaaaagaagagattttgtatgttgtcgtctcagcggagtgtcaatcctcttacacacaccattaagagtaacacccagagtatcatctaaaaccacaactccaagaagaaaagaacaacagacataccacaacgaacagaacataccatagttgtgaacacctcctacaaggagcgttcttttcccggccttttaaaaaataaaaagggacaccacaacagaacagaagtccttgacattctttgttattccaaccttctggttatcaattttttttctttgaaatgaacagcacaagatagttcgagtttcacgtattaatacagcaggagaaaaatataaatatgtaattctagaagaccatagacagggaaaaaaagagaaaagaacaaccacaccgcgcgtctataacacccgctacgagagcgaaactggagatcttcgagacgacacctccaagagacgacacctccaagaagagaatgacaacacaagatttttacctgaagaaagtaattgggagcaacaagaaaatgcaacaacaccccaagagaaaagcagcatcggcaggcgtcgtcgcccaaattttcgtccttcccaagaactaaagtcctgcacactccgcagccaccaccatcgaaaaccttcaacgcatggctaccgcatgggcgccacgacgccagccgatcgttaagggggagctcgactctcgacacgctccagctccatccgcgcagttgggttggatggggagagggtgagagagaagaaaggatcccctctcccccacactagcctgcccgacgcggccatcttttgtcagcaaaggcgacgtcgcaagaggacaaaagcctagattggggcccatgaaggaccgcggctcccccttaacagaacaagcgccgactccgccatgatcctgttgtccgcgtcacctcgggccactagaccgtttcgctggcgccttgccaccctccgtcacagtgctcccgccatccaaaacgtcgcggcactagaacatccaccgaagcacgatgctcttacccctgatccggtggaggggatagggtcttgtccggggagaggccgaacacccaacacgcgccaaaattaccatgtccagcgccagcatatatttgataatcctggtatccatgatagtttatagttaaaaaaacaataaaaaattactcaaaaatatttttttaatttatctgaacttggtgggattactaggcatttatcattatctcaccccagtaagccagagtgctgtgcggaaccagcgttaaagaaaagcacgctgattacacacctgatctagccatatcttgatccataacattcattcatattttttttcctttggtctatgtaaaacacagagcgagagagagagagagtgtgtgtggattatatcaatgtaagacatattaaccacttagattatgaaataaggactgttaaacaaagggattatactgactagtttagagtgtgaaacatatgtgtgtgtgtgtgtggtactactatctttgagttaattaattttaaggatctgctctgattggaggattgggacaatagtcaatatttaagatatggtagcatgttaccaaattaatcaagctggtgcatagtcaatgaataagatttaacatgaaagcgatactaatagctgggaggtgtacttcaggaatagccctccggaatcttgctatttaagagtattaaacgtagattattgacaaaactcaggccataacccctaggctatttt

SEQ ID NO: 79698 - DNA, 101960 bp, Oryza sativa
aaaactttcacacacttaaacttccaacttttccgtcacattattccaatttcaactaaacttttaattttagtgtgactaaacacattctaatgcgtaaagatttgcataagctacacgtagtccatttatggtgcttgctgtttactattcaggatcgtacgagagaacgcgtccttctctgttcatcgttttctgaactttgcagagatcagttttttgtccacatgtattcaaggttttttgacgagtttctgactgtattgaatgcttagcttaaggagggtgtgttgtagttggggaaaataaaatttttgggtgtcacatcaaacatttgaccggatatcggaaggggttttcgaacatgaatgaaaaaactaatttcagaactcgcctggaaaccgcgagatgaatcttttgagactaattaagccgtcattagcacatgtgggttattgtagcacttatgtgctaatcacggactaattaggcttaaaagattcgtctcgcggttttcaggtaagctatgaaattagttttttcattcgtgtccaaaaacatcttccgacattcagtcaaacatccgatgtgacacataaaaattttcatttcgcgaactaagtaggaaaaatagaaaagggaaaccgtaccgttttctccccctatcctgtcgatgtatccgcgtgcgtggataaagggcgagaaaagcgaccggtcaacctccctatcgcttacactcacccggatctttcccaaaccaaccttgccaaccccagatcgagcatctgagcagccgccggcacactctgcctcctcctcctcctcccatccttcacctctcaagtttctcacaagcaaagtggaggcccacgacggagggcggccagcaatgcaaagctggcgatgggcagaggctggcgaccacccgatcttctcttgatatgggcagcggtggaggaggagggcgcatgcggctagtgaccgcggcatcaagcgatccctagccaccatcgatccagcagcaagcttgaagaaggaggtcaaggtggagttggaaattctcatatccgattttagttggattagagtccgattcatttagtcatttagtttcttttttccagatggaaatttggatatggtcttctcctatgtatccttgtgctgattttttattgggtggattagagtttgattcctttcagtttcgtgtttaactcgggaaatttagaatttggaaactacctagatacgggctacatgcgcgaggctgagatgacgcaccgtgatggatggagttgggaagcgcgttttgtgcaaccggttgcaaacccaactcatatctacaccgttcaatgttcattgagattcgtgcggagaatcttaatcttaactaattaaaagattattagtaattttaccagatagttaaatgcccgtgcttcggtacggtgtattaaaactaaaaatatttaagttcaaaaaaaaactaaaaatatttgtttttaaccaaagttatttttaaccgaagtctccaatgacagagagtaatatagtagctcataataaattattatttaatagtgcgttgcaatgggaaaaaaatactgttatgataatgattacagttattttatagttccatgggagttataagatatagttctagacataaacaataccccttctctcccaacgtaagcgacagtagctgcgccttttcccaccgcaggtcgtaaaataatatgatatggttggatttaatttttattaaattaaccatgattaataacgctctttgaaacttttttggaattttcggagcttcattgctaattttgacaatacaaacatcatttcagcatttatttaaataaaaatgtaaataaaaaccccaatttctctatgggccatttttagtctttttactgtctcatcccgtaaataaagtctaatttacctcctttaactccttctctgattgcgcaaacttgcaggtctatttggaggcccaatagtccgacggcccgagcgggagaacccggaaccatccgatcgaatggacggttcagattgatccaaacctacataaatatctgtagccaaaccctaaccctagattttatttccctccccacctccccactcgccccgatcccctctctccctcgaatcgaaaagcgatggcggccttacccccgtagtagcggcgacctcccccaccgagcagcgttggcggcgccctccccccacgagcggctactgtggcgcccttccccctctccccgcgagcggcggcggcggccgctccctccacgctgtctcgcctccctcgccggcagccgctccctctacactgtctcgccactctcgcccccttctcctctccctcggtggatacggcggcggttgcggcgggttgatggtggccgcgggcggatcggcggcggcttcctccacccccgtttgccttcctcccacggcaaaggcggcggcggccgcggtcggatccggcaacggcgactccctccgacggctgtggtggcgtcggcggcggttgcgacggccgaggacggctatggcaacggcggagggtggctgtggcgatggctggtggcggatccggcggcttcttcttttttatgtatatttttgtgaagttttgtgacgtattttgtgatttggtgattattgtggttgttttttttgggcaaagagtggttgagttttggttgtgtcgattttgggatgtgtttcctgtatccgactcagagctattgatttggaggctgcgaagacgccccgccaacggacgaaagcgccttcgtgatgaacagaaaaatacgataagataagatttgcttccttttttctgtgcagtagttttttactttgtgggagcctacataataaaataatagaaaaagaacaggaatataatgggtcggtttccatgttctgaaaagaaccggtctgttgtaaaaaaagaactggtcggttttaattttcccggtgaagaaaaaccactccttggttcgattagatcagatcgatcccctttctactttacagtccttttccccgccttgcttccgcttcacacgattgccaccgccgcctgctttctcgacgtcttcgcatgtgggagccgccgctcctaatgcgccatcctccaggaatcattgcctggctccctcgacaccccaacatccaggagctcgccgttgagggccgccacgtcctcatggcctccgccccatcggaggcggagccctgccgccgcctcctcgccggaggcccaccgaaccccctccacctcctcacgaaccaaccgccgcctacgacctgtcccatctatggggagatgaattaaacccgcctccgtgaaatcaggtcagatatcaccaattgctccgtgacttgttcgattgcttgtagtaactctttcgtgtatttatggggttaattttattcgattttgagttcaaatcgaatccgcatccaacttcctttcctgttgaatctggtatcctccctgcctgtctttgttcaattttgtttttgtttgcctctattaaaaatcgatttgttcaattttgttttttttttggattatttgtatttgatgcggactcctacaagtcgtgcagaaagcatgcgcactgaatcggtcaaaattttggaggacggacgaaaatttctgtgtgacgaacgggaaaatttgttatttacgcgaaggattttgaatctgtctctgttttttttttgtttggcgacgcaatgaacacatgtgtgcgggacggaggatgccactcggatttacggacgataatttttgggtgacgattggaaaaatatcaatcttttaataattattattaattattattattattagttaagattaagatttctcgtccgtcaatccgtttcgtccgtgcgattcttccaatcgtcaatgtctgattttgtcgttggcgtgtaattttccgatcatcacagtataaaggaggggagcgccagaccaccacacatcgctcccccgttcaccaagaccaccaccaccttatccctttcgcacgaccgcatctcccgcacacgcgcagtgatccggccgcttcccccgttgccgctctcttgtactaccagtacctgttgcctcgcctagctagctgctggcctggccggcgtcgcgtgccttcatggcctcgctcctacccagtccggtgttccccaccgccgccgccgccgcggcgtccacatcctcgtcctcgaggtgccggtgccggtgccgcatcacaacgtcatcttcggcgcacggttggtccaactgtcagggctggagactccatcaccgggtttgggccgcccaggctgctgatcagcaaggaggggtgcagcagcagcaacaacaagaagaaaatgaagacggtgtagtcgacagcaacgtgctcccctactgtagcatcaaccggaaggagaagaagactattggggagatggagcaggagtttctccaggcgctgcaggcccgtgccctgccctgcccttccctcttgttgaatccggctacctcctaccttacatacactatacttacaagtcaattgagtcacaatttaattcgattagattcctctttttccttctctttaggccttttattacgacaagaaggccgtaatgtcgaatgaggagttcgataacctcaaggaggagcttatgtgggaaggaagcagcgttgtgatgctaagtaagtggtataaaatattccttttcttctagcttgtacgagatcccggcccttactgtacactataagtgtgcatgccgctgaaaagaaaaagattattgttggaaattcagagataatcctatctatatccctgtagctagtttatttagctgctatcattttctggctgtctggttgcgcatgtcgtgtcatgcgccgtgatcggggcgtgtgggatggcacacactgagaaccgatcatggtgcactaaggtgtggatcgtggcgatttgcccatccgcatatatcgcaatggaagagaaacataaaatggccatcttatcgcagcacaaataccttgtgttctggatatactagttcatatcgtcttgtgttcgatatacgacagtgagtttgtgatagcgttcgctggattggtgccgttatattatgtccacccaatgcaagtaacattggaagctcaattcttaagacaacatatatccatcattaagtgaatgcgagacatccctgctaattttcaggaaaaagagaaaatgattgtaagcattcttatcaacactgcacactttatattttgagtttctccaataacattaaaacgataggagagacaggaaaatggatgaactgcaaacagaggaatgtttgtgtccaatttatataaaaaaaatactaggagaggtttttttttaattcagtcatgctaatgttgtcatgttaatgcttaatcgttgctttttatttaatattttttttcgtcaggccctgatgagcaaagacttttggaagcatccatggcttatgtggctggcaaccccattatgacagatgctgaatttgatgaactaaagctgagattaagggttggtctttcttgtccctagtaaccttatacttgctaaaatgtgtaatattaagtgctgtaaaaaatgaatgctattctaccttattatttaatatcagcgatagatttggggctccgctaattgtacttctcagtgctgtagcatggtaatgatgctaaagttgccttataaaaaacatgagttataaggctcagcattttgagttaaacggtaaattttagtaatttctatcatgatatttggttgtcagttagcttcagtgtaaaaatgagatttaaagatgaaaccatacatataaaagacatacattgtagcagtaatgtaaatccgagactgaacttacctgtcaatctgttattatttttttctcttggccagaaagagggaagtgaaatcgtacaagaaggtccaagatgcagtcttcgaagtcgaaaggttgggattgacttatttgttttattatactaattcatttttttttgtaaactgcagtttagttattacactaatctattgaacataacagatatggggaatttacaatagtaaagcttcagtttagcagccctaaaaagtagttagccaaatagcagtccattgttgtggaataaaaactgttgaacatgaaaagtacggtaagcaatttccattttgataagcatgctgcaatcatctggttaacaaaaagtattgtgtttaaattatgcctcttcgaagaactcggccccaaagggaaatacctccccagggtagtataattaagaagtatatgaaaccggggccaagaaaggtcacgaaagccaatcctcccgatgataaatcctaagctccattcgagacactcatggctatgattgacccgatctttcggtgagttgaatataactacgatttgggagaaacgttgacgaccccctacaaccgtacgagacattgttgtgttgcgccttagcgatcgatacatctctccgtgggttgttgatctagctggtgtagatcaaccttaatcctgcaagtagatcgaagaaacaagcaagaacaagctaaaagcaatctaaattgcaaataagaattgaatacaaatgataagttggggtttcgtaatgagcaaatcagcgatttaaccgatcacgggattacacagcaaagtagcgaaactaaactttaatataaacaaaaccctataaaccctgaaggggtacctagctatttaaggcggtgggttgacgacctaggggcccctagggtcgtgttccacctggttggggtccaccccacatgggcctcacttgggccagggtcccaaacaaagttacaagcccaaaggcccatgacaagtggcgcaataccttatttctctatttgccgatgacttgctaggaatttggagatgaggttggatctgttggaaagaggattccaaatgctttccatcaagtactcatggacccaaaacagagcttgtatgcacatttggcggtagtttgaagtcagcactgtagcaggtggccgaattagattccagaacttggtcaacttgatcttgatgtgagcgacggttgtattaatagtaaccatggtcacatctccctacatggggagcttcccctgtgtagatatctataagaatatttccagcaacatgctatgatctagtgtcaaaaaccatgtcatgtcaaaattaaaacaagaatagtttagcttagagaactattttgtagagacatgaccttattcacatcatcactattttgggtgctaatgtgatgctgtttagttaatctatcctggagtaacaaatttgttattttcgcaggtctacagtgacttgactgtcgattacttcaagatgttcctgctaaatgttccagcagcagttttagctctgacactgtgagaatcatatgacatgatgtcagagatacattttttttttgcattacgccatgtttaatatattttttcttgactagatttatggtcatttttcacttcgatgaagaatcattattgtttttggcagttttgtttatgtgtactaaatactgtgtttatatctaatctagatttcgtcttcacagattcttcttcctggatgatttgacaggttttgagatcacatatcttcttgaggttagttctaacaaattcaagataatataccaattgagatccatacagtactgctcactgacatgtgggcccgagggtctgtggggccctctctcataataatacttcttccttcccataataagttcatttttgcctcccatttgtcctaaaataagttcacttttaagcaatcattgtatcgtaatttgtgaaagtagggtataattgcactgggatttggtaaagtgagagtattataatcttttttggttttgtatttgtatgtgtgggatgggtaaaaaatgaacttattttaggatggagggagtagctaagtcaccaatatataatgtttctttagttctttacatgtataaaattctgaggatgttatatatatgacatcctcaggattttatacatgtaaagaattaaacatacattatagtcctataatttgttcactcacttgaatagattttgaaaagtcagaattaggtgcgacctttatacctctattttaccgtaatcaatgggccaggtggcagttaaagacgacgatttggctgcccggcttggtttgctgcatggacctaagtgcgcactaagacatgtgcatgatggggggggggggggtaattccagctaggaagtgagagttaggagtgatatgatggagggagtgaggggtcagaatttgtaatttgcataggagacaggaggggagggctgagggcaggcttgtttgggcccatctttccatagaagtaatgggtggtggatacatggttttcaatttcatcgtctcactcaagcacctgaattttgggaaagattgagcaccctctaaccactaccacatgcaccgcatgctttgctgcctctgcccctctgcatattgcatgcatactccatcctctctcccacttacccctcctctaaccacttcattagcaaattttaaatgtttttttctcctaaattacttatgcaatctacggtccaatttacatagttatatttgttgtaattaaatttttacaacaagatctcacatatgatttaatttttgatgaaaaaatagaaaatattatattccttattgaaatatttttatataatatatgaaacatcgagttgtaattgttgaaacatcacaaaatatttactgaaacatccaaaaaacaccatgtgcaacatttacaaatgaactagtgaaacattagaaaatactcattgaaacatccaaataacatcatgtgcaacataaaacagattcgttgcaacataaagacttaaaatgtgcaatacagttgaattcaaattgaaacattcacttgtacatgaaacatcaaattacaatggttgaaacatacatatatttttttcatcataatacaatcatgtacggtcttgttgtcgtgatttaattgcgatgaatacaacggtctaattggattgtagattagattattagtaatttaggagaaaaaaatatttgaaggttgcaaagggagcttcatgcatgtacagagagaggtcggtgcaggctgtgcacactgcacagggagagagagagtccatcagggtgaccaagcacaagcatttttgacatcaaagttatggtcggtggcctcatctaactttatttcaacagtacacaatttcataaatgagtagaagtagagcagaaatcacaaattattgtcacttacatcagaggtttgaggagatgattgccccttagggatgatagttgatagaatatatgaagtgttcatagattatatggtcctacaatacatgggccttgatataacatattagtccaacaacacaaggtcacggttcacaaccagttgggacatagatgtaggcatgctgcatcgaacattatgttcgctacctcttattagtgaccaagaataattgatggcgtatccgcatccgatgtaatattcatatctgatgctaattagagtacactgtattcatatccgatgtagtatctgacagtggtatggcactgtttgaaagcatccatgcaatgtgggccctcatacagtagaacgtgcatcatcaccagtaagggtaatatggaaagtatgggaatatagtgaggcacctatgggaggtagaaaagtaaaaataaaaaataaatggtttataatatagcagaaattgtgttggtctttttttcatgaacatcatttaccctctacataagcagagtaaatatctttaactgttctttgccaacctgctaatgtcattatgcttcttccatattttccaacaagctataagaaatatgttcacgaaacatcttccttgtaattggagtttggcttgttcaaataacgccattgttttaactgttgggcttcaattgatgatgccatacctgatatatgctttccatgccatgtatggatttttccagaaaataaatattatagcagtgccacgataaccatctaatagtaacctacaatgttgtttttgaatactgagcatggtagactcctgtaattctatatcatacgtcacttttggaacaaactgtctaattctacatcagaccttacagtggatctgatgccataaaacaaactttgttatttactgatttttttagataataaacattgttatttactgattacattcatgaatgatgcagttgccagagcctttcagtttcatcttcacatggtttgccgcactgcctctaatattttgggtagcacaggcaattacgagtgccatagtgaaggactttttaattttgaaggtattttcattgtcttatcatacatcgtgggcatgttaagtatggtacaaaatgacaaattttttgataactagggaccgtgcccgaactgtggcaatgaaaatctttccttctttgggactatactgtctgtgcctagcggtggtgcaagaaacagtgtgaaatgtgcaaagtatggatttgaaatctagtcctcggtttctgatgcattctatcttatattttaactaatgtggttactttgtatgtttatcagttgtagcagttcattggtatacgattctgcatcccgattgattacactcccagaaacagctgaggcttgattgaagatcacttcggtgagtcattaccctaatgacatgtctataaactgcatatttctggatacttttaagcatttgaactgttgataatgtgaaggctgaagatcatccaatagtttttacaaatgtaaaatttctggagaagagtaactgaatcaacaatttaaagaattaagtggggaagcatcatgtggaaatggtacactttttgcaaatttcatttcaactcggtctagaaattaccaagctaggacagacaaaatttctagtccaaattcaaacttaattggacagataaaaaaatacatacttactgaacaatgaacttgtcctctattttctgagtatttgttttattaaaatctagcaaatgaaattgattctcataataaaattttgcttgaatagaatatgtctaccctgtaattttttcaattttgttatgtatacctagggaaaataaaatttgcaacacttgtgctagtgtgtagttaggaaacatattgaatgtgaacgtggtaattaatgacagcttgcttggtggcatctaaaaaataacggagttggaaaatgccaacatatatgttattgacattccccacatgccattctcataggcgatgatatcttgcagcttgtatcttttcgatggcattttccttattttctcttaataatatgaaaaacaccaatttacattagcaggacaggagctgcaccaaagcaattccttgtatctaccatggagagcaagatgaacttttcatcttgtgacaatcgtgttgtgaagcatccttttttatactccttagtctgcctctttaaatattgtatatatttgcatttattaaaagtttaagaaatagctatgactatatatactgtataaacactttggaaagtttatattgtacatgaactaaactgtcgtcatatcatgatgaatgtctgactggcccatgcttattgagtaaatgaagttagcagtacatgaagacgcaaggtatatgcaatagtgcacagactgatgcacgaacttgtgtactgcgtgcgaatcaaggccaaatgacataacagggctgattttaacgtctttgacaccacgtaatcggggtgggtctagttcgcggacgttcgtgggactcgaacagtcgataacctctttccttgttcgttctaatgatacggttaactatgaaatgcttcttttccgttataatgacatggttaaccatataatttgctcctatcgagcactagtatttcattgtttcagttagatgttgttccctcgcatgaaagctgtctgagatagatgttccctcgcatgaaagctgtctgagttggtctcactatatatacgatcagccactgaattgattctattagtggcaaccttgatgaagatttgaaagctagcatttaaaagactatatcggtctgtatatgtattcggttagcctcttttactttgggtatcaaggtgattaccctaaaattaaggctaaaaattgggaactctctagcataaaattcattgaacataagcaataaatcatgcttgagaacatcccaaaattttcgctaaaattcagcgggaaagccatctggatctggcgccctatttgtttccatcccaaaaaccgcatctcttacttcctcctcggagagaggggcaataagatgatcattttctgcctccgacacttgggggatgtcatctaatttggaatcatctagggaaagggaacttacttccggtggtctaaaaaactttttatagaattttgtgatgtaatttttttgaagcatcgttcccctcaattttttcttcatcccggtctaggctaataatctgtttctttctatgtttgctattagcaatctagtgataatatttagtattattatcaccaagaagaacatcggtagatttagccctttgataccatttagtttcttctcccccaagtaggtgtgccaaccgatctctggattgaaagtgtctgtttccatattagctaggacatgactttctgcggtgatatcaagagtatcaatggtgtgttgcaattgtcctttctctatatgataaaagccactagtgttagttgcccagccttttagatggcgccataaggcattcatcttattgttccatctttggacagtgttttgccctttcaccggcttatcccatacctctatcactcgatcatgaaaatcttcccgcacttcaaaaatctcgcttgtgggtggtaatgacatgattgatgatgaagactctgtcccacagggcataccaagagcgtgttactgtgaaaacacggcggtctaggagatctacttaactccagtttaggtccaaggtttgcctcgattgctaaaggtgtacttgtattactgtactccagtaattttttaggctctctcgagtaaaaaagaaaatgttgatagtattactgtttatactatgttcggtgaaaacgatattattgggcattgtgatcgctgccaaagatatgaaaatgtgcacaaaacgtttttctggatcagctgctagtgatttgctgtggacccgatctccattctatttcttttcaactactcaatgtctccattcgttctaatgaatagtaagcttagcatgggactacgaatttagatatagttttgtccaaatttataattctacaatatgtcaaattcgattctaggttactatatattgagacggaggaagtactcacatgattattatcgagagaattatttgatccacatctctaaaaatgtttcttaaaaaaaatttcctaatgcattgtatgcatttcttgttctaatgcatttgttctaagtcgtttgttaagttatttatcaaaacatttagcttactaccccgtcccaaaatacaagcatttctagctatgaatttggacaattatgcgtctaaatttatagctaaaagttgctatattttctggatcagctgctagtgatgtgctgtggacccgatctccattctatttcttttcaactactcaatgtctccatttgttctactgtatagtaagcttagcatgggactatgaatttagatatagttttgtccaaatttataattctacaatatatcaaattcgattctaagttactatatattgagacggagggaatactcacatgattattattgagagaaaaatttgatccacgtctctaaaaatgtttcttaaaaaaaattcctaatgcattgtatgcatttcttgttctaatgcatttgttctaagtcgtttgttaagttatttatcaaaacatttaacttactaccccgtctcaaaatacaagcatttctagctatgaatttagacaattatgcgtctaaattcatagctaaaagttgctatattttaacaggtgtggtatatcatataatctactataataaattagtcaataatctattttaaactaggccataatctagtatttggaattctgtatgcagatggaacattaatcatctgaactgcactctttctctacgagcgattctgtcagtctgtcggtggccgctcctgtctcactccatgaatggagctgaactctagtgttagaactgcatttgacaaagctcatctgccagattaacgtggatgaaagttctgaatatattggccgatgtacaagactcgtggatgatcctggcaacatgtccacttttgctaatgttgatgccatatgcaaagattaaaagtagaattttttttcacttttttcacttgttgtagtgtgtagtgacgcctgatgagaggagcaataggtcaccagtcaggggggtggcccactggctaggctcacacatggccggggcccacagctttgggggttcatgggttgatgatggaaggttctgttctttagaccatgatggaatgttgatcttaaggtgccattgatcccacctctattattctcatggcatgttgtggaagaagcttcaggttcaggcccatgcattttgcattggtgaacatgagcaaggatgcatgaatcatgatgagtgaaagatccatccaaggagtgtatactcaatgattaatttcattttgctcttgatcttgtttggtttctccggccaacacatggctgtccaaatccagacaagcccaatcaaatccaatgcagtatctggtccggacagggttgtccttgtacttagctctgttgctgattgaaatggactagtatttcctgacactttttgcagaggaagggcatattgtcatgtgaaattatgctgcatccggctagtcttttgctcttctttcttgatgccaatactcaaaggaaaataagaagatacagtaaaaaaaaagatgaagaaaattacaaaatggaaaagaaaaggtatggatcatgcaacttctcctgaacctgttaatctgctcgaaaagaagaagataatacaaagaggagatattgatttgtgttcaccgacatgcatggtgcatggacagaaatgacaccaatgaatgatccttcaccaatgtcattttcttggattaagtactgagcacgtcctactctcacatcatttcagggaagctggagcttggagcctagaagcagataaaagagagccgacggtttggatccacaatgagcttgagatatctcgcattgactgaactgcattaattccatgcaggtcacggcgatttaatccctaattagctgtggaatcagaagatcatcaaacccccaaagtatagttatcaagcttaagttatcagtactcaagaagtcaagaaatatacggacactgtgtgcctgattgttcaccgcatcatcacaatccaacggatttcatggactcaaggggttcggaggcatcgccgcactttatccgcatgatttttgaccgcacattctcgatcggacgattcctgcgatccaatggctcccgtgaaccagcatcagcggctttttttacccctcttgcatctggaccgtacattctcgatccaacacggttcctgtggaccttgtttggttcacttccgaacattgccaaacctccatgccaaaactagccaaatgtgtggcttataaattgatggccacaccttagacaaggtttggctaaaagatgagtgtatgacatgtgggcctttgaatcgaaaaactttggcatacacaaatatcctaaaaagtgtggcaaagtttggcaaagtgagggagtgaaccaaacgcccctaaatctctgaccctccccggcgcctcttccggctatctgctccgtgaactcagatgagttcatgagttcatcataaaacccacaattctttttgtttttatataaagactcaaacattgaatatcaggttgttttcagttcaggttggcatcgattagaggtagaatgaagatggtgaaagcgagcaacaagtttgtgccgatagattacagtagaatttagcatctcacatcacattgagtggctgtacagtagttaaatcatgaatcaattcacgatcgagtcagaacagcggtttgtaacacttgtaaaggaaggccattgttatagtgaacctcatgggtcatgccgtcatggaaaactagatattttccctttttcagaacccacaggagaaaaatgcacgccattacatacaaatcagatcagatgtagtcaatgagctaagaatcgtgttgtgcacttcttaccacattgttagcctacagggctaacaaacaaagactaaatgtctaactctaactactgctcaagttcttttgcacacaagatgaatgtgcaggagtggactagtgaggttcaggccagcagaaactaattaatcataatcagcaggagtagggaggtaaacacgatggaagctcttgatccctagactcttcctacaagtagggcatttcttctgagccttgagccatgcctggatgcatttctcgcagaagatatgaccgcaatttgtcgtggatggcttgtccagtttgttcagacacacaggacaggtaaaggttggttcctttggagcaaccttggcatgcgtcgtactggtttgggccacatttttcggctgcaaaggtgagagcatattatgagttgcatgtaggagtacaatactaagcattaagaaaacaatatacatacaccagccaatgcggaattgcaattatcatcacagtacaaagaagatcaacttaaaaagattaacaaccttgctggtcccttcttccctatctggagaaaggcatataacatgtacagcaccctgaaaatttctgccccgggaaaatatagctccagcaacgccataaccttggggaacagggaaaacagggaatcatgatgaacatttgtgaggtatgaatcataattattgtatatgttgtagtgtcttgtaataataatctataagacagtacaccgatgtactatcaagtttcagtttcacctacagtacagaactatgggttagaattaatggtgcacatttcttatgtcacttggaagtatccaaatgtttctgagtaacacaagacttccaaatagttcttttagactaagctatgtggagttcaaacataagtaatgtacttacctcccggaccagtatccttctccggatccactacagccacagagcgcctcataatttttctgctcctcctctatcaaaaagaaacatcagcttcagcttcttgtaaaggtttcagttattcattcgcttaattggagacagaagaaagcaaaagcttactttatcatctagagcttcaacatcgatgggtgaggtccgtgtacccctaaggatcagagcctcatgctggctcccagtgttcaccactggagcagttgtttccaagtttataacatcaactttttgtctggatccatcatgggctcgcttcctagagcgtgcagtacttgcagtactcatgattcttatgatatttggaataacctggaaatcagtgagccacaattacttattgctgaatcttcagcttaagtaccctaattcccttaacagtttctacaagaaatgcccattttttggcaacatgcacaagatttgcgtatcattgcattaaagatagataggcaccaaaaaaaacgcagattgcgatcctgggcacgccagaagagcaaaagagggggaaaaaaacaaaactgagaaccctggaaatttggaaggaagggaacaattcaacaatactttggcaaaacaagagtcgagatgagaaatgcctgcaagcactgggaaatttcaagtatgtggtatataaagaacctgtaaagatcatctaatcaggcaattctcatgctcctgccgacttaaaaaacttcttttttaggtgttgtcaaatatcaattacaatgatatcctctaatctcagctctctacgatctatacacacataactttatatcacatttcgcagaacttatcacaacacacagatgcgcaacaacaataaagaaagaaagatttggggggaaacaaatgctcaccgagactgctaaaccccaaaccctgatcaagagtgcctgaatttttcccgaatccgtcacaattcacaacgaactgagggggatcagcttactaaatcaagaaaagtcttagcgagcccgatcccagacgacgatggaaaccggacgagcttgcttccgcggcggaatcccagagcaaagaacagatgaatcagatgaggcaaatcatcagagcagttaataaacggaaggggtgaattggcgagggggaaaccttacccgaatcggtctcgaacgaacaaccaaaacgaaccgcggcgcaaactcgctagggtttcgcttcgagttcgggacggatcggaaggaaaggggagtcgctgtggactttggcgccctcctcttcctctcctcccgcgctgggcttctgataggtgggccccggtgctgaccactcctcgtctcggactcgttttgatgggcctcaatcacggcccacacacgtagatgggccggataaaactgtaaaactagatttgaatccagatggactagctacgctcactaggccatccgattgggggctgtttagattgataccattttcaatcatactatattttttttagataaaattaccaaaaaagtgtctatatttagtttgttgccaaactttggtaaatatataagaaattctactaaaattttaggaatattgtcaacttgccaaaatttggtaaggtttattttggctacaatctgaatagcccctgggttttgagtgttcttgatccagtacgcaccgtatgtgcatttcttttttgtatgataatagtttcaagcaattcaatttacactgttttgtttaagtaaattcagaaggaaaaagaacagattgcttctagaacttttgaggatcagagtgcatgtgatgcgaccgttcatcagtcttcagattaagggagctctgcagcagactgccagcttcagcaataaaaagctatccaaaaaacaaaaaactccaaatctaccagaaatctagtttcatagattaatacgtgcataatggactttctgtgttgacaagggacaaattaaatgacgataagaacaagaaacagcccaagctttaacctgccattacaagcatgtaaatccagtacagaaggaaccaaacaatccaatacgtaatctaccattacagcaggcatgaactatactgtaatgtatatttccccacttccaaataaataatctatgaccaaatgcagtttcgaagctgatgaatcgcactggggaaacgaaaatcccattctctgcaatttacaagtacattgataacagcctcaaaatccatctctatttgcaccatccaaagcaggagcacttctgcaaattaaaaaaaaatgtagagctcaaatgagatcagaaatgtaaaagaaatcaagaacctagcggagccatcgtttcgcttattcgcggaataagtgaaacactatatttacaaacaaaaaataatttgttaataaaacttttatatacgtgttctagcgatttaaaagcaaaggctaaaaaataaattttgataaaaaaccttaaaatcagctaaatttaaggttgaaaatttaaattttggctgataaatataagcaactaaaaatgaggcccctatgtgcaatggttggttggtggagtggctcaccgtggaggcgaagtcgtcgtcgtggtatcgcttggcggcgttgccgtggccggcggcggcggcgccgcccttgccgagccccgccgccggcttcccggcggcctggccggtctgcttctcctccctcaccttgttgaagatgtgcgtgtagccgtccgccgacgccgggttcgagtcccagtcgccgaaccgcggcaccgccgaccccctcgtcggctgccattggcgatcacaacaacaaggtcacgaagcttgcaaaagcgtcatcaatggcggagaggtcgagcggagcggagggaagctagcttactgtctcgttgccgcgcggggcgccgccgccgccgcccttggcgcgggagttggcgacgaggccgccgccgtagctgccgctcccgctgtcggagtaggggtgcagcggcgacggcgacggcgagtgctcgacgctgtacgacgacccgccgccgccgcttgtccgcccgcctcctcttcttgccggcggcgtctcgccaccaccagcggcgtggcggtggtacggcgagccgccggcgtagggggccggcggcggcggcggcggcgcgtcgctcggggcgcgctcgtggtgggacggcggaggaggaggggctcggctcggcgatggcgcggcgatggaggaggagaaggcctccgggttgtcgacggggtcgttggggttgaacatcttgccggcggcggcgaccttgcccttgcgcgcgttctcgaagtagacggtgtacggcacgttgccgccattgtcccagttgccgaatttcggcacgtgcgcgttcttcttctgctgctgctgcataaatgcaaagctatatatgatcagccattgccgccatgcattttcttccccttctcacaattttggggattttttggcccgggcatgaaactatttcgcacgaaaaattcaaaaaaaaaatgcgtatgtggcaaaatgtatttaaattcgatcagaatttgtttaatgtttattttttttccgatccgaaatttaggtatactgagatagtggatcctgaatcccagtaactactatacagttttagtatactagatggtaaaacaaaaattagactataaaatatggtatatcacgatgtcttcttaagaattataaaaatcgctgacatgaccactgccacaattttaacctaaaaaagaacattttcttttgcatgtcagatcaacttctacaagaagccatatacaactacaaaaaaacagctgtgcgaattcatcaaacatatcgagattttgattttgttttcaaaagtcatactcataaggacattgctgaagtaaacattattgaacatgccaacttgacagagctgacttgctgaatcatgtactactgcctactacaagtggttgtaaatgagcagtctgaccagcaaaaaattagcaaaagaaaaatggagaccaggaactggtcaattgcacacacactgcatacatttgatgtatatggccggactaatcaaatggaacgtgctgattttctaatcggaattaatcaatcgttcacatgctgtggcttcaccacttggactgattaatcaggctggccagacaggaccgggctaatgcggcggttgggtgttcaggtctgacaattaatctcttttgtgtgccaatttgtcaaagcttctggagaaatgacagcgcaaggtaggtctaccttgctgacaccctacgtttgattaagattacaaaaagtgggagaaatttcaagtcaaagagacacagatgcatcatgcatgatgcatcccttatctcttcagttttggttatatacaaattcaatcttcaggttagaacagattttgaataatgtaatcgattaagggagaacaattgattatccaggacgtcgtattccagtgagttaagcagacaacatctatcttctatggcagtttgattaattgtggtatgaatactatggagacaatactacaacttaaatgtttattcacaaagaaaaaaaaacaacttaatgtgatggaaagatacatctcaaccatcaagaaagacttcttgcagatgaacacgtcaaggatattccttcgttcacacaagcaataagttattcataccattcaagttgagcaaactaggtggattcaagcagaacaagagcacaacaacagaggactttgttttccaagcgatgaaaccggtgttccaactaattaactagctaacactggatgacaagaaacaaaatcgtggtgatcctgttacggttctttcagaaaatccaggctcagatttcgcatccaaaaaccatggacagataaaaacgagttactctgaagttattaagaaagtgagaactgttccttcagaaatttcaggttcagatattgaaccagaaaaccatggacagatcaaacttagcctacgcctaacggtaaactgtggcagaaagagcgatggaagaacatggtcgcatgcaattgcaaggtatgcccatgcccaagaacagaagagcaagaagaaagagcaaagaaagcttaccgccatggccgacgaggagatcgatcgatcgatcagacgaggtagcagctagccgtcgaggaggaggggatgggtatgtatgcctcgtttcttcctccttggaaggcaggggctaagctagctagctatagctatagctaagcttagcttgtcgccaatggagtccttctcctctcctctctctcaggccggctggcttgcagctgcagcctgggattataaactccacgaaagggacccagaaggcccagccaagtcgcttctttgctatgtaccctctcatttctctgattttgcttaatagtcctcgtaattaatgtcacttcaagtcttccctagtctctcttgatgatgattaatatttaatcgttgcaatttttcagtggttatggaagatggcaacacctactccctctggttatataattgacaagttttaaataatgatacggtctctgatatatatctttaaccatgtccttctattataatatatgtatcacaagtttttgttttattataatactttgtaaattaaatctatatatgttattctagtgtatttaaaataaataaacttaaaactattgatacttaaagttataaatatttaaccttaattttgtttaacacatcgaaaccggaagaaaaactactacttcctccatttcatattttaagtcgtttttttctaatcaaacttctttacgttttaaaaaaatagtaacatatgtaatatcaaattagtttagtttagttaaatataacattggatatatttttataatatgattgtttgtgttgaaaatactattatattgtttttataaacttgtatatgtaacggagggagtacttcaatagttcactgcttatcgccagtaggtagcaattataaggccgcgtctgcatatagatccttatcatagagccaagttcatttcacgaaaatagtcaaaatataaggggtcttagtgaaaaaatattggtcagatggagcagttgactagcacactatagctcgaacgatttaacaattaacaccttaaaccaaagttggccatctttgaccattcgccggctcgccaactccatcgctgtcttcttcctctagcttcccaatcgacggatggattgttcgatgcttccaagctaaacacctccatctcattctcattttttttctttgtttactcgaactaaccacacgattaattctgtcctgttctatatgcatacgtacactgctgcaacctattcgtaattaattaacaagttaatttaaccatcatctggtcccatccggcgactctttcctccctgattcaacggtgagattaccggcgatcaatcgatcgattgatcaaccggtcgttgcaccggccgtcctcttgctgcgacgacgacgacgacgaggagacgcatggatggatggcaagtcaatgctcccgcgtaagtgtagatacaagtggactgcacggttggttggtacaacaagtgccttgagttgaatggtctcctcctctcctctccattgaccacctctaccttgcatagtcaaactgtgcattgacccccatttcatttatgtagtttggtttcttgctcactgtcaaattcaagggatttaactttatgcattgtttgaatttggttcctagggcttgtttggatttaggctaatttatgtcttaccaaatttttggtagtttcaaccgtactttatggatgtttggtttgatatcaaatgttcgccatactagtataaattgtattgtactctctccgtttcaggttataaaatattttgactttagtcaaagtcaaactgttttaagtttgactaagtttatagataaatatattaatatttataatactaaattagtttcatcaaattaataattgaatatattttcataataaatttgtcttgggctgaaaatgttaccacttttttctacaaacttgattaaacttaaaacagtttgactttgacaaagtcaaaatgtcttgtaacctgaaatgaagggagtagcagtttgactcccaatattttggtatggcaaaatttgggttcaaaccaaacaagcgcttagatttgtggagccaattgagctgggctaattttgggccagaatataagtttcagctattttacttgatgggctttaattttcaaagtccagcccagttaggcccaagcccattatattatttcccctctaaaaaaaatggaaaattaatgttttttttccctttgaaggaaaatttccgaggaacacctccacgtcgcccccttttcccattccgcctcctccggcctctccaccgctgcccccctcgccgccgacgaaaaccctagcggcatcgcctccgccgccgccgcgatgtactccgatagtgtctccgggcggaagcgctccgtcatggaccgcctcggatcgggcggcggtggcggtggcggtggcggtggcggtggcggtggaggcggcggaggctctcgcccgcggcctgactccgtgaagaggtgcgacttcgagctcgctataggctcaaatcgtcgcttgctttttgtctctgtacatgcgctgctagatgttacgggcttgcgactcgtggttggatcgtatggggatcgaggtgggtttgggaaatgccgcttagggcgtggaaattagggagttcgtggcttcgtgcgtggtgattgtagctttagggcgcacttaaatgagcattttgcatgttgattccaggttgacccacttagaggggagacatgtggttgcgaccagcggattgattagtcagactgagaggaaaatgtgtttatttttgtcttactgcaaatgtgatagccagtgacctggttagaatactgcatttgctttaaattcgttttgaaactgtggagagtgtagcattttggacagccgtgtcgtctgttgttgctgcagctaacctttatcactatctgccagtctatatgcatgcacgccttggtatagttactatagtattgtcacttttcttgtgttgtctttagttatcgcatcattaagtcatgtttaaattgctgcatcactgcagtgtttccacctgatgtgtaagattcacaaatggttggtatgatcggttggtttatatgttcccagattaattgtgagcacagaagcaaacacaatcctattgcttatatcttctactttgtggtttggacaggtttcgtcaggcagatgggacttggagacgtgaactttatatggactctgtgggagttcaaagttcatgtaagggacattcatagtatattttctaaacatacaattcatttttgcttcctgcatgatgatttaccattactgtattactttcgttttgcacggtgaagctggagttccttccagaaatatccaaggaaaccagaaaccacatttgcagcaaaacactcaggttatgaggaaatcatcagttccagatcttcgtgaaaaattgtctggagttcagcggcctcagttgaatagtactgtacagatcccaaagtctgtaccggagatatcaacgagcgctaaacctgttcaaaagagggaacctgtccaaaagagggaaccccctgttaatgcggcccttcctgctactaagaaagtgaacgaaccatctgcaccaaagcaatgccaggaaaaggtggtgacactgtcatattatcttctcacaaactctcgtcctgatcaactaatatgctttcatatttgttctagactaatgggacaataatgtatcattatgctacatcccttttatgtatttcgcgtgtgtaatgatgtgatggtggtgttcttgagcatttaatgtttctccaacctttattctgaattattgtctttttgtatataatcttatctatgtttaatctgcttgactgcttgttaaaaaatacaaacttcatctgcatagtattgtaccaatgtaattatctgtccagatgcttttatgattactttgggtttcatcattaaatattatcagttgaacattttaataatgtgtttgtttaaaatgtgcagactgattcctctcttgatagattactgaagtctcttgatgtagagaagtactcaataaattttcaggctgaagaggcatgtttgacttatttgggtattcaagtttttcatgtgttactagcctactacattttgttaatgcttaatcatttttcaggttgatatgaaggctctgcttcacatgaatgaggaagacatgaagtctttaggaattccaatggtactgtacgaatttggattggaactttgttttacatgcaggagctagtccattctttattattatttttttttcaaatgagtgtctagatgcctctgtattgccacctttcctactgtcataattttaaatatgcaagttggtagagcaggtttaagttatataacttccctgaagagtgaggattaacttgatttaatcccctattctcctgtgtgtttgggtgagctggggtggggctaggggttgtcttgcagaattattactaagatgtttcaaattatttagaattatgatgcattctttataagctacctgtctctcttttgacatcttgttagatagtataatctagatcggttactaatccaaatttctagtagcttttaatagagttaaatgatgattctctaaaatgaatgaagtggtataagtactgtcatatgtgcctttgtgtaccttttgcatctttcagattttatcctagggtttagtgttccactaatgatatttcatagatgacatgcgtctggttgcagacaaagcaagtacaagtggttatctcctgtgtgttatttccccctgttttcttttgtatatatagctaagtattccttcactttggttttttattatttcgtaaaaacttcataaatgttggctttgctaactgcctataagctctaaaatttagcaattccggtgtgcccttggtagatgcatgtcggtgatctttcttgtctatggtatgcgtgcatgccgtaacgaaactgaacaattgctagagtgtccattgtgtactagtgtacaactatccttccgattgcaatctacttacatatatttatttttcaagtttgtcagcctttatgagtagcgatatcattgagttttgcagcattatatgccttgattttgtgtccatatttattagatatcttgatttgttttcaggggcctcggaaaaagatattgtcagcattggcttccaagaagaagaaattatcaaaatcattacctaccagttgaatagttgatgcatctttaaacgtagtagctagatgacatgttgatttggatgtgtgcactgccaggatcaacccaagtaaccccatttcttgtataagatttccatcgagatgatgtacaaatagagaactgtgatctagcagtgctgttgtgaggcaattaacagcttgtcaataggagttatgttctgatattatgcggatatttagatgccaacatatgatgcatcggaattattttcccgtatcatgtaaacccagcccattattagcgtgcacagctagggagataaggagattttatttgtatcggcttttgggggtttccgtgggtttgtgcatcttttccttaacttgtcatttatcttttcgctttattcatagtcagctaatgtgctcaggtggagccgtggagctgtgaggttgaatgagatgtctcactcatttcttttggttagcaaactggtgcatgcttgtcgtctgctttctgtattttggatgcctgcttccaaattggaagatggaaaagctttactccgaccgatgcgtgaatgtttggagtaatctgaatatagcgatgattccgaacacttgtagcaatgcagatttcatgatctctggagattcaaaactgctgttctgccatgaccttccaacgttttggctcgaatttacaatgaagattcaaacaggttaaggtttcactagaaaatttagtcgaagttgaaatacatgtacacgatatatttctccgtagcttcaagccttcaagacactgggggagagaaggtacttgccaagttgcattctccatgacctcaaatataggtcatgctattgctgttgatgacgatgagggcaagtaacatgatgcttaatgtgttgcccctaaaaatggcatgtaggattggatgatgaggtggcagtaataattgagaaaagagaaggtgcgccacctctcatgcaaggggcaacctccatataaacccgaagaaaaaggaaatgaacgaaaaaggggattggacaaacaaataaaataaaattatttgggttataatgatagaggtggtgtagatgtggtgtattattttcccttatatatatcacctcttatcttacatggataaaattagatgtgacaactacctgtactataaaacttgccctgacgcggtttctgtaggtggggcccactgtcggtgagacaaagggtgggatttggtgggctccgtttgtctcggcacaggaggagaaaacaaaaaaaggataagtacatgttggctccctcaaaaagtataggttgaatataatttatatcgcttaacgagaatatttgatattctggttaagagatattgaatcatattcgacctatatttgagggtgtcgacgccaaatcagttaaagccacctacaaaaccaccgatgaagtcaaatcgtactggtattgtcaagatatctggtatactactccctccgtttctaaatatttgacatcgttaacttttttaaaacatgtttgaccgttcgtcttattaaaaaaattaagtaattattaattcttttcctatcattcgatttattgttaaatatacttttatgtatacatatagttttatatatttcacaaaagtttttgaataaggcgaacagtcaagcatatgctaaaaagtcaacggtgttaaatatttagaaacggagagagtacaattctggttgagggatatgaattaaattctacctataactctagggagcctaagtggacttattccaaaggaaaaaaggagtgggtttcggcccatctcaattctcaaaccgagacggggattaggatcagagtctggattccgatacggcctctccgtccccttccccctacaactaccagatcgatcaatcaatcaatcaattaatctcttgttcttcttctttggacgctcggttgaatctcagcgagaagcgatgggatccgtggtgtcctccgcctacgccgcgctgcgctcgttcgtggacgcccgcattgagaaggtggggtggtgggcgtggcccatgggcgagcggcggcgagagcgtcccaagactgacgccgagttcgccgcccggattgcttggattattgaacagtcgaatcgctgcaatcaccggggtcgccgccaccgcgaggaggaagaggaggaggaggaggagcggccggtggggtggtgggcgtggctcatgggcgagcggcggcaagatcgtccccagaccgacgccgagttggccgcccggattgctcagtcgcatcgctgcaattaccggcatcctcgctaccggatcgataaacaacaatcgccacgggatcgatgaatatcccccatcgcttatggatgttatgttagtctaagtttttttttttcattttctgaaagcctagacgagatttcattaaggggttatttggttgatgcctaagcttaccataactaagcttaggcaagttgtatcatgtggcaaaagtatggctaagaaatagttagccacaagtgtggcaatgttagctctagttatctgagtatgacatgtgggacctaagggtaggaaagtgtggcatgacacaactgtggcattgaaaaaacacagacaatgaaaagactcataaaatttctgaaagaggtgattctcagagtcctgcttcagaattggaagatgtgttcttggtgaaaacatcaaagcctttaaaagttggtaagcttatatgctcatgtgcttaattaaaggaagggaaaacaatgctcaacagtcctacaatgtgcatgctgtctcagaagtcagaacatagaacttttcatgaatgagcacagcaacctttgatagtaccagtattgtttgttagtttttgctcaagataagaaaaagggcattttctggaacggcgctgtcgtgctagcttcatgaagaaaaatgtttaaagacttgattcatacatggactgcacaacaggatgtttacattagcaggatgtttcggcagttttaacatggcatagctttttgttacaagtgtggcaataattatcactaagggaaaatagctcagggttttgagtccttgttttcgtataataatttttttctccaaattgttggttaacttaagtacatgtggagatctttgaagaaaagaagcttcgaataatcaaatgtagaggataaaggttctcaaaccttgtagagaatgaagattgctggtttcatgaagtagctgttgaggacaaaactaaaaatttatatgcttgattctgcagattctaccaaagtggaacagatatctcatagcaaggatgctataggtggtcctttgcagactagaaaggataaggtccaaggaaaggttgttgatgctcttcctcagaaagtgttgtgtgatgccaaagttgatggaatggatgcagcaacagcagattcccgcattccagaagatcgtgcttcaccatcatttgtttctccactaagcgaagagaatgcactgatagcatcaggcagtgatgtaaagataaatgacagtgctgttcaaccagaagttagtacagaagccaagatgaccgcctcctcagcaaaagttactacaaaagacaaggggaaaactcagattagcgatgttgtttatgacaaggcacatgatatcaactctcttgcatcgattgagaaatgcttggaattgtatcttgaaacagaggagagagaatgggcctgtgagaactgctccaaagttgttgagaagccaggcatcatgtcaagtaccaaggaggacacaacagctggagaccagagtgaacagtcagagaagagtgcataccaagtggaagaaaaccaaaatgagcagaaagataagaatgaatgtcccattcaaacacgtcttattcgcaagttgccacctgtattaaccattcatctgatgagatatttggaggattttaagaaggtgataggacatgtgagctttaaggaaatccttgatgtggggcagttcatacaggactcagagtttgaaggctattctatgcaagacagccaacaaattgctgaaagaggtgattctcatagtcttgcttcagaattggaagatgtggtcacggtgaaaacatcagagcctttgaaagttggtaagttatgcactcatgtgctgaactaaaggaagagaaaacaatgcttaacaggcctacagacgtgcatcgtgtgtcagaagtcagaaaatagaacttttcatgaatgagcacagcgaattgtgatagtaccactattgttgtgttaatttttgctcaagataagaaacaagggcatttttcggaacgacactcttttactagctacatgaagaaaaatgtttaaggacttgattcttacttggattgcagttcatcatgtttacattagaaggacgtttcagcagttttgacatggtatagccttttgttacaagtgtagctgtcattattgccacaggggagataactcagggttttgagtcgtccttgttttcgtataatactttttctacaaattgtggagattattgaagaaaagaagcttcaaataatcaaatgtagtggataaaggttcagaccatgtagagaatgaaggttactggttgcatgaaatagctgatgtgcgcaaaactaaaaacgtatatgcttgattctgcagattctactaaaatggaacagatcacacaaaacaaggatgctgttcatggtcctttgaagactcagaaggataaggtccaaggaaaggctgttgatgtccttccccaaaaagtgttgtatgatgtcaaagttgacagaataaatgtggcaacagcagattccctcattccagaagatcctgcttcacaatcatttgtttctccactaagggaagagaatgcactagcatcaggcagtgatgatgagaaaaatgacagtgctgttcagccagaagttagtacagaagctaagagaaccacttcctcagtaaaagttactacagaagacaaggggaaaactcagattagcgatgttgtttatgacaaggcacaggatatcgaatctcttgcatcgattgagtgcttggaactgcattttgaagcaaagatgatagaatgggccaatgagaactgctccatcattctagttgaatacagggagcccatcatgtcaagtaccaagggggacactacagatggaaaccagagtgaacattcagagaagataatatgccaaagtgagcaatcttatgagaagaaactattcccagaggttggcacatgtaacacagatattgttcaagcaatagttgaaggccgtgattctcatatcactggtttagaactggaagatgtgacccatgtggccatagaggaaacagatgatctgaagagatctttggggtctcgtaaggttataggacatgtgagctttgagaaaatccttgatatgggactgttcatggaccccaggtaatgacaactgcatctgttttttttttcttttcgaaaacatataacaattggcatttatatacagcaaattaatcaagtttcttatttgcagtaagctaataaatattatttttcctaatttgttccttttgctttagaagacatctctctgcaacaggctactttcagatgacacaagcattgatgcttgatggtcaatctttgtatgtccatttttcacatcttcttgctatgggtatatgaattattgtactgtgtgtgtcaaggtgtcatctagatgcctcatctaatgctaaccactaaatgtgcgaaggtgtcatctagatgcctcatctaatgctagtaattttgaatggtggttctgttattttgtgaaatggaaacaattaaacaaggcgacaatctgaatgttttaactgtatttggggaattggttgtgatttggattttagaataatttgaatttgtgtgatgttaagaacctgatttgattctactctactcttgctctttcctaccttttagagtcagattatacatccttagaacaattattggtttgttgataatatccatcgttctggccaaagtcaattcactgtagcatagtatcattcactattctttggctacctctctttttggtgaagaatcacaatctccttaaaaaaaaccttcactctgatatttagccaagaaagatgtgctattgtttacatcgagctatatgagctgaagtcttatgtctgctttgatcatttttctctctaatcttcagctctggcgacaaagataattcgcatagtccagttggtgttgttgagcaccagggcctaaggggacctctgaattttctaggagctacaaagtaagttcacaccttcaccttttattttctgtccatgttcctctttaacaaattttgatgcctttcaactgaatattacaatgatggatgtttctatttattagactgaataactgatttgtttgttaattacactcagtttcagagaggtcatcgagtaaaagcagcaagttctattgaaccacctgatgtccgaatcaaatctttcttatctgcactacttgccacaataaggattgggcagctggtttttctatccttatatgattcagttctcagctggctcccgtgcggcttcttttggagaagaggagggccacaagcccctgagcctgaatttagctggatctctgttatgggtgatcccgttattaacactgatggtaagtgttgctatcaatgctttcattttcagttattcctatctttatatggatcattaattgaatgaattgtttttattttaggaagctgcaccatcgcagctgccacagtgtgcatagaggcccaacacaggttggcctttgaacggctgtacggaaaaggttctttcccatgcaaagctaaagtgcctaaagaactgaagaaggcctgctaccgtcaagggatttggagcagcgaggaaggggcctggactcccgacgttcttttaatgataatggagaaaggcggtatcctcacgcaacgagtaccgaataacatccagcttgcaattgatggatttttttggctagagagaaatgtagcttttggaaaacttgagtttatgcgcctgctgtatgcctatggtcctcttctcagcaccctttggacagatgatggttatgcacaaacgtttggagaccgtgtctacagagggctacaaaaggatccagattcgggggaccatcattgcgttgtctgttttgcataccgggttgacagcaggacaaatgagctctacgttagaattatggacaattgtgcagatgatggacctatcagatgggtattatttgatgtgttcgatagcttctacgttccactgataaaaaaatcctatagagcctcatgaactacggagaaagaagaagaagaaagagcatagtatctttgcttacgcttccagttatttctccacattgaagagaaacattgttggatgggctgttggtagagagattaggagatattattatcctccgaagcagaggaatgtagttctgtgttgatagaagttgacttctggagatatcctttagagagaagtaacgatgttgttcttgataatgcgtttaattttctttcttcccctgtttgttggatagacatgcaattagtatagtaggacatgtgcaagtatagaaactgagaaagatgattgtatagccgctggtacagcttggtcggatggtactgttattttgcaattgctttttacagcactgtggaaatatctggaacatattgtttgaaacattgagctttgcctcttttttctttctggtggcaaatgtacaatgtatgcaagatgattaagaaccacattttttcattcctctcgttttctggatggatacactgtgaaacgatttttctctaatgtaatgtgtaaagagaacttacaacttttggtctgactttgaatgatctccattgatgaggacaagtactttcaaagcaacattacaaattactactacctccgtcctaaaatacttgtcattctaaattgtttagcatgtgctaagattagaagaaaaagactataatacccttaataaaatattatatagttaaatgtggaatgttggttgggggtatgatggggagatatttgaatttgaagtagttgatgtgacaaatactacttgcaagtgataactattttaggacaaattttaaatgccaaagagccaagtattatgggacggaggaattacaactgtagaacaacacagcttccccaggtacatgacgtttctctgagttcagtacaaacgttctgcgctggtagtatgtacagagtactgacatgcaacgtactgtaaatgaacgagaacagttgactagctgttccaacaaatcatctagctaccgaagaaattagtaaaacataagctaaaaggcaaagaggctatgccactactctgattgtttttctacatctccgttagcactcaaaagattccaagcatggttagtaggccttcactccatttttacggcttgagttggtggaaccttagctgcaagtattggatttaattttgaactgtcatattcatcccgtaattcctcaaaaagtcagcgcttggatgagcaaggaatgtaaaactccttaggctgtgttcggtttcaggggatgagaataatccctctctcacggaaaacggagcaatcgattagcgcgtgattaattaattaattattagcttttttttcaaagaatggattaatttgattttttaagcaactttcgtatataaactttttacagaaaacgaaccatttagcagtttgaaaaatgtgcgcgcagaaaacgagagagaggggttgagaaaagggatgccgaacacacccttagcagaggtataaacatagacacagatgaaaaccaactgtgaagcatattgtaaagaaaatgattcaaaacaactatcagcagttgagcttacaactctgcttcagcagtgagtaaaattttaaaaacatccaaaaagaagaactatcaccaggcccatagtatatcttatataatgaaagcaacaaactttcttgtataaggatgtgccacatcataaaaaatatattggccattggataaagagtttagataaacaatgaccatcggatcaaaatgatacatgcaataataaaaaaaacacaaatgaattgatatatatatatatatatatatatatatatatatatatatatatatgtatgtatgtatgtgggaatttctagagttctctagtgctcctattaaacacatgatacaaatagagagaacgcaaagacaatgaaggaagaaaaatacctagagggttccaatgattcattttataaatatgtagtataacttagctaaatctgtagtaggttgggccatcaatattttataaataaaaaacttattaaaaccaccttcttaaaagataagtttatacataagtttttaaacgggattgaaagtcgtgcaaagtgcgactacgtggctagtacaggtgagacatgtaaaggtgggtgcttcaaataacgaagacatgttgaaccctatgaatggaaaaactttgtaaccgaggaaattagaacattcaacagactagcaaataatacataaatacagaaactctcattcaattatccagcaatgtttagtagtaacgacctcaagaccttgaccgcatttaccacattattgttgagaagagccaatatctatggattattgattggactcttcatctgagcccaaatcatagtaagaaaccgcctacataaacaacaattgtgtcaagaaaagagtctctcacaattagctctatcgatttgttgtcataaatgacctaaaacttcaacacaggtaaaatacaaatgaagaaattccgaaaggaagctttggctctgcaaacatgttatgatatagccaagaaagcgtttttcacaaaaacaaacattcaaaaaaagagtggagctatttctatcatgcatatttgatatttcaacctatgcctctacccaaaatgtggttacaaaagctaggacactaaaggcttagggctttagggggagcttaagattctgagatatgagaagcggctggttgttagctagcttctaagaatctggaaaagctgggtttcctaacttctagcttttagttcattttctggattttataactacagcttctcaaaatctggaccaaaagatggactgtttgggggagcttctgattatgggagaagttgcaacagctaaaagctcccccaaatagagccttaaattcattaagggtatagatgtgaagggcattttggtcttttcctctagtcttgtaatctactatatatgtgcctattaggctaactccaattaaaactgttcattcattccccaaattgtgacatggtatcgtaacaaaagatccgccgccgagccgcgagccattttctcgtcatccagtcatcagtcgtcgtcagttgtagcagtttttgccattatttgtattcattctcttgtgtcaaagcagcagcagcagcagcatcaatcacctcctctagttgcaaccatcggctgcctcgtccatctgtcgtccaacgcgcctcttcacttcgtcctctgccacgtcttgtcgatttgtcttccgtcagcaacggagtgaatggatctctgccaataggctgctcctccccgagcccaaacagtgaaaatactggaaggaggatagggattaggaaaaagcaaataaaaatgaaacaaatggaacagtcaataacaaatactcccttcatttcatattataagttgtttgatttttttcttagtcaaaattatttaagcttgtaggaaaatgtagaaacattttcaatacaaaacaaacatattattaaaatatattcaatgttaaatttaattaaactaatatagtattgcagatgttatcaaacgtaaagaattttaattaaaaaagtcaaaatacttataatatgaaacagagagagtaacagtaacactaactactgacgcaggcatctatttgttaaattgcattcaaactaatcagacaaacatctctcatctgtctatcagtttcgtccaggcacaacataagtagaaatgaataagcttcagcgaaaaacaacagaaatatgagaaatatctgccttctataaggtgcgaaagagggcctttttgaaaacaaaatgcaggggtatttgtaaaaaaaatatggaccgttagcaatggtagcggtaataagggttcctttttgaaaaatgcaggagggaaggaatcctggccattggatctatcaccaacggttagatctccagtacaagccattcccccgccgccgccgcctcccccaccggagccggcgagccgccgcctccccatcgtcaccgccaccaccaccacgtcctcctcaaggtctacggctcggcgccgctgccgccttcccccaactagtgaagccccccccccccttccgcctctctgctcgccatccatgccccctcttcctcgccgccatgctagcagagtcgggggtggggcaacgatcggcatctctgcttggcggcggagattgcaagcgttcagccggcgacgaggttgtccgccgctcatgctcgccgtatagttcttgttgcctttgtttatgggtcgaagtagtggtcacataggaatggggattttaattccaaatgtttgtgcctgcaagttaaagggttttcgctgctaattataatatactcctataagacaatgcaatgcagcttccttgacgaaagcactagttcttgagatggtgaattggtgatggcacgataggctttggcgatatgtgcaatataagattggtcattctaaagggaattatggttttgctcttggaagtcttacatacactttaaattgctttcttatgtgtttttggacagttttgggatccatgaacagcataatgtggctgcactggtgcaacagttagtatggacaacagtcggtgattcatcaagcatggggcagcagctgcaatggcatggccgtgctcaaggaaacaaagctaacctatgtcccatcttttgaagcactgctacaaaattgcaaattgaaatttactcctcattagtcccatttcctgctgagttgttgccttattggtcttcctagtgatttattatgagcttttcaccccagaagaggttactgatccagctgtaagcatggtgttgattcaagaggaaacttaagtaggaagaaaggtataagtaaccgcaggaaggaagatgtcactagagtctcctgaggtccaaagaaccatctgggaagaaaagataagaatgaagtgcagaagaagcaaaagctctgatcctcctcaaataattttcttacttccttctgcatttggagtaatgcattgctttctgcactacttatagaggattcgtacagccacctgggtccaaagtttgaaagtgaaaagaaattttgaaaaggtaagaaattctgttcaccattcatcttgttcatgcagtcgaaaactttcaacattttcctttgatgttctgtcaagataacctggaaaatgctttgattatttcgcccaactacttgaatcctatgttttgctgtttctaccatattaccatcctgtaagtatgcacaggtgtgatgccaaattatgcaaatgtctcagccttcttcagttccctaactgtgccataatagcctgtaattctagactatgcttaccaggcagttttccgttctcctattcaaccaagaatgataattacacaaataggctatggaatgagatcagtgcgtggacagattgtagacattaaacttcagaatgttgtaactttactaaacatgagttagaagtatttgcatatagatcactccaaagatatctcaacttcactttactggtaacatttgctaattctttgtccttaaaaaggctagttcgcaatttagatctttaatttttatgggagatctagcttcaagtgtaccaacttttctcatgaggataacatttcattcctattttgttctaattttgcatttatggtcagtagaatgctcttattcttattcatatatgtatcttctaggatggctaccccacaattggacaagagaattcttagcgaacttgaacttatgggattccctactgctcgttcaattagggcactccatttttctggtatgtctatttcaaaaggaatacaaggtagacatattgtaataaactattttatggtaggctgaatggcatagtattcaattagaacagtaaaggatatttaatttcgtctatggttgcatggctgtaatcctgtttgtgaatttcttcaacacatatccgaatcggtttggttaaaacaatcggtctttatcaggtaattccagtcttgaatctgcaataaactggcttctggaacatgaaaatgatccagacattgatcagctaccactggtatgttatttataaaaaaataactgttcaacatgagttcattgaaatatgcattgttctgtaattggtggaataattatcaatcgggaaacctatcagaagtttttcacttcaagcattttaaaagagagcttccctctatatcagttacatacttacatagtattgcacattgtcatgtaaaatagtgcttttgttaattttcaccttttgttctgagtacttgctttcattttctagattccaagagaaatcaacattgaatgtggtgatacaccaaatgaagcgagaaatgacattcaaggaatgaggtcagctcttatttcttaaatggtttcagatgagagctgataaaatatcagagtattatttcagggaaaaggcatttttttccttccctgttacatagctacgtaatcaatcaagaaatctgcactctacatatccactgtatttttcatatggcaacagccagatatgtcctagtaatgctgtaggttcagaatctgatatacctcaagaaacaagtgtcttattggggatgccttacaagagcaattgcacatttgacctttggtactgctattataattgtaaaatgattgctatatggacctgtcctttagcctgtgcatttgataaatccgaacagttctgatgttatccattagttctcctaactggtacaagtacactgtatgtgttgatttcaccatgcatttttatcatgccatatgccattgtcaaatactttatgttacaaaatacaaacaagtggagacaaaaggcaccatctgttaatccatatagatttgtgaaacttgtatactcaagtaactcaaagaatgtatgatcgcattcttttcttcgatatgtgctgcactgtaaaatgtgtaataggcatggttgttttgtagggctgatgcccaggagagtaaaccagaagagtcaacagcagctggaagacagaaggtttactcagagaacttcctaattttgacaccttaaccattttccattacatcagtgtgttatggacaaaccctttattgttatacttgaaggagtaaaacctgcaaagtgcatcatgttgaggcaactcttataggaaaggttaaacaaggtggcaatttgcatcagtttcttttccaattttgtcagaacacatcctcagattctaatagtacactggactagaagttgtgcataagaacatacaaggggcaatagcaaatatattcccttatccttgtctcaaaattgtacttgatttgcatatcctgtttagtagtctagtgttattacattagacaatttgggtcattgttagatctgcttacagcatagttagacagaaaattaaggaatatttcagtataatttgcaaatttatatgattgaccaaagatattggtcaattagtgggctactttactttcgttgttactgcctaatgtgaaggatgccaatatggaacccatttcactttctagcagtttgtttttctacctgattaattgatctggattctgcagccagtgctttatactttcataaactgttgtcacacctcacacctgaacttcctgtatcaggaaacatcacaggtagaaagagaacttaatgcagatcaaaacgaggacgaagtcagaaggaggtatgtaatttgctttggacagatatcatgtctttgatgatattgtttatcgttctggtaagtctagcgtgcgtgccgtttcaggatcatagaattgttcaagtcaaaacaggatggtcaagaaagagaaagaggtagaatccggaatcaattacaagaggataaggtctgataaaacaaaatacacttttttgggtcttatttttcatctcacttcattttggtaaccacgcaataaatccatgctggcctgcactgtccccctttgggatgccatatgcatgtgatatgctgccttaagcccttgaagcagaaagctaccaaaaagtgttaggcaaattaaatgggaactattcatatgttccctatcatgtttttttacagcatattcctcatccctaattgttactggatggttgttgaagcatcataattgaaggctatagtacgacatgactggaatactatttgttaagaaacaacaagatgtttttttacagcatattcctcatccctatttgttactggatggttgttgaagcaccataattgaaggctatagtacgacatgactggaatactatttgttaagaaacaacaagacattgtctctttgaaattttttatttgattgcaagaatggaaatctattgtgataaacgtatatattatgctaactaacaactgaatcatatagtatgctaactaacaagtgaaccatatagtctacatgatacaaccgataataacatatactgtggtctacaatgtgtagtgcccctgtgctgacatcattttttttctgagagagattgttggactgcatcacatccttcagcatttcttgtcatgcaaaacttacttttgtcatacattgtgaagagggagaggattcgagctgctaaagatcttatggaagcaaagaggactcttgaggaaaatcaaagaaaacggtttgtttcatatgcaacttgtatgtgatattccaacttaagggtgcttacttaagacacggtttttttagtgcagtgtgatggagagtcgaaaagcagatcaagaggaggagaaaagaacaagagagagaatccggaagcgtattgaagatgataaggtccccctgatccaatggttttaacttttttttttaacttcaaaatttcccttcatcagtttttttttcagttcaatccaattgttttctaggatagttcaatctcctggtgccctcacaattgttcatttaaagtatggctatctgaaaccgtaaattcattgatcattgtaattgtctttttattgttattggatttccacattgactatgttattgccatgtatatcacctcagaccacagtcatatgcattagtacagcctacattttacaattgcagttcattgcatgacctccaaacaaccagctagttcaatgatgacattgcttattgccatagtgtgattacactattactccatgaccagagtgacatgattttagtacgcttcaatcagtgacatgctatgttacttgttgaagtaccaaagagccttaaatccttatctcctatgcaggcagaaagaaggcgaaggcttggtttgccaatggaaaacccagtagcttcagtcccaaccttaactccaacgaaggtctaaaatttccagagcacctctatttttcatgcgaccttgaaacaacatttctcacctttttagctcctcagataaaacctgttgaacctgctgtgtcaccagaacaactgagagactgcctacgaaatctgaaaaagaattacaaggtaaaacagtattctgattgcagatacgaattatgcctgcgatcattttgacaccgaagcattgagctattgactgttactggacactgttgatatgatgcttcgtaaacacaattgtagtttatcgtatatatgttcttccacatcatcgttcagagaaaatgttgatatgttctcaaaagctcaccctcgtagaatccaacaatttgtgcctcataaatgcaaaatagcattgcgttaggcagcaaaactcttgtgtcatgtttcagataccgtttcatgagttacatacatatcaactttatttgtaggatgacactactaaagtcacaagagcattccaaatactgctgaagataattgccaacatagtgaagaacccagaagaggagaagttcaggaggattcgactaaacaatcctgttttcaaggtaactatgaaaagcgatgtgcaaggaggcatagaattccttaattatttcataaaaactttttcattcatttctcttatcctgaatccaccattctcctcttaaacaggaaagagtgggcaatttgcaaggaggcgtagaattcctggagctgtgcggattcatgaagctcgcgatcagcggctacctggtaatgccgagggataatatcaacttggcacttctcaatgctgctggagttgaggtagcatctgcaatggaaaacccctactttggcctactctccaagtgaatggaagatcctttcggctacttcatcatgaggaggcagctggtgctgctgcttctctacatcgtacaatcctcctactagtgatcagtgaatggccgccactacaatgggtccatcacagctgctagaatctgtttcctgtcgccaacattcgtgtacgatatctctcggttaatttggaactaacgacagatctaacacctgggtaaaaaacactggtgcttctcaagttgtaacgcatacgatgtgtcatgtgtatgttcatccaggaggaataaaaaatgaaaaatatatacatcacctgcaatgctgttatggtaactacagtaagttgcattggtttctctcgttactgactgaatgacaagcagatcagggccatccatccatataaatggacaggtagctttgtctcaaaatttatagccatctcaaagaaatcaatagagagggaaaaagatcaaatacccattgttaatagaaaactagtattgtcagtggtagataaatggtatcgaatggataaaatttctcgatttgtggacaggtggtagataaaagaatagaaacaactcattttaaggataaattttgaactctaaaaatcgaacatttatttttttttgcaactgagggagtatgtcactgttgcttgtggagagaaacattaattggcatctgtcctcaagggagataggaatgaaagatgaaagaaagaaagggagaggtgtgctaggtcagctgcattgctgcttgccggcacatgacatgcttggctcaactgtactgtctctactgtacttggtgggcttcaattctggcagatgagaattgagatgtgagaggagccgtcatctcatctcacttccttccttgctggtccctcctctctactagtctcctggaagagaagagtgaagagaaggatagtgtggaggcaggggaccagcttactctgaagtctgaagagaattgggagattgcttcttgtcttgttgacaagctgcttctgctgctgctgatactgataatgatgagttggttctaatcatctggccattagtaggatcttgaaatgagaagtgtatacatgtgagttgggttgtgcaagttttttgtctttgagcaaggttagctaggaatgttcagggttggaacttggaagtagtgtggcaagaatccaaaaaactttgcaggcaagagtacaaaaaacattgcaggtaggcaggcaggcatgctgatgaatggaacgtacgtacacatgggcagatcaatcatcaatcttcaagtcatcaaggagccctattacatgtctgagaaccgtggcaaaatcactgtaccagcctgctatcacctaccagttttaaaatataagcatttttaggatttaaaatttatgtaacgatataagcgattccaggacactgattcctatgtataaaaatccaaacattttcaactcgtcagaagcttaaaaaggaaatctaagcaattcaaaattcaaccaataatacgattgaaagagaaatttcccatcaatcttaatcattgctaaataatctagaaatggtttattttaaaacggagggagtattaatttgggaggttctgttcttggatctatggtccatggaggcatggagcagtactgcaagcaccagcagtgtatagtactgtgacttgttaaaagcccttgatctgtctgcagcctgcacaacccatccgatcttctcgacttgaatactatgggtgtgtttagttggggaacaggaaatttttgggtgtcacatcgaacgtttgaccggatgtcggaaggagttttcggacacgaatgaaaaaactaatttcagaactcgtctggaagccgcgagacgaatcttttgagactaattaagtcgtcattagcacatgtgggttactgtagcacttatggctaatcacggactaattaggcttaaaagattcgtctcgcgatttcctccataactgtgcaattagtttttctttttatctatatttaatgcttcatgcatgtctccaaaaattcgatgtgatgtttttgggaaaaaattttgagaaactaaacggaccctatatcatcataatgtatgatcatatcatatcatcgagataaatttcagtaccatactacacctgctgatactgtactccacgaactaattacaaatgctgcttgaatcgatagatccatccatcatcgaaggcacggacctggatcacaggcaaaaatcacagaattaatccctttaggagagtagcgcctttcggtttttattttacggaccatgtaaatactttgttagtgtttttttccttctctatcaatataaaagtggtaaagctttcgcccttccttaaaaaaaaaaaaaagcctgcaggcagcaataatacacggaaatcagattaggctccgacaaaggcaagcaggcagcgatttgacacatatagctagctaagctagctagccatggcgatcgatggatgattgatactataaactggggatgggcgcacgcgtgcagatgcatagaatccaatgtcgtcgtcggctgcattgcttgctgttcctcgccagcgatcgagatcgaagaagaattagggccgggcagtagtgaatgcgagcgtacgtgaagcaggaggggacatggccatggctatcctgcagcttcttgaatgcctccgttgatgcatgattgatccgttccagaacccctggactggacttggctggatccgttccttctccttccattgatccacttattagggtttaccagaccgatgaaaaccagttagatttcacaaaaccagatttcccgccgcggggattggggtgctagaacggaatggcgggaggtacaactcgcttgctttactctactctatttatatcgagttcacactgatgcgagtgtctgaatttgaactgaaaggatgcatatatggtaaaaatagacaaactatagaaaagaaattaagtcaggttatatattgggcactgtcctaacctaatgtagctcctcctctatttcccggactagttggagattacaaccgctcagtttgtttatcaagtaaaaaatttcaaacttaattttaatattttttgacaaaatccgacctgatttttttcaatgcttttcaaacggttttcatgaacccctttttggtgaaaaccgttgaccccctttttttacgatttggtgaaccctgccacggatcgatccctaatgtgctaggatgatactagtaggagtatagtacagtatgtaatatgcatgctagtttttttaactcatcaattttatttccattttagaaatatagtagtacatgatttgaaatgcaattcattgcactgaaatgacttctcaaagatctagctctaattagttggccatgagttaattttcagccaaaatagcttatcaacgataaaaaaagtaatttatgactaaaattttttatacgtttcctttgagacttaaaatccaatattgagaacgaaaactatgttgaaaactaaaataaactccaaagttacgttttaaattttaaattttgctagctgttgattttatataggggaaacgatgaggttgctagtagcataaaaagggttgctaggattgacaagatgcgagatgttttgacattcataataggattgacaaagctgcaagatgttttgacgatcataagctaaaggattcaactcctgcatttttataaggactcaaatcgacgcatgggctcttgtgtagctcccacagagcgacccaggagtgtcttggctatggtgatagggcgaggccgtgatggatgtgtcagtattcaacaatggtggcggtggccgatcgactaacgtcaacagcaatgatattgtaggtggtacaatgattccaatggcattcggggtagatggaaggcggccattggtgtccgaatctatcgtgcctcggcaagctgcattggagtggcttcttcttctctgcattcattggatagcatcgccaagcaaaggcactagaaggtagagacatgatggcaaaggaaaaggagccagccaaaggtggatgaaatgtggagaggtgcaggagcttagacatatatgtggtgttcttttctcctgtaaataaaaatgaagatggagattaagtgttttacgtaaaacaaggtggtattaacatatggttggttaagttttagttattacaaacttgaaaaatagattaatctgatattttagagtaaatttcatattaaaagttttcgcacaaaacacacatcgtttagtagtttaaaaaacatgtcacggaaatttttatctttatctaactctcgttggagaaatgaatgagactgtaatgatcgattccttgcgatttttgatgtagtaggtctcatcatgcagcataagattgaagcctagtatttccgttttctcttaaaactagaatataattattaatgtaacttttgattgtgtgtattcatttgtggttataaataatgaccgaactttcatccattatcttaaacaatactgccgcattctcacatcctttatccgctagacgattcatttctctagctaagctgttgatcaagtgactgattagcgcacctcaacaaccaccggtagctagttactccctccgttcaaaaaaagataaaccgcaggtttacgtaccaatgtttgattgtccgtcttatataatttttttttataattagtatttttattgttgttagatgataaaacatgatgaatactttatacgtgacttatctttttaattttttttataatttttttaaataagacggagagtcaaacattggacacggaaataaaggtttgtcttttttttttttaagtacgtctgtcactcactcgacctgtccgatccaaccggccgaacggacagacagccatccagccacccagccagctagctagccctctttctttcgatctttcttgtgcagcaacacggcaaaaatgcagccacgaataagatggcccggccagtcggtgcacacgccgactcatcggtcaagccaaccgctcaacttcatactccttcctaatccaaaataaaatcaattctagctattcatctgaatgtactaatgcatagctaaatatattcatatttaaaatgttactatattcgtcctaaaatataaacatttctagctataaagttaaacaattgtttatctagatttatagctagaaatgcttatatttgagatagagggagtttttttaaaggaaaaatatttatatttaaaaagttatcgagttgtacagttataaactttttcttcaaactttcaacttttccatcacatcaaaactttcctacacacaaacttctaacttttccatcacatcgtttcaatttcaaccgaacttccaattttaacgtgaactaaacacacccgatgtgtgttctggttacgtgtcagctgcttattgttgttggaacacatggttgtggttgctcttcaatgggaatggggttgcattgaacgttcaaaggcattattattagcacatgctgcacattcatatataggagatacatgcatcaagcaaacatgcataagtatgtggacaacaagggtaaagcaaatgtgtgtcgagatgttggtgcgatgcatctcgatccatgtgaaacgtcaccaccgtctagacggagtaacataggtagagagatccattacaatttcaggactcattcgggatgtaggattgaaaaaatataggaataagaaaaacatagaaatatgatagaaatgtaagtgtaaaacagagaatttgaaaacataggaatttcatgtgagtaggtgtttggatggagtaaaggaaaaacataggaatctttaagaaaataggtgcactattacaaaattatcacatgctactagtgaattaaacaacattaatcaacctaataatatgctttagttggttgatggcatgatttgcctcgttcccacgcagagggagagaaaaaagaggtcagcgtggatgtttttttcatgtgatcttccagtgatatggctagcgcaggaattttccctatgtatttcctacggatgttttcctgtgatccgaatgacgccacagtaaagtaatccataggaaccaaaaaccttcatttttcttgtgtttctcctccattccaaataagccctcaatggttaacagtatagttttggccggaggtataaacgagatatagtattttttttatgaataaagtccaatttacaccgttaactttgcgggaaaaaaataatttacctctcaactctttaataccatacgaattatcctctcctcccatccaaattcgaagcgattctaatcctatgtgatgcacaggacacatttgacatgtgtcgtcataatcagcttggtagaaatagacattatatcatctctctgcttaaatccacaccattgcccatcctttttctcctattgtacaggctagctcaagctctagttgtctttgtaggttgccatctacagcttgcacatagtcctgtttcttaagccatcactatttgttcagccttacttcttccgtttcacaatgtaagtccactataaaacggagagagtacttaagttgttgattggatggaggtcctcgtatcaaatggatatggaggctaagattgagtcatcatttttttatgtgaaaatgtgtcatcgggcttgttcactttgctaccatttttaaccttactttttttttggtaaagttaaaaaaaagtggctatatttagtttgttgccaaattttagtatgtacatataaaatgttgtcaaaatttgataaccttgtcaaaattttagtaaccttactaaaatttggcaatgccaaaacttggtaaggctaaaaatgatagcaaagtgaacaagcccatcatcggagggagtatgtggtggaggtggcaacttgatcttgatctagctattatgagcttgttgtcaatttgtcatcagatttgcgctagccgctgcctagtcatggctctaagcgtaagatctgaggccgccaccatcacagggatccaaaccaagattcattttattgtcgacttccttcaagctctaaagctatcttcagctatgggtctcatttaagctctagagccacttctagtggtacacttgtaagttactatagtcattttccaagccatccgagagcatctatatacaacatatacttcttccgtcccataaaaaaccaatctaatactgaatgtgacacatcctattactacgaatctggacagaggcatgtctatattcgttgtactagaatgcgtcacatccagtcctgagaaagaagagggagttgataataagaagatggataagagattgacacgtggggtaaaccacagttgctagctggattgcgaatagatgggaccaaaaccatactgcacagtactttgggggtaatttgtccagtgtaaaagaaattaagggtgaaggttatggaagtacagggtaaattaggcttttgtaaaagttgcgtactgtaaattggactttaaccaaatctttaagctgtgtttagttggatctaaagtttggattttggttgaaattggagatgatgtgactaaaaagttgtgtgtgtatgacaggttgatatgatggaaaaggactagtttagatccaaagaccttgtttagataggactaaaacttttaagtacctatcacatcggatgtttggacactaattataaatattaaacgtagactattaataaaacccatccataatcttagactaattcgcgagacgaatctattgagtctaattaatccatgattagcctatgtgatgctacagtaaacattctctaattataaattaattaggcttaaaaaatttatctcgcaaattagcttttatttatgtaattagttttataattagtctatatttaatattctaaattagtgtctaaatatagagattaaagttaagtccctggatccaaacaccacctagccacaaccttattcgcccgaaaaggaaacagtactacaacacttggcctgcaaattctgcactcgatgggtccgattgctctgatgaagcatgcatggggagaagaataatgcagctagtagtacttgtcgctgccagggttgtttttaccattgtgtttgtgtcatctgttgtttggttgttcgcagaattccaagggaaagcgtcaaacagccggattttgggcagctttcttcctgcgagattgatgattttttatctacttgtacagttctactcctactaggttgatagggttggtagcagggtgtcagctgaagtagtagtatgcttttggttttggaccatctaattaaacatttttatactccttctttgtttgatccttaaacaggatgcaataatgctaacaaggttggaccatgttatacagattttggccttagatggggtttctgtgatgttgatgttatgtcattattgtcagtatatacttaagcttacctaccaccttgattacttaagcagaaaaagatcaatattaccctgaacatgaactctccaattgtcaaaatcgcctaattatacacataccaaggttaaacaaactgagggctcacaaataaagtgtaatccggttcgaatttttggaccggatcaaaaaacacaaaccacttaatttttcgtcatttttttaaaaaaatcaaactgaaattttaatttttaacaaaatttattcagaatttattggtttttgtcgatttattaatggattatgcgaaatccaatgatacagcttgcaagcaaattttgattcagtatcgggactgtgaaccctaaacatagaatactaaagagaaacgtagcatcgcgtatcaatatcaagaaacaagttgaacacatcgggaacgatccaacacggaccgtctagcagcacgacggctactctcgccatctgcactatacacagcctcatactctcatccataaaataaaaaccttggttacgtcagattgcactcgagaaagatcacacaccttgcaaagtaaaaaatggaccagagggaaaaaaggaaaacttccagcacagtggctttgtgcctttgttcttcttaaagagctaggagctcatcttcctagggattgcaattttgcccatgggtccgggtatccgcgatacccgacccaatgggcacgggcgtaggtgtgatattttacccgtgggcacgcccgcccgagacccgtagatatcgtgggcaacaactgggtttcattttttacctgtgggtaacccatgcccgacccgatacatatgtattagctaattttgacttatctcttaattcttatactcctttctcatggttcatttgtgatactaattagtaataagttgtgatgtaattcaaattattgtcgataactgataatttagtaaattgttgattttatttctctttgttaaattatatatctttcgagttattattcatgtgtgatccattgggtacccaccgggtatacccgtgcccgtcgggcatgggtacgggtatagagttttgcccgctaaccctagtgggtagggtttgggtgagcgacgacgagcatggggtcaggcatggttttgctctacccgtgcccgacccgacccgttgccattcctgcatcttccacatacgtaaaacggaacgacttattagtacataattaattaacttttttagaaataaattaatgtaattttaaaatcaacttttctatagaaatttttgcaaagaacataagctctgttcggcaacaatactctgcagctgtaaccaggtgcgttgtatagccggtgtatatattttctttaccatgcactgtagcggttgctgctgtacagctgcagtttagctatattgaacagacccatacttcctccatcccaaaatataagaatctagtattggatgagacgttttcaagtacatagtatttggacagggagtccgtctagatacgttatactaagaaacgttttaacttgtcctagattcttatatttggggatagaggtagtaccgtttaacagtatgaaaaaacgtgtgaaaaatgagtgagataaagttgagaacacgtaggaaagaacacatcctgagtcagtcagcaagtgcggtgttcttttattttcgttaaagaaagaaaaaaaagaaaaattgcgcggatcaaacccatctcctctccacaatccacatgcgcgcagccgcgcgtggcgtggcgtccggcttgcgaccgcacgccaggaatcccgcggtctcgatccaccaccaattcaccgtcttccaccggcacacgcaccccgcgacgcgatccatcccaattttttttttttggcaccgggatctcaccctcgcaaaaccccgcgcggcggccacgcgcgcgcgcgcggggaggcgtggcgtgccggccgcggccaccgttttttgctgtcgcgctccacggtttcctccgctcggcgtgcgcgacgcggtgttggggttgtgttgccgcccgcccgcgccgcgacgacagaatcattggcggatgcacacacacatgcataaaaatgccggagcgtatgattgcatcttgaccagtaaacgggcaagcgtccaaatccacggaatattacgtactttgttcctgatgctggaactttacttaactaaccagatcagaacaaccctacttcttccgtcccaaaaatacccaaccttgcactagaacataataatacattagacataatcttgtatttagattcgttgtgctatagtatatcacatctagtattggattaccttctctaggacgtagggagtacttctcagccaaaaaaaggaagatcctcatgagcaatatatagcatacacttcgttgcataataaatcaatttttatagaagaaatctgaacataaattatactcccttcgttctataatataagaatttttgactttttacttgcactgtttgaccacccgtcttattcaaaaaatttatgcaaatataaaaaataaaaagttgtgcttaaagtattttggataataaagtaaatcacaaataaaataaataataatttcaaaaatttttaataagacgaatgatcaaacagtgcaattaaaaagtcaaaatttcttatattatgaggggaggggggaggggtattcagattcgtatatgaaaaataatttattttcgagagagcaaattcttgtaccaaatcagcctttagaaaattgtgggattgtaggactggttgctcttgttgttggccaaaaaccgatcacgattggttgacatttgcgagcaaaatttggtcatttggtgcatctaaataaacatttcttacgcaacctcgtaccaaaatggatggaggtggcaatctgctcacaccctttttcaaaagataatacccccaaaatcgaacctaattatccaattatgctacattgagatggatggatataggcacatcgcgacagtgctctatcaggcttaactctgtcacatacatatgaccacctgtcaggctgtcacggccccagcattgacatttggatgctctcgaccaaaccttttggcgtctgctttgccacattagtccattattatgaagaaaaagaaagggaggattagtgcaaaggaattctttttatcaggtcaacatcattaggccgatgagtaggacccctagaatgagattatactagtatgctattagagtattagtgctatactgctactaattgtactcctgcgtcggtgtcgcgcaaatttatgagatttcgacttctggtcataaatttcgccaaatcatgtgacatcagagggtaatcagcatttgaaatggcgctccctccgtggaagtaaatgagttcataccataggaatgcacaatgaagtgaggttgataattggaagctttggagcaataaatttggagttatttaacgcactagcactgcagccagtatattgatttatttctactattactcaaggatttaccaaaccgttttggatatggttcccgtcacctcagtttgactggttatcggataccaaacacgatgttatcgcgaggcatatcatggtttcaaaaactgtattatttaccaaaccgttttggatgtggttctcgtcacctcacagtttaacggttatcggatatcacgaaaaacacgtattaccgcgagtcacatcgtggtttaaccatgcgaaaagttaccgcccgagataaccgtgaggttttgtaaacctgctcttactatagatcttcaaacattgcgtagctggagcctggacaagaactgaaaaaaaaaaaactctgccagatttacaattactactaatctgtactccagtagtcaaaagttttactaatttttaacctaccaccacccaggcaagcaggcacccacccaccatctgctgatcttgatggttgaatcaaatgcgttcctacaggacgcaagaacaaaccttttgatcgatccagggtactaggtttttgaattttggggggaattgaaacatgaagagaatgtttgatctcttgcaagttgcaacaagctgatgaacaggttctaatctttgcagttttttttttgcatttgcatttgcgaagaactgaatcaagaacagaggggagaggagaggagagatctatctatgtctggatcagtggggttcttggctcgagctgagggaggcaaccttggtcgccggcggcgaggtcagaagatgtcgaggacgtcgaggatggcggcgttgcagagcgggcagcggccgcggccggcgaggagctcgcgggcgcaggtgcggcagaaggtgtggccgcacgggatgaaggcggcgcccttggcccgcgccatgcacacgcagcagcagccgccgcccgccgcccccttccccgcctccgcctccgcctcgtcctccgccgccgccgataccgatgccgatgcggcggcggagggagacgcgagatgctgctgcacggtcgcgcccgagccggcgctccactgccgctccgtctgctccagcagcgccatcagggacaccctctccccctgctcctcctcctcctcctcccccaccgtcggcggcgacacagacggcagctgtcgcggcggcgtctccggcggcggcggcggaggaggaggagtcgccgtaaccggagcaggcagggagaccgcgcggcggacgagggggtcaccaccttccccaccaccaccggaagacgacgggagctggtcatcccggatgatatccagcaaggtgcgcgccgccgccgccgccgcggcagccgaggacgcaggcgccaccgtcaacctctcggccgccatggccgacgcgagggtgaccgcggcgcggcggcccgcggcgaggtcgtcctcgtcgcggagcttgaggaggtcgcggaggttgcaggaccccgcggcggcggtggcggcggccgtccccgcgggccccacggcggccagctggtccgccagcgtgacactccgccgcagcaccctcccttccatggatggatcgagctcactctctcgttcttgctgcggccaagcctgcctcgccgcgtgtgtccggacaaggcgagggggagagagagaagcagctgctgctgctgctgctttgggttaataaaagcaaaggaggaaagggagggaggagtggtcgcttggatctcggcgaggtgggggatttttcttcattttgcgggggtttttgtttgtcaatgtgtgcgccggtgcacggcacggttgcgtttggcgtaaccggttttggtttggtttggcaggtggtgggggtggtggtaatggagggacggatggggtgcggccgtgcgtgcgtgcgtgcggtcggaggcgtcggccggagacggtttctgcgtgccaatttggcccaaatggcacgaaaccagcgtgccaatttggcggtgtactgggctgtatgcccgtagcccactttgttggtcgtggaacatgacggcgatgatgatactgctgcattgtctgcccagtgttcaaaaaaaaaatcgctaggtcccggtttataaaaaccgatcaatattaaccttttttaatacattaaacaaaatttataagtttttattggtttttggttggtttacggtaaactgatgaggggcagttttcatttaaaagttttttttaaaaaaaatatcgccaagtcccggtttataaaaactaatcgaaattaactgtattctactacgttaaacaaaagtcaccactttttattggtttctggttggttttcggtaatacaatgaggagtggttttcatttaaaaacggaaaggtaaacccttctcctgactctcatcagtgagagtttcaatgcgagctgcagtatccagtagacatcagaattgattgaaaaaatgaaagaaaacgattagaatctgccgccgaatccgcgaggacagaatcgaagttgctatcctgtattgattgatgcatcagaacaccgaaattctaggagagttccaaagcagcaaacgagcaagtactactcaaagcatgctgcacattctccatcaaggaaacaagaggcctgaaacaatgttgcttagcttgcacatccaaaaatacttgggggaccaaagctcaagacatatcaagtagtaatatcgttgtattttctacctagtgtaaagcattaccaagcattagtacagtcctgtgttcttcttcattcttttccagggaagaagaacacgttcctcatgagaaaaaaaaaggagattacgaatgtgatcagactagctgattaagaacaccggccaccatctattcagctgggcaggaacgtattacagtcaatttgcaggtcctacaatgactcagccaaagcaaacaaaattggacttgatcacgacgtctactgaatggatccttgtccatccaaagaatgcttgctaatctaacaaatttacttccttcgacgttagcctccaattctctcatagaagaaaagagaggcctcgcacttgagaacttcttctagagatacttgtctgatgtcggtatcacttgcacgataccaaggggaagtgccaccgtcaggctgctcttgatttggtctcacgtaagcaaccatgtgccctgaactggtgctggggccaatgtgttcaatgacaccgactaggtgatagctggaattgtctttgtcctcagaactgaaggttacagaaaaacaaaagcaatcaaactagatgttaggcatggttattttgatctcatatcctcaatgctgcatattgctaacaagaatctcatatcctcaaacatttaacgaataaaggccctttaatgaatttcaacatgccattaaaacatgttggtgcgaaggctgggatatttatttcagtacctaaaaaatctatataattatacccttctaatgccaaatactaaaaccagaataaggccaaactaatatttttgaaaaaatgcatttggaggcacctaatcacctacaaacaaaaaggcagtcatctctaaaacataataattctgattttctaatgagatgtatcagtaaagctagtcaaaatatacaaacaagaaaaattgcttactgtgaatcataaatttattggaactgccacatgcttatatagatattgccatgcagaaatgctaatatgcaatacctggggtccatgaactgtcctacatcaaggatctcctcaaagttcacgtgtcctctaactttaccagtctccttggatctcttcagatgaatggccaatacaggtggcagcttgttaataacacgagtttgaatcccaccttgattcctattttcccgctctttttgttttgcatccacttggtctgcactatgatccacctttacttgtttccacttaccctgatctagactgctggtattttcctggccactcaacaggtcgtccggttcctcagctggaaggcaactagatacagcttcttgaacacgttcatggcaatcagtttttttgttggctatgttatcagaggccaagtcttgttcaccatggatcatcccagaagtgattttgttatggcttggtggtcgacctcggctgcgcaatgagtatgtgtgcttgacaggaggtagtgtgttgattccttcagtaatgctgtccattgcgagcatagctttacgttctgaatcagaaccatgtggttgcttacttgaagtgcattctagtgccaaactttccaaatttttagattgctcgctctggcgtgctaccttgtccaactgcacagtctgatctctgtcaattattgtgttttcgttggtgcttgccattatctgttcaccatctttactaccagtggtgctcagatggtgagaaactccagaacagttatcacatctccattccagcagctcttctttaaaaaatagtgctaggcactcttcaatcgatgcaagagagtcgttatcctttgccttgccataagccatattgctaaactgagctttccccttgtcttctgaagcaccttctacagagcaagcatttttcttggcttctatactaacttggggctcaccggacgtattctcaaaaccagcattgtcattttgccctaaatcatcagccttacttggcgagcgctgttccacttcaacagaatctgcagaatcaagcatatataaggctataatttatctgcatcagcaacaacacacaaccatcaacctccattctctacgatctgaagctgcctttcttcgagaatcaccatacttgattaagtaaaccaaccttctagagcaaaattttatgtatgaagacaaggacttaacaaataaacagtcttccactctaaggtcttaactgctagactacgacaaacaactctgccatgctaacagtgctcaaatatcatacttcttttatgtagccatcctgaaggtttactagatatttcttcagtccatgtgttagtaagtccttacaaatttttctctgtttgactagaattggagctccattccgaaaaaagtgcccgttttctcgttatgatgagaaaaacaatggtggtgtgactacaatactcctctgtttctttcatttattcctcaaaagatgtacatggtctgggaaaccctctatacctgcatatctgttcaaaaatgttctctctccttttatttagaaacacaatgcataaacttaccaccatccaaaggctcagatgttttctctttgtccacatctcccagttctaaactagcgatatgagaaacactgccttcagcaattgctttgacaatttcggtgttactcgtgtcaacctctgggaatagtttgataccagtcttctctcgagacatgcaacttatgtcccttggtggcgatgcaatactttttggcggaggcctctctgatggcagtggaactgagagctcatacattacttcatgggaaactgaattatatgagcaatggctgcaggaaatggtagcagacagttgaacacgaaaaatggaatcaacaactgtaggagatactggaggcaccattgacttctcctccttatccaattcattgagtaaaaagcaaagcaattcatggctatcttgcatatcactgcttatgaaccgtgcatccaaaacacgaatacaagcaaagaacttcgtggggttcagttggagttgtgcgttatcaacgttgtttacctcctgaaagagctctttcagttcataaccaaggatatacgaaggagcatctggtgctaacatccttgcccgcagcttgccaagcacaaataggcactgcaacaacgcattgatgtagcaagtgtttccaagattcggcatccctctgataacacagccatgccccttcactaatccagattcttgaccaaataattccttgccaaacaccatcccctgctcaacagtcggtgcactgagggtcaagtcaaattcacatttgaagcagtaccccttatatggatcactgtaccacaaaccaacccaatggtgttcaaacttccgcgcatgcagccgggcatgtccatgcggttttttcttggcctcagctctagtgcagaaatgcttgttgcatcccgtgcacaccatgatacgggtcctcccattgatcttacacccgggatgttggcacgccggaatgttcttggaggtggtgacctctgacacaatcagagtaacgtcttcctcgtccaataagtgtctgcattccgttctgtcgctttctgattccgtgtcatcgacctccatattcagacaacgttcacaaatgaagcagtacagagtgtccggtttactgaacaatgcagcgacacaatgctgctccagatcggcgtgccaccgggcgtgtccctgcggcttgtccatggtcccgtccccaatgcagaaaggcaagctgcaatcgatgcacaccaagatactgctcttttccaccttgttctcacacaggtaatgctcacacctcgcggcgaacttggaggacctgagctttgatatgaactgtaccatgtcttcctcaaaacgtacgaagtgggcacataactcctcatcggtgttgctggtcgtcgccgccgccttctctcccggcttgctcgcccccggcaaagccaggtcgccgcatccgggatcgggtacggccggagcaagcaggttcaggtccaggtccaggcggggggctttgagcggcctccccttgctcgccttctcttccggcttgctcgcctccggcgaagccgtgtcgcccgcatccgggatcgggcacggccgcagcaaacagatccaggttcaggtccaaatccaggcagggggcattgagcggcctccccttgctcgccttctcctcgtccatcccgcctaggggagcaagaaccacaagaaagaatcgagttaatccatccataaaatccacaacgaatcaacacaagccatacgaagattagcatgaaacaagaaggctaaacgatacaggcaaatcatcaaacaggttggccgttaggcgaggacgaccaatccaattccaacaacctcgacgccacgaaccgtagtcatactagggtgaactacgagagctcaacaagcgggaaaaccacgaagaacattccggcgaggaaccacgaacgccgcgccgccgcggattccggcaccaagtaaaacccccaccccaacccccaccgccaccgccacaactaccaccatcaccaacaacaacaaccgagcgatcggccccgcgtcggcgacgaacagagggatttgggggggaagaaatggaggggaaaactcaccggaggatgcgaggaggggcacggaatcggccggcgcgcgagccgcggcgtcctgcgacgacgacgacgacgacgaggccgaggagttgggagggagacggtgacgtggcgttgggcgggttgggtggtggtgggcttttgggcgtgtgaatgcttctgatccatttggcttaaatagccaggaggggaaatcaaggcccggcccagtaggtgtcaaccctctaacaggctgggctgatccaaaccaaggtcctgagtaacacgaccttaagttctaagtttagaagtgaatttcaaattagattatttataagaggctaagttcctaatttaaaagattcattaggttgtttgatgggctaagttcccgatttaagactatatatttaaatggatatagaggccggataaaaaatactcttctccacaaaaaaaaaaaaaagagaaatagccactatcctgctgctgatggtttgctctcacacaagcaacggagagctcaatatccactgtggtcagttatatataaacttcaatgaattgagtctggcaaccgtgaatcgtgatgggtgatatcatataaaaacgaaccaagagttgctctactgatgtagactgactctaagctataacgggttaagaagagcataacatacacaaggcccaagttggagggatgcagtttatctactgcagctttagaatgcctattcactttactgcccatgatattacagtcacacttgcctcaaggctaattatgcagctcctccaaacaaatgttttgatcatagatagaacatggggtttttttttgtttctatttcattaacctaaaccatgctattctgccagaaagaagcaaagggcagttcttcatggcaacagagaattgtccctacggcgagctgctatggcgctccagggccccctcgtgcgtccgcttcttcatgtggattgcgctgaaagatcggtgcctcactgctgacaactttgaccgacccggcaaaaaaagaaaaaagaagaaaagaaaaggagagcaaagggcaggacagcgctatcataagtcgaaaacatgtttctatgctaaagaaaacaagcaaaccatgccaggaaaattcatttgtgcaccactgtggaagcatggttactttgatttactggtttatttcgacaaacaaaaacaaatgtgcacacagtatgcaataattcacatgctcaatgcattcaggttttatattggctatgctgcaaggtactcctaccacaactcatccctaaagtgtatcctttggtatctgtgtccactgcgggtttctgttcaaaatcgctggatagctcacattgtgggatctggcccggtttctgcggaatctagcccaaatcggagaggccagaggctggaggtcccaaagtggagatgcaaataaacacattacaagtatccaccgtccagaacaccgtccagactggagaggatttgttcaccagagattccagtcatcctttcttgtttgatccatcagaacaccagaaactgtaggggacttccaaagcagcaagcaagcaagtactcaaagcatgctgcacatggtccatctaggaaattatatgcctgaaaccatgtcgcttagcttgcacatccaaaaaaattgggggactaaagctcaagatatatcaagtaatatcgttctgtattttagacctattgtaaagcattatcaatcattagtacagtcctgctcatttacaaatggcacatgtcctattccttcattcttattccaggaaaagaagtacgttcctcatgaacaaaaaggagattatgaatgcgatctatttgcagtcctacaatgactcagccaaagcaacaaaattggacttgatcatgacgtctactgaatggatctttgtccatccaaagaatgtttgctaatctaaccaatttacttccttggacgttagcctccaatcctctcgtagaagaaaagggaggcctcgcacttgagaacttcttctagagatacttgtctgatgtttgtatcacttgcacaataccatggagaagggccaccgtgaggttgctcttgattcggtctcacgtaagcaaccatgtgccctgatctggtgctggggccaatgtgttcaatgacacctacaaggtgatagctggaattgtctttgtcctcagaactgaaggttacagaaaacaaaagcaatcaaacaatactctcagatataaacaaatacgattaatcaaaactgcataatagtgcaaggataaaacatttaacgaatgaaggcccttcaatgaatttcaacataccactgaaagatgtaaggattatctatacgattatatgcatttgccagtgcaaaggctgggatatttattcagtatctaaaagctttatatgattataacccttataataacaaaagtactaaaatcagaaaaagccaaaccaatatatttcaacaaattcatttggaggcacttaaccacctacaaacataatggcagtgatatctaaagcataataaaattctgattttctaacaaaatgtattagtaaagctagtcaaaatatacaaacaagaaaaaaactacttgcttactgtgaatcataaatttattggaactggcacatgcttatatagatattgtcatgcataaatgccaatagtcaatacctggggtccatgaactgtcctacatcaaggatctcctcaaagctcacgtgtcctctaactttaccagtcagctgggatcttttcagatgaatggcaaacacaggtggcagcttgttaataaaacgagtttgaatcccaccttgatacctatcctcccgctccttttggtttggacccacttggtctgcactatgatctagctttacttgatctagagagctggcattttgaccctggccactcaactggttggccagttcctcagctgcaaggcagctaggtacaacttcttgaacaccttcatggcattcattttttttgttggctgtgttatcagaggccaagtcttgttcaccactgtccaaattgctagattgctcgctttggcatgctatcttgtccgactgctcagtttgatctccatcaactattttattctcactggtgcttgccatcatctgttcactatctttaccactagtggtgctcctacggcgagcaatttcagaacagttctcacatttccattccaccatctcagcttcaaaatgcagttctaggcactcctcaatcgatgcaagagagttgttatccttcgccttgccataagccatattgctaaactgagctttccccttgtcttctgcagaaccttctacagagcaaacgtttttcttggcttctatactaacttctggctcactgggcgtatactcaagaccagcattgtaatttttccctaaatcatcagccttagttggcgcctgaataatctcccctgggacctcatccttctgaatttgggaaggaacatgtacaccatccttgctttgcgagtgctgttccacttcaacagaatctgcagaatcaagcatatataaggctataatttatctgcatcagcaacaacatacaaccatcaaccttcattctctacgatctgaagctgcatttcttcgagaatctccgtacttgattaagtaaaccaaccttctagagcaaaattttgtgtatgaagacaaggactcaacaaataaacaatcttccactccaagctcttaattgctacactacgacaaacaactcttccatgctaacactgctcaaacgtcatgcttcttttatgtagccatcctgaaggttttccatatatttcttcactccatgtgtttagcaagccctcacaactttttctgtctaactagaattggggatccattccaaaaaaaatgtatgttttctctttatgatgagaaaaataatggtggtgtgattacaatattccttagtttcttgcattcaatcctcaaaagatgtatatggtctgcacaatcctctatacctgcatatctgtttaaaaatgttctctcttcttttatttagaaacaggatgcatgaacttaccaacttccaaaggctcagatggtttttctttgtccacatctcccagatctaaaccagtgatatgagaatcacgtccttcagcaattgcatgaacaatttcggtgttactcatgtcaacctttgggaatagtttgataccaatcttctctcgagacatgcaacttatgttccttgatggcagtggaactgatagatcatacattacttcatgagaaactgaattatatgagcaacgcctgcaggatatggtagcagatagctgaacacgaaaaatggaatcaacaactgtagtagacactgcaggaatcattgacttctcctccttttccaattgattctgtacaaagcaaagcaattcatagctatcttccatatcactgcctgcaaattgtgcattcaacatacgaacacgatccaagaacttcgtcgggttcagtgggcgttgtgcattattcacactgtttacctcctgaaagagctcttttagtgcgctacccacgaacccagaaggagcatctgatgctaacatccttgcccgcagtttttcaagcacaaagaggcactgcaataacgcattcacgtagcaagtgttcccaagattcggaatccctctgataacacagccatgcctctttgctaatccagattcttgatcaaatgcctccttgccaaacaccatccccctctcagcattcggtgcacctaggatccattcgaattcacatttgaagcagtaccccatatatggattactgtaccacaaaccaacccaatggtgttcacacttctgggcatgcagacgggcatgtccatacggttttttcatggcctcagctctagtgcagaaatgcttgttgcatcctgtgcaaaccatgatatgggtattcccagtgatcgtacacccgggatgttggcacgccggaacgttcttggaggcgaagatctctgacacgatcagagtgatttcttcctcatccaatacaaagtgttcgcatcccacttggtcgctgctgctgtcactttctgcctccatgtcactcatctccaagttcagacaacgttcacaaatgaagcagtacagagtatccggtttactgaacaacgcagcaacacaatgcttctccagatgagcgtagaattgggcgtgttcctgggcgtgtccctgcggcttgttcatggtcccgtccccaatgcagaaaggcaagctgcagtcgatgcacaccatgatactgctcttgtccaccttgctatcgcacatgagacgctgacaactcggggtgaacttggaggccatgagccttgatacgaacattgccatgtcttcctcgaaacgttctaagtgggggcataacccttcctcggtgttgctggtcggcgccgccgccttctccttaggcttgctcacctccggcggagccgtctcgccgcatccgggatcgggcgtggccgcagccagcgggtccaggtccttgcggggggatttgagcggcctccccttgctcgccttgtcgtcgtccatcacgcctggggacgcaagaacaacaagaaagaatcgagttaatccataaaatccccatcgaatcaaacaaagccatacgaaaaaaacagcacaaaccaagcatgaaacaacaaggctaaacggaacaagcaaatcatcaaacaggttggccgccgttaggcgagggacgaccaaaatccaactccaacaacaaaccacgccacgcacgaacccgtactcaggctagggcaaaccacgagagctccacaagcggggaaaccacggaaattccggcgaggaaccacgaacgcggcggattccagcaccaagcaaaaccccaaccccaacccctacccccactaccaccaccaccaccaccaccaccccaaccacaaccaacaacaacaaaaaacagagcgatcaaccccgcgtcggcgacgaacagggggatttggggggagaaatggaggggaaatctcaccgggaagacgcgaggagggcgccgaatcgatcgggcgcgcgagccgcgggcgtctcgcgacgacgaggtcgaggaggagttggagaggagaaggggagggaccgagggagggagggagggagagctggtttggtggagagggtggcgttgggcggttacttggcgtggtgatgggctttggagttgggaggcgtagcgcgtaagcgggcgtgtcgtgtgaatgcatctttctgccttgatggggcgtgaatagccagggcccaggggaaaggaaatcaaggcccggcccagtaggcgtcaaccctccaatgtgctctctgaataaatctaccttctcctcttctttctatactttttgccaataaagtttgctcctgcttttattactactatactgctccttataattttataattatatgagagctgaggcaagcctcctgccctttcttgtttacaggagcaaatccatcaaccgttcaacatcgaccacacagatcaagatacagagctgttgagcactggaaaaaataatgcacaaggtattgttcttttcaatcaacgatggtgcatttttttgtaataactttctctatcaacattttttagaatattatttaaatcgactttttcaacttttaagttttaacggttaatttaaccgtccatgtcctcaattattatcaagaactcagtttcatccatcatccgacaccactttagcaagccatgatctttacccagagagtcaaaaggcagtaggttggcaatgcagtatctgaaattctgaatcatgttgcagcatataacagtggtatagattgtccatcacagaagaaaaaaatctggagtaaagctcatcgaatcaagtacgatctcacagagtgtgcgcacttagaagtacaatctcacagaaccgtaccaatgctgatatgatatacacaactttctcacttcattactcctgctttgtttttaagtttttctttttcgttcaaaaaaaccctaatatattcctcatggacaaaggaaaaaaaagaatgtgaatgactgtaaccagatcaaatgatcaagaacaccagctaatatccccaactaggtacgtacatgttggcaaagccctgcaaggactaaatatcattcagccacaacgacaaaactggacctgatcacgaacccacgtcagtatatacaatgattgggtcactgtccatccaaataaaccttgatactctcaaatatctgcttcatttgtgattgctcttcggattctttggtgtgtatagaattcaagacatgtcttacagtcttagcagcccattctctcatagaaaagaaggtaagcctcgcacttgagaacttcttctaaagagatttctttgatgtcgtcatcggttgcacaataccatgaggaagagccactgccctgctgctgattgtttgctctcacataagcaacgcactgcccaatatgaatgctgaggccacggttctcaatgacaccaactaaacgatagcgggaactgaatttgtcctcagaactgaagattagagaaagttaaaaaaatactatcaaaccagatacaaggaactaactcatcataggttgatgtcaacaacttgtctttgttgatcttatatcttaggaactgaatattgttaaaaagaaatctataccttatctaaaaaatacacctctattagatatgagtgaaagactggtatagatcatgttgaatgaataaccatgtaatgtgtttaaacatcgaccagctatttaaacagaacattggatatagattcacatatatccatggtagttaaaagcttcctttatctaaaaaaatatccatcatagcacttgcacttaaaaaccatgaaaatatatcaaacaagttggattcaaggtacgcatcacctaaaatagaaaagcagaaagcaatcatatactagttcagattatttctaatggtatgccacagtggtcaattataaactgctacaacgaattgagtttggcagccatgatgggtgatttcatataaacaaaccaagagttactctaaagatgtaacctgactctaaagggttagaaaaagcataacacacaaggcccgaggggatgcagtttcatctgtagcatctttagaatgcctattcactcactataaagccaagcaattcagtccacttgcatcaaaactaattacaaagctctctaaaacaaatggctccatgatgactggaaaatgagttctgttagtttctaattctgtaacctaaatcatgctagtctgcaagaaagaaacaaggccagtgctatcctaagtcgcaacctgtttctacacctaagaaaactagctcacagtgccaggaaaaatcattttaacatggctacaggaagcatgcttattttgccttaccggttcaattggaaaaacaataaataaaagtacatacagtatacagtgatccacaaactcttaaaaaggtcacagaaaaaaaaataaacagacaaaattactcagtacctggggtccatgaatggctccacatcaaggatctccttaaagctcacatgtccactcactttaagaggccccaaagatctgttgagttgaatgactaatacgggtggcagcttgctaataagacatgttagaatcgcaccttcattcctatcttgctgatcatattggttttcttccagttggtgtgcattatgacccagatttacttgattccccctttcctgatcttctatgctgatattttgacactggacactcaacaggttggcctgcttctcagtcagacggcagctagatgcatcttcttgagcacctccaaggcattcaggttttttattggctatgctgcaagaggacgagtctttttcaacagagctcatccctgaagtctctccacaagtttttatgtccactgcaggcatatcatgattttgtacaccagaaccatgtggctggctacttgaagaactgcattctacagaaagtctgatcaaatcgctagatagctccctttggcatgttttcctgtctgactgttcagcctggtctccataaaccgtcctattcacattggtacttgccatcatctgttcaccgtctttaccacttatagtgcttgccttctgggcaaccttggaacagttctcacaggtccactctatcatctctgattcaatatgcaacttcaagcactcctcaattgacacaagagagttgatatcctctgcctcatcataaataatatcaagacttcgagctttccccttgttttctgaattaatttctgctgaggaaatgaccatcttggcttctgtactaacttttagcccactgaacgcattatcaagaacagcagtgtcagttttctctacatcactgactgatgctatccatgtattctctttcattgttggggactgcaaaggacaatgtacagcgtccttgctttgcacgatctgttccaatttattagaatctgcaaaataaagcatataatttttagttatgtcctcatcagcaacttcacgaaaccagtactcatcattctctacatggtttcagaatatgtatccgctacatttgataattaggagcttcttttcttcaaggacctcagcatgtacttaagttaaccaacaatatggagaaaattttattagatgaggacaaggaggactcaacactctgagatatcttccagtggcaatagtaactgctacagagctttgccaagttaaatctgctgaactatcatgtttgtttaatacgtttgtgtagatatcctgaaggttttgttgtttctgcaattaatatatgaatcaaatccttagacattttctctatttagctagtacaagaccctgctctgatagttaccattttccaatgctgagcaaaacaataacagataatagtgctgctatcacagtttgattcattcacgaaaagttccattttctgatacaccatgcaagtttggagccctgcttaaatcactttcatttcctttagttaggcacacaagcacataaacttaccaacttccaaaggatctgatgttttcaccatgactgtatcttccaattctgaagcaggaatctgagaatcaccgccttcagaaagtacacaaatcttacattgagatataggtctttcattctgtggtggtgatgcaacactattggatggagcaccctttggtggcaatggcactgagagatcatagaatacatcacaggaataagacttaaacgagcaacgtttgcaagaggtggtaacagacagctcactaccaaatatggaatcaatgacggtaggagccacagaactaggagcaccctgttgcttgtttggaggccttattatcttatcctcctcattcaatctattgcgcaaacagcaaagtaattcatggctgtcatgaattgaagtgcctatcaaccatgagtcgaaccttcgtacacaagccaagagcaacgcccggttcagcgggcctggtgcatgcctcacgctgtttgcatcaacaaagagaccacgcagtattgtaccaaggatccccaatggagcattcggtccaaacatccttgcccgcagctttccaagaacaaggaggcaccgcaacaatgcattcaagcaagtgtttccttgattcgatatccctctgataacacagccatgcccgtcagaagacccagatgcatgagaacctgcctctgcgttgactgccaatccctccttgccctcctcaccacctatgaccaaggaatcttcacattcaaagcagtaaccaacatacagatcattgtgccacactgcaacccaatgctcctgaagcaatgcatgctcccggatgtgcccttgcggcttagccttggtggctggctcaatgcagaaataccctttgcattctgagcacaccatcatgtggtgctccccggtggttaggcacgtttcattatcacacattgggtcacccttttcagattcaacgaaatccttgatgataacaatgttctccgtgtcaaacgaatgatgatggcacacgacagcattcttggaggagctgacatctgactcgatcctatcaatttcttccttgccacatgagaagtctccacgctgcatgttgctgacatccaagtccagaagacgttcacagatgaagaagtacagagtttccggctcaccgagcaaagcaccaacacaatgctcctccagatcggcatgccaccgggcatgtccctgcggcttgttcatggtcccgtccccaatgcagaaatgcaagtcgcagtcgatgcaaaccaggatactgctcttttccaccttgttctcgcacaggtaatggtcacacctcggggcgcaatcgtaggagtaggacctgagctccgagatgaacttgagcacgccgtcctggaaagggtcgaagtgggggcataccctcccctcggtgttgctggtcgacgccgccgccgccttctgttccgggctgctcacctcatccggcggcgcagtgtcgccgcatccagattcgggcgccaccgcatactgcgggctcatcccctttcctgtctccatcgcgctcttctcctcttccatcacgcctggggcgcaagacctgaaacatgcgaatccataaatccccaaagaatcaaacaagatatacgaagaagaatacgaactgctactactgctgctgctgctgctgctaccagggatgaaccatccaaggagccttaagaagacagcggactatggcggtgaaattgaccgaaaggcgagggttccatgaattgtacggactatggcggtgaaccatgaaagctaaacgaagcggaaaaccaagagatctctactaataggacaaggcgaaaccgaccaaattccggcgaggaccacgaacagcggccgccgcggatacgggtaccgcaaaaccaccaaccgatcgagtgaatccataaattcccatcaaatcaaacaagctagacgaagaacagtacgaacaagggatgaaccgagaagggctaaacaaggcaagcaaatcatcaaacaggttggccgttaggcgcgacgaccaatccaacccaaccacaaaaccacgccacgaactctagttagccaggctcaacaagcggggccaggcaaacccagagagatcacaacattcccggcgacgaaccacgaacgcggcggcgccgccgcggattccggcaccaagcaaaaccccccacccccaccctcccacaccaccaccacccaccaccaaaccgagcgatcaaccccgcggcggcgaagaacagcgggatttggggaagaaatggaggggagaactcaccgggaaacgcgaggaggaccccgaatcgatcgccccgcgagccgcggcgtcccgcgacgccgaggccgagccgccgaggtgggtgggaggagagagagagagagagagagagaggttggggaagaagcgcgcgtgcgaagagagagaggcggagatggtgcgcgtgctttgctacttaacccggccctgtttggatgggccgtaatgggcccatgagggtggccgactggtaaatgggccgtaaataaacaagagtcctaccgggcagtggccgttcttctcagaaagctattttcgttcttgtgttcttcctagatcaacttgttctagtttttcgcttttttgatgatttttatttctttacccatcatatgtaggcaaacttgctcgctggaaattggcaggtcccggagaaaaatgttgccaacaaaaacacatgtggataattgcaagcaatttatacacttatcatcatccatgcagaacattgaaagcaagaggctcaaagaagtaggatctcattgcatgttataacacggtccatacaggaaagcaatggaagaaagaaagaaaaaagctctttagaattttttgacagaaaaaaagctctttagattgatacttcaaggtgtatatctcaatcatcttgccaccagaaaaatatacaggcaaagctgaaagtttcaaacattatgttcgaaaaatttccatggtactgtaaagcaatttcaaaatagtactccctccatcccaaaatgtttaacgccgttgacttttttaaaaatgtttgaccgttcgtcttattcaaaaaatttaagtaattattaattcttttcctatcatttgatttattgttaaatatacttttaattatacatatagttttatacatttcacaaaagtttttgaataagacgaacggtcaaacatgtttaaaaaagtcaacggcgtcaaacatttagaggagggagtaccatccaacagatgtacagtaactgaactgtaccaatgcctatacaatcacctcggtcaattctctaatggcacatgtcctactatgctgttttttttttctaaatgaattcctaattatccattcctcatggaccaaaaaaaatggatacgatcagttggtcaagaataaccgaaatttctcaattggtatgtacatgttgcggtcgaattgaagtcctgcactgactcagccaaaggccaaagcaacaaaattcaactagatcacgagcctacgttggtatctacatactacactgattaaattggatcgttggccgtctaaagaatgcttgacaatctgacatatctgcttcctttgtgattgctattcggattagctgaattccaggcatcttagccttccatccgctcatagaaaagaatgtaagcctcgcactttagtacttcttctaaagagacttctctgatgtcggtgtcacttgcccaaaaccatgaggaagagccattagtctgctgcggaggacttggtctcacataagcaacataatgccctgaatacatgctatggcccaggtgctcaacaacaccaactagacgatagctggaattatctttgtcctcagaactgaagattagaggaaacaaaaaaggaccaaagcagatgtaaggctgtaactcattatagctctatgtaaacaacatcatgaatttcttgatattatttaatacatatcttatgaacaggatattgttaacaagaaatatctatctcatctcacaaaaaatatatcagtttaagtaaaatactactccctcaattccaaattgatctacatatttcataggtacaccaagaccaagaaaagctaataactctctcatactatatttattctagcaacaaactctatgcatgcaccattcccaatatttcctagccaatagcaaatcaagatattacatgtgggttataaatacttgtgtgcatggatgcatgcatcaatgtctatttactccaatgcacaaataacgaatagacttaataaataaacacaaatatgtaaatcatttaggaataacctcaaaaaaaactatatgtagatcaatttggaatggagggagtagtataaatcatcctaagcgaataacaatgtaaagttttaaaaaataaaaaaaatcatctgaaaactatttatacatacccaacatgtactaaaaatattaaaaaaacacaaatatatcaaacaagtcatattttaagaaataaaaaaggttggcaggttaggcatttcaaggtacacatcacctacaaatagaaaagcaaaaagcaatcatacatactaactcggatatttttaacgggatgtcattttcataaaaaaaaagaaaataaaataaaaaggaggataaccacaagggttactctagagttactctatggatgtagcctgattctaaagggttagaaagagcataatatacacaaggcccatgttggaggggatgcagtttcatctgcggcagctttagaatgtctgttcacacactattacagttaacttgcctcaacagccaacacacattacggagctcctccaaaaaaatgtttcaatgataaggtttcttttgtttttgttcctttagcctgccagaaagaaactaaagcaatgctatcctaagtcgtaacctgtttctatactaaacaaaactagctcaccaagtcaccatgccaggtaaattcatttttacatatcgatggctgcatgcttgttttgcttttctggttcaattcgataaacaaaaacaaatgcgcacacagtatacggtagcccacatgctcataacaagagtgcaacaaaaaaggacagactaaattactcagtacctggggtgcaggaacagtcccacatcaaggatctccttgaagctcacgtgtcgcctcactttaataggccccgtatttctcttgagctggatgactaacacaggtggcagcttgctaataagagatgtcttaatcgcaccttcgttcctatcttgctgatcatattggttttcttccacttggtgtagatttacttgcttcctccttccctgatcttcagtgttggcattttggcactggccactcgacaggttgactggcttctcacctagatggcagtcaggtacatcttcttgggcacactcaagacattcaggtttttgattgactatgctgaaagaggatgagtctttttcaccgtgactcatccctgaaatgtctcctttggtcatagtgtcctctgttggcataacttgatgctgtgcatcagcaacatgtggctgcctacttgaagaactgcattccccatccaatctgaccaaatcgctagattgctcactttggcatgttttcctctctgactgttcagcctggtctccatcaactgtcctattcacattggtacatgccaccgtctgttcaccatctttaccacttatagggcttgccttctgagcgacattggaacagttctcacacctcttttctaccatctctttgaaatgcaatcccaataactcctcaattgacgcaagagagttgatatcatctgcctcatcataaactacatcacaatttcgatctttccccttgtcttctgtagtaacttctcctgacaaagtgtccatcttggcttctatactatcttctggcttgatgctatcaagaatagcactcttagttctctctaattcacggtctgatgttatcagcacattctccttccttattggactctgcaaaggacaatgtacatcatccttgctttgtgcgatctggtccaatgggttagaatctgcagaatcaagcatataagttttaggtattctcctcatcaataacttcatgaaaccagcaaccattgttctctacatggtttgagaatctttatcccctacatttgattatttgaaagactattttcttcaaggatctctgcatgtacttaagctaaccaacaattcggagtaaaattaattatatgacaaggattcaacaccctgagctattgatgaaacactgtagcaaactgtttgccatgctgaaactgctggaacatcctgtttgtataatgctgacattctgaaggttctggtatttctgcagtccatgcatgaatcataccttaagcaattttctctatttagctaccaaaagagtgctgctcctaaaatatcctttttctcatgttgagcaacaaaataacaaacaatagtggtagtatcacagtttgccgcaaccatcaacaaaatgttccgtcttccaattcacacgcacgttttcaggcctgttcaacatcattttcctttatttagttaggtacaggaacacataaacttaccaactaccaaaggctctgatgttttcaccatgaccatatctcccaattctgaagcgggaacctgaggatcactgcctccagaaattgcatgaatcttttcggtgttagtcttgtcaattgttggaaattgttcgatggcaatcttctgttgagatatgcatctttcattctgtagtggtaatgccacacagagatcatagaatgcatcctgtgaaccctgtgaaactgactcaaatgagcaatatttgcacagagtggtaacaaacagctgaccacgaaatatggaatcaataactgtaggaaccacagcactaggagcatcctgttgcatgttatcaggcctcgttttactttcctcctcaatcaaactatcacgcaaacagcaaagcaattcatggctgtcttgcatagtattgccttggaactctgatttatagtggcgcacacaacccaagagcatcactgggtccagcaggtctcgtgtatagctcacactttctgtagcaacaaagagatcatgcagtattataccaagcatccccgatggaggcggagcgtccggtccagacatccttgcccgcagctttccaagcacaaggaggcactgcaacaccgcattcaagtagcaagtgtttccaaaattcggtatccctctgatggcacagccatgcccactaccagacccagatgcgccgatgacacagccatgcccactatcagacccagatgcgcgacagccttcctcgcctttgaccttcattcccttatcaccctcctcaccaccaatggtcaagggatcctcacactcaaagcagtaaccagtatacggatcttcgtaccacagcgcaaccggatgcccatcgtcgaacgcatgctcctcgatgtgtcctcgcggcttagacttcttggcaaaccttccaatgcagaaatgcatatcgcattccacgcacaccatcatgaggtgcctctcggtgcacatacaggtttcatcctggcacaccgggtcgccccaggacgcaatcttggacacgatttccgcaacgtcatgctcgctgcaggtcatgtgctcgcaccgctcgccgccgccgccggcgccgcctctggttgccaccgccgcggcctccctgtacacctccagcgaggcatcgccgccccatccagaatcatccgcatccagcggctcgatccgcggggctttccctttccgcgggctcctgacgatagccctatccctttccgccgcccttgccctcttctcctcttccatcgcgcctggaaccgaaacaaccacaagaaatcagcacgaatccgtcaataaaatcccccccaaatgctgtgcgcggggattacggaacaagcgaagaaccaccagaaaataaaaaaaaattgcaagaatccggtaataaaccctagcccaccgcgcggattagggatgagagacaagaacgagaaatcgggcatttccggcgaggagcgaccaaaccaaaaccgaagcgatcagcgggtgggggattgctgggagaaaacgcgcgaggggggactcaccggaatacgcggggatggctccgaatcggcgagggcgcgatcggcgacgagtcatcgacgctgcggcgcccgcgacgacaacgccgacgagatcacgagaggtttttggaggaagaagaagaagcggcttcgctggccggagcgagttgaggtgaaggagagaggaggcggttgctactttgcctgggcttatacggatgggccaaacgtgggtgggctggtatgggctcataagcatggatgatgggccaagagttgggccgtgcatgaactggaggcctagcggccgtgcttttccaatacttttcgtttggaataaggcccacttatgtccctcgtctttacatcgagtttaattgatgtcgctaaaccacaataccggaaatcgattgatcatttcaaaacagtgagtcaggtcctaaaatagtatcgatgtctattttagctaacatagcatcctagtcaataaaataaaaagattcacaagtaagtgggcttccacggttctacctctccccatctctcccctttctttcccatctctccgtactctatatgtgtctggtcgaagaacgagacatgtggggacacggcgagagcttcgcgacgtgcgtcggtacggcgagctcgagggagaggtcggcagccggaacccaccgccgccatcaccgtcaattaaatacgaataataagaaaaataaaacaaatgcataatcagtctttctcctagcttttcatacgaaattaaataataaacaatactcaaaagatttctctacgactagattatattatttgttcattaaagttaatcgacactatatgatcatactattactagtcgttaaatttagaaaaccattaaatagtctttactcttttttttgttagaactagtagtaataatagtcttcattcattcactatttaggaagcactaaatagcaaatactccatcctttccaaattgatcatcatatatatttatgcaccaagaccaaggataatttaaatcacatcaatcaagacatcatgcacacattctctcacaatgcatgcatcgattaaaacaacatgccaattacatcttagcatgcacacattctcccatgctgtattaattatattatgataaaatacgtgtccatgcggttatatgatgatcaatttgagaaattttgaattttattatatgatgatcaatttgggaagtagggagtaaaacccacgcgttggcacgtccattagttttgaataaatacggccattaaataggcccaatcttaatccggcaccgtagaaaagccagggccggccctgagattttggtggcccagggcgaaactataaacggggcccttaatatcacatacaaaaaataaataatatagatatacatatatgaatatattgcttgtaaatatttaaagttcatccaaaagcaatatttatatgaagaacctcacaaatatttcattgcaaatttcttgagatatttttagacgcgaattcattggtgatagtaatctcatctagcaattcgcttttcataaaaacatctaacgattccttctcatttaatcatttattttcgaggcgacataatgtgaagaatggactaagaattgtaaaaataatgtattagtgttcgaactcatatagattatacaacttaaattattagcaccgattaatccaaacaaatattttcttttctcaagcaccaagaggattgcacgttaatgttaatatattactagaagaaagcaatcaacaacactaaaattgccaatcagctagctagaagcccttgcagagaagagataagaaatcgggatcagctggaatcaggaataatatagttatctacacgtgctgttgcctttggcttttgcgtacagcgtagcgctaatctctagtctaattgcatgatcgcatccctaatcacagaggggtaggtggagggccccaccattttggggggccagtgcgcggctgccccgctgaaaagcgatacgtatatatatctcacactcgccgccactgatcaaaaccctaattaaacccgtcgttaattagcattctttcgctaagccggcaaactcaaactcttaaaccctaaaccccccgccgcgagcagctcagcatcttgccgcgtcggagatttgagcggcggccggtcatcatccaagctccgcccccgtctccaaatcctggtatgtatatatccatctttctcgcccctttagatcggcctctgttatgatggtctccaattctttctaaaccctagctgatgccgattctctctttctttcctctctctccctctcttttctctcgatgtgatttcgaatcctagatcctatatatatatatatatatagagagagagagagagagaaagaggtaaattaactggtgctacatgaatatgcatgctccaagattcaaattgagtatatacccaattttaatgggtatgaaattttttaaaatatttagatataaacattaacttctttactaacaagttcaagtttgaactttctttttgttagattttggttctaagtatataatatccaaacatataattagttaggtatgtaataatgaattgtgaaataaagttgagtttgagttgttttgttgttaggtatttgtatgaatcaaattcatatacctaggtatatactcacaatttgaacatttttaaaaatttgagagaatttgtgtgttttataccttggagcctaggcaccatggagtcccatatgggtatcctatatatatatatgtgtgtgtgtgtttatatatatgtttatatgtagatttggatccgagaaaactaatgccccatttatttcggtttaagattataataatatagattattgagacatattactgtaagctggattataataagtcgacattgaataagatgttcgctgcttgtttctctgatagatagctcttagccacctaataatctaaaaaatatttttagagtggattaattaccagattatagtaatttggcttatagattgtaatgatctattataataaactatctgtttgtttcagcttacttctaataatctacattataataattctaagctttcagtgcctaaatggaaaggtatagatttgtgcgatccgagaatgagggcaagcctgttggccttgcttgccacgaggcgtattcttgttcgattgctctgtataacttcgctctactgacgtggattcccttaccactgataacaccccgatttgtgactgagcaagaggtgaaatattccatcatcgcattcgtagaacataagatcaaagatcttgaaaaaggttggagctcaaatttcgattatctgtatgaggccgagaaagaatgcaaatgtcttgtgcatgctcttccaggtggacttcagatctgtccagctcttgacaggtgcagatatatatgcagtttctgtagattttgtcgtctttgtatttccttttaattgtcttgattcaagttgtgctatttttttctttctttttttagcatcacatcgttcaagacaaatggtggacacaacttatttagtttgctggagatccgaatggtgcacggttggttagctaatcccgaggataacatctatgagacggtcaggtccttctcttgcgatgatctggagtcacacatttctgatgctctgaatgataattctgaagctgcacagaggaatagggatgcaagcaaaagtaagattgtatcatcaaacatgttactcaataaatcccacgatttgatttttttttgttctactaatttttgtgtttattcttattgcaagatttattgggtgcaaagaatcagattacaagttatgggtatatatgttggtctcactagggactactatacacttttatttgatgaacactgcaattcactcatttaatacattatcatctggactacacagatatcagtctttgtgccaaggattactgaaggatgaatatgctatcctttatcgggggagtgacaccttcaatcttattcgcgaggtattaaccctatagatagctataacgtcggtcatcttattatttgaaaatatgatgacgttttgttttaataagctgtccctctaaattgttgatgatattaccgcagaaagatggatccattttgatcctggaaacagacaaatatattagatgcttacccccaagcaaggtggaggattctggaagagataaggatatcctacaacttccttaactctaatgatacaaaactctccaatctactaattttcctatgtaacaggcggatgaggaaccaatttacttgaattgcaaatacattccacttaagaatcaaccccacatcgctaaagtaagttgtagacttgagaatgtactcccaactcaccaatttcatgctaactctcttgcacttaaaaaaattataaataacaagtcatttgatacttattgtctgacaggcaaaactatggtactatgagaagttgaattcaagaaatgaatatgctccaagaaatgtaacaaaggatgaagcttctattcagaagccaacaggaagtgagggaaaactctcaaatcaggaagcaatattgcaaacgaaacaggcttctgatgagacactgcactatagagttgttcagttcaagcatgagaacttgcttactagcattatttgccacaagggatattcactttggactgctctctataaccatttagttttgaatagagctctcgcagtgaaaccatcggaagtaaaactccaatttctgcctgagagagaggtgaaagacgcgatcattgcacatctcaaacttgtacttggtgagatagaaaaaagcgagaaatcaaaacatgaaaagctgtataactgtgagtttatctggaaatgtttcatacgttctacagcagatactcatcagatctatcctgttcttgacaggtgcaaatagttactgtagattgcttgtcattacttctgtatctttgtatttctttttaattgttttgattcatgccgtgctatatttcattgcagcttcacatcattcaaggattcttttggacgtagcttaatttgtgtgctggggatcgaattggtgcatggttgggtagctaatcccgaggataacatctatgagacggtcaagtccttctcttctgatgacctggaatcacacatttcatcccttgatgctcggagtgataattctgaagctgcacagagggatagggatgcaagcaaaagtaagattgtaatatcatcaaacattttactcaataaatcccatgatttgattttttttttattttactatttgttatgtttgatttcttattgcaagatttgttggctgcaaggaatcagtttacaagttatgggtatgttggacactagggactatacttttattttatttgatgaacactgcaattcactcatttaatacattatcatctcaactacacagatatcagtctttatgccaaggattagggaaggatgaatatgctattctttaccggggcgatgacatattcaatcttattcgcgaggtattaaccctatagctataatgccggccatctttttatttgaaaatattttgtttcaatattttatttaatacgctgccccctttaaattgttgatgacactaccgcagaaagatggatccattttgatcctggaaacagacacagatatattagatgcttaccccaaagcaaggtggaggattctggaagaggttaggataccctacgatttccttaactctaatgatataaaactctccaatcaacttattttcctatgtaacaggtggacgaggaaccaatttacttgaattgcaattacattccacttaagaatcaaccccacatcgctaaagtaagttgtagacttgagaatgtactcttaactcaccaatttcatgccaggctctcttacacttgcaaaatttataaagaacaagtcatttgatacttgtctgacaggtaaaacgatggtacttggagatgaagtcaaagaagaaaattaatgaggcttcaagcaacgaaggtgctggtcagaagcagtgttatcgagacacgcgtgtcagtgtgtcgactcgtgtcaggcgtggcaagacacagctgtagtgacaatgctgaacttggagagactagagagaagagagggatgagatagaaaatgcatgcagctaacatggtagcacccctcgagatgaaagagagtggcaatgcacttttttttttttttgatagatccactctcttgtctcctccagttttctttattgtcctttttatcttgtactactattctttactatggtagataaaaggacacatgcaaccgtcatcgtgtacagctgcaaacaaaaatatatgatcttttatgcaaattaatgccccattcacttattaagagaccccaaatttctcttgagatggagggctaacacaggtggcaacttgctaaaaagacatgttttaattgcaccttgacacaagaaaaatagaggcaaagtgaagcggataatatactattcgaactttccacagcactgtaaagcaattgcagataacagatcatccgacaaaactatatcgatggctaaacaatcaccagctcaagtctctagtttgtttttttcaacgaatgcaaaattctcaaggtgtatctcaatcatcttgcatacaatgtctctttgccataaaaaaatattgaggcaaaactcaacatggcgaatgatattttccacagtactttagtgtaaactaattacaggtaacagtaacaatcgacaaaactgtaccggtgcttctacttcaaaaagaagaaaaaaaacctgtgcatgtgcctacataatgattttgcttacttcaaaaagaagaagaaaacctgtccatgtgcctacataatgattttgctcaaattctctaatgcaaaatgtccaactatgccgtttgttttcaaataaattattaatacactcatggacaaaaaagggatatcagctggtcaagaacaaccgaattctctcaactggtatgtacatgttgcggtcaaattggagtcctgcaatgactaagccaacgcaacaagattcaacttgatcacgaacctacgtcagtatatgtacactgattaaaattgaatcattggtcgtccaaagaatgcttgttaatctgataacatatgcttcctttgtgattgctactctgtaggatccagacatcttagccttcaatcctctcatagaaaagaaggtaagcttcgcacttgagaacttcttctaaagagacttctctgatgtcggcatcacttgcacaaaaccataaggaagagccattggtctgctgcgggcaacttggtctcacataagcaacaaaatgccctgcatccatgcaaaggcccaggtgctcaacaacaccaactagacggtagctggaattatctttgtcttcagaactgaagattagagaaaacaaaaacgatcaaaacagatataagactgtacttcattatggctcaatgtaaacaacagcatgtcttattttatcttatatagttactccctccatctcaaaatagaagggcttttgcccggatgtgacacatcctactaatgtgtaacatccaaacaaaaacccttatatttggggacggagggagtatatcttatgaacagaatattattaacaagaaatcagtatctcatctcatgaaaaaaaatctgtcagatctaagtaaaagactggtataaatcatcctaagagaataaacatgtaaagtataaacaagtaaatcccctacaaactatttcaacatatcactttatatatatccatcatatattaaaatattaaaaaatacataagtatatcaaacaaatcaaattctaagaaataaaaaaggttcaacaggttaggcatttcatggtacacatcacctacaaataaaaaatcaaaaagcaattatatataccatttcagattttctttaatgggatgtcattttccaaaaaatatccagtggtcaatgatgaactactacagtgattgagtttgtccttcaagatgggtgatatcatattaacgaccatagagttactctactgggtgtaacctgactctatagggttagaaaaagcaataatatacacaagtcccatgttggaggggacgcagttccatagccttagaatgcctattcactttacagtccacttgcctcaacgcaaactacggagctcttccaaacgaatgttgcaatgataactacaagatcggttttgtttgcgtctatttctttgtcttaaatcatgttagcctgccagaaataggacagagcagtgctatcctaagtcgtaacctatttctgtgccaaagaaaactagctgaccatgcaagcgaaattcatttttagtttttaccacagctacggaaacatgcatattttgctttttctggttttcaattggacaaacagaaacaaatgtgtgcaaggtatacggttatcaacatgctcataacaacagcacacaaaaaaatggacagactaaattactcagtacctggggtgcatgaacaatttcacatcaagggtctccttaaagctcacatgtccactcactttaagtttaagaggccataaatttctcttgagatggagggctaacacaggtggcaacttgctaaaaagacatgttttaattgcacctttgttcctatctggccgatcatattggttttcttccacttgatgtgcactatgacccatatttacttgcttcccccttccctgatcttgttcatcctggtctccatcaactgtcccattcacattggtacatgccactggctgttcaccatgtttaccacttatagggcttgccttctgatcagcattggaacagttttcacacctcttttctatcatctctgcttttaaatgcaattccaatatttcctcgattgaagcaagagagttgatatcatctgccttatcataaactgcatcacgatttcgatctttccccttgtcttctgtagcaacttctgctgacaaagtgtccatcttggcttctatactatcttctggcttgatgctatcaagaacagcactgacagttctctctacaccatggcctgatgctatcaacgtgttctcttcccttgttggagcctgcaaaggaccatgtacatcacccttgctttgcgaaatctgttccaagtgattagaatctgcagaatcaagcatataagttttaggttttgtcgtcataagtaacttcatgaaaccaggaaccgttgtacattgtttgagaatcttgaacctctacatttgattgtttgaagcttattttcttcatggaccatgtacttaagttaaccaacaaagctgagtaacatttattatacgagcacaaggactcagcaaaaactgctggaacatcccgtttgtataatgctgtcatcctgaaggttctgacatttgtgcagtccatgtatgaaccataccaaagaaatattctctatttagctactagaagggctcttctctgaaaaatgtccttgtcatgtcaagcaacaaaataacaaacaatagttgtactatcatggtctgctccattcaatcattcattaatgaaaaattcatcttctgtttcaccttgcgtgcttgaaggcccgttcaacgttgttttccattatttagttaggcacaggaacacataaacttaccaacttccaaaggctctgatgttttcaccataaccatatgttccgattctgaagcgggaacctgagcatcaccgccttcagaaattgcatgaatcttttcggtgttagtcttgttgattgctggaaacagttccatatgagtcttctgttgagatatgcatcttccattccgtggtggtgatgcaacacttctggctggagtcccctttggtggtaatggcattgagagatcatggaatacctcctctgaatctgacttaaacgagcaacatttgcaagacaaggtaacagacagctgaccagcaaatatggaatcaataaccgtaggagccacagcactaggagcaccttgttgcatcttaccagccctccatttcctttcatcctcatccaaaccatcgcgcaaacagcaaagcaattcatgacagtcctgcatagcaatgcctcggaactgcgggtaacgaaagcgcacacaacgcaagagcatcgccgggtccagcaggcgtcgagcgtagctcggaccatttgtaccaacaaagagatcatgcagcaagtcaccaaggacacccgacggagcgcccggccccaagatcctcgcccgcagcttcccgagcacaaggaggcactgcagcagcgcgttcaggtagcaggtgttcccaagattcggcatccctgtgacaacacatccatacccttcctcgccgcctccggcgccatcatcggccaccatctggctctcaattgccaatgaatcctcacactcgaagcagtaaccctcacacggatcctcgcagcgcagcgcgacccaatgcgccctccggtaggcatgctccctgatgtgccccagcggcttggccctgtgggctagccctccgacgcagaagcaccagccgcattcggggcacaccatcatgaggttgctcccggtggccaggcacgtctcgtgctcgcacatcgggtcgccgcgggcggccatgcccatctcgatgtcagcgatctcgtccatgtcgcagctgaagtggccgcagtcctcgccgtcggtgtccctgatggccaccgcctcgcaatcccccggatccttcaagggattccgtgacggaacgcagccgccgcgtgaaggaccggcctccgccgccgccgccgccgccatcgcgcgtggcggtgtcggcggcggctccaggcatggggccttccccttccgccgtctctcggcagcatcccgatctccatccccatccctcgcccttgccttcttcttctccgaatacatcgccgtctggactctggaacaggaagaaaaaatcgcaagaatccgataataaacattccggatgaacatgaaccaagaaaggcgaaagaaagatgagaacaagagaggaaatcgagacaatccgggtgaggaccaaccaatggatcaagcgcgcatcgggcaacgccgcaacgtgcagcgggatttggtttgggggagaaatgcgcgacgagggctcggaatcgacgagaacgatgccgagaggttttggaggagggagggaggcggtggcgttccggctcgtgttgggtttggaggacactggagtcgggcagagttggggttggaaagagagattgagatttgagaaaatcccagaaagagagactgagagttgaggttggtaattaataagcatccaatttcaaaaatattagtattgagttgcatgcaagtgtggaatagaaatgggcagcaacttttatttaattgcgcgacagccagatttgaactcgagacatctggctctaataccatattgagttgtatgcaccgaccagttcaacccaaaaatttaagctgatgagaaaaggcgggcaattcactttatattccaacaaatatcatggataaatacaagtttgatgtaatatcaatatacaagagattttgtctctaaaatatcatcgttgttagggttccgttagcatccttccattaagtgctatagaataaacaatgcatttaacggcgtaggatggacgaaaccttaacggcaatggcatttctgatactaaatcatttgtacgaatattttgtggaaactcggactcgtcaatagcatgttttagatttgggtgtttgtcaatggtatttcttggattttctcttgagataataggtgggtccatggttcatcgggttcacaatgacaaacacacgtttctttgaaggtagaggtgcctaatcccgaaagaaagagggagtggattttaaactctcgagaaggcatatctctattgtttgcatgctatctaaataattataaaaaattaagaagtatatgtgatatatcactgttaaaatttaacttctacaaattaaaaaaaacaaattaaattataaattgttaatgtatattaacagtaaaaatagtttttttggcaatatgtaaaagttaaattaagaatgttcgtattaatttatcttgttaaaaaaattaaaaaaaatttaaatagtttcctgttagagaggtggtcatgtgcgtggatcgcatggttgctacctaaccctgctttgttttggatgaacgccaatataatggaaggagtacatggaggggtggaattgaggaatagcggcagttcttttgtgttttgttttgtttttttgtttgttttttttttgaaaagttcactcaactgcaaaatcgaatatagagtacaactaaggtataaaactagtgcaaattaagttccccttggtcgctggttttggttaaactacttacgtggtgcattgatctggtctatcgtcctacgtggcgtagaaagaaactagtactatttatgttttaaaataattataattttatattgttttagcatatatcttgaagaagcaattgcttcttgatacaactggagtactagcaagtttttacccaaatgactgctttgcttttgagcatgccagtatggaatggaattactatgaattagagggtgaattatttacatgatgcataatcaattaatcagtctgcaatctggattgtctgtccgtacatgcatcgatccgtcgtactagtatcatgcatgatgagtattaatactactggtgtttgatggtacaagcagcgtcttgttcctgtaggcgtacgagcgggcgaagcagaggaacatcgcgagtgcgacggcgctgacgccggcgagcagccagtagaagtagtcgaggtggccgcggtcgaggtcgtcggcgaaccacccctcgccgccgtccctcctggtgacgccatccagcgccgcgatgagcgcggcgctgacgaagccgccgatgcccacggcgccgcagtagagcgccagcccgacgctgcgccgcccctccggcatctcgccgtggaagaactcctgcatccccaccgccgccagcacgtcggccacccccatcgacgcgtactgcggcaccagccacgcccagctcatcgccggccgccgccccgcccgcgccgcccccagccggcgcccctccaccgccgccagcgacgtcgccagccccgcccccgtccgctgcagcgtcgtcagcccgctcgggttgcccgtcgcgcgccgcagcgccggcaccaccgcgcggtcgtagatgggcacgaacagcacgatggtcgccggcccgatcgtctggagcgcggcgggcggcagctccacgccgccgatgcggcggtccagcatccgcccctgcttgttgaacagcgtcatgatctgcgcgtccgccacgccgtacgccacgcacgccgcccatatcggaagcaggcgccgcagcgcgccacgcgcatcctcctccgacgacgacgatcgcttgccatccatggcggtgtcgggacggggcggcgcgtagaggcggtaggtgggggtgccgaggaggaagacggcggaggcgcaggacacgacggcgaaggggacgccccagccgacgttctcctggacgtagctgacggcggcgatggcgacggcgacgccgacggccatggagaagaaccaccagttgaagagggagctgcgggcggcgctctccctggggtggcccgggtcgaattgctcggcgccgaacgccaacccgcatggcttgtcgaatccctgagcgaaggcgacgaggtagagcgaaacgtagacgaagatcacctgtgccatggaaggacggcaggcggcggcggcggcggcggtggcggcgcacgccggcagcgaggacgccacagtcagcatgccaagcccctgcaatcatgcgcccatgcgcgtgaaatccaatcaattttgtatttatccgttctaaaatatttgtagtaataagtttttacctttaaaatttatcataaaatataactcctttgtacgtagttatatatatatatatatatatatatatatatatatatatcattttttcaaccaataataatcttccgccgttcaagtttccctacctaataactcctcttctcaaaacctttgtccatttaattctacttaagatatagatttttcttagcattttttaaattgttaaaatggtgtattctttgtaaaaaaaatttatataaagttgcttgaaatatcaaattaatttatttttaaaatttgtatttgaatttttcggagaagggtactgatcactctcgaacggacgtacgcacgttcatttcaattaaatcacatttgttgtttattttaagaatgcacgcatattagtgagtaagattaatactctaccagtgggagtaacatttttaagataggattaagataaggtggagcagggagatggtgacagtgtttgatttgatcgctcagttgcgaaagggtcagatatataagtacttagtccatgtttgtttcagcttaaaattattataatctagattatagaactagattattataagctggattataataagccgatatagaataagctgctagttgtttgtttctctggattattatctgtttgttagttgttagtcatccaataatctaaaataagcatctttagagtggcttaccaaattatagtaatctggcttatatattataataatctattataataagctatctgtttgttttagcttactcataataatctagattataataattataagctgaatcaaacagggcttaattaattggatggaccaaatgtgtgagcagagagttttcttcttttgacagtgcttgtactaattaatacgcgtcatccacgtctttgttgcttgcagatgcagatcgatatgcacatttctatcttttccattatatttttgtcctgatgatgattactagtactgtactatcaattactaattgtgttcgtacgttaatgggcaatataacaagtggtcagaggagtattagtagaagtaacacgaatttcatggcagacatgctggcatatacggggtgctactccattattattcatcgaggagtggtaagtactaaattaacattgacaaaattgaataaaccaccaaattatcacttctgttttgaatttaccctcaaaagctgatttgttacaaaggccaatcacccaaacccttttttgataaatacttatcattatggagccaatcagccaacgtgtacccatagtactacctttatcctaaattacttctctttagaatagtactacctttatcctaaattacttctttttagaatttaaattttgttccaaaatacttatcattacggagtgttagttgtcttattcaaaaccttttcaattttatccttaataataatttcacttcttataatgcattattcaataagaaggaaagagcatgaccgtagttgattgtcactactcatcggctcatcgccgttgccttcaaccctcaagttattcaagttcatctttctgctttaaactacaccctccgtctaaaaaaattaaatattcagaatcatagctagaatttatattttttttaagacagagagtacaacaggtatcgagctggctgatctagcctttgtttatttgcgtgcacggatggatttggtgggtcagcctttgcagcaaattgactttgggtgggagttggaaaaaacaagagtgaccagttttatttacaatcttaacaataaataataacaaatggatggaggaatatatagtaaataataaataaaatattaccatgacgtagagggtgcaggcgaggaggatgaatgggtagcggccgagaaggagtcggcgaggacggcgccgaggagagggagcatgcgcgccgtccccgaccacgcgttcgccgccgacgcgttcgattgccccagcggccccgtcaggtagctgatcaggttcgccgacacgccgtagtaggagaagctgcagcccatctccaacactgcaacaattcattaatcaattaatctctcatgaaatctaatcaaactttgcaaattaaggaacaaaattaaccaaaccgaacaaacatcggtatacgcagtacacgctcactggcgacgaacagtgcggagcgccagccgcctgaggtggcgcggtagaccggccgccctcggaagtcggacacgccggcgagcggcggctccggcggctgcggcggcggctcgtcaccctcattcggaataagcaagggacggcgactgtccatcggatcggatcactcgttggtcgctttgggtgtgctagtgctagtaggatttataggagagcactgagcactctctccaattgagaagaatcagaaaatgctgctgctgttattgccctcgtctcctcctgctgctgctgttcttgttcatgtcgagtgaggcagagaggccactaactatggcacaattatccccgaaaaaaaaacaaaaaacaaaaaacaaaaacaaactattgcatgatttgcaaaagatagcgaaatccaaaccgtccatctccttaacccgtgatatatatgggcatgttcactttgctgccaaaaaaaaaccttatcaaattttggcattttggcatggtaacttgccaaaattttggcaagatttcttatatagttaccaaaatttagcagcaaactaaatgtagccacttttttggcaactttactaaaatttagtaaggttgaaaatgacaccaaagtgaacaggccctatatttcgaagatatttaagagcaccacgaacgaatcgacgacaaaggagtgaaggactgagtagtgagtacctaggatgtcctactggactatagcaaattaaaggagacgacaagtagcattaactgggccttctccccaccgataattcaaccacagcaaattaaagctgatgcaggggtgttaggttcatggccacattttgccacactacattttttattgccacagtttattagatatgtgtttagttcactgtcacagttgtgactcgccacactttttcaacagcatgtcctatatgtcatagacttaattttcttaccaattttaccacactctgtggctagcaatttattcaccacacttttgtgactaccataacttgcctaacgttagttgtggactatagcaaattaaaggagacgacaagtagcattaactgggccttctccccaccgataattcaaccacagaaccaacatctttaacttttaaagctgatgcaggggtgttaggttcattgccacattttgccaaactacattttttattgacacagtttgttagatatgtgtttagttaactgtcacagttgtgactcgccacactttttcaacagcatgtcctatatgtcatagacttaattttcttaccaattttaccacactctgtggctagcaatttattcaccacacttttgtgactaccataacttgcctaacgttagttgtggactatagcaaattaaatgagacgacaagtagcattaactgggccttctccccaccgataattcaaccacagaaccagcatctttaacttttaaagttgatgcaggggtgttaggttcatggccacattttgccacactacattttttattgccacagtttgttagatatgtgtttagttcactgtcacagttgtgactcgccacactttttcaacagcatgtcatatatgtcatagacttaattttcttaccaattttaccatactctgtggctagcaatttattcaccacacttttgtgactaccataacttgcctacaaccaaacacacccttaaaatccatagatagtttcggatggtgctttttgatgattaacgtgacacccacatggtgtattgaaccggttgtcatctcctacgtgacgtctattggatgaatacaattagaaagaaaatagtgggaccaatatgtcattaacatctcttcctcctcctctacccttggtggacgcagatgaatagcgattggcttaagcagccacgttagctcgagctccttgtctccccttcccctagcatcatgatccgtttcctctactctatctctagcatcccaggcagaattaaatcgggccacatcgtgattttgcaacttgacttacactggtttagacttatactagttttaacagtttaacgacaattgatatctgattttgcgattgagaaatatgaatggaacatataaaatggacccccttttttttttgttctttcctctacccatatggggcctgttagggagaaaatattttttgctaacacagcacatgtctctcatcatcaatggagaat

SEQ ID NO: 79699 - DNA, 10828 bp, Oryza sativa
tctaccaaattttataattggcataagggagaaattaaattatcactttgcacgggttgcttactgtagtaacttcttttagatgcatgcatataggactggtttggtttgagatctaaattaggcttaccaatatttatcaatttcaatagtatttagtgtctatttggtttgaagccaaattttggcatgcctaaaaaataggccatttcaatagtgaacttaggctattttggcttcaatccaaacacaactttgctttaccaaaattagtcatgctaaaacttgccaaaatttagtattgacaaaatttagtaagatgtatttaggccacaaaccaaaccaacccatagttacctgaacaatggcgacgtgcaggagcgtcccgcggagtccgatggcgattgacgcggcggccatgacggcagggcccgcgaggaagcggacggccatggagacgacggcggctgatttgccacacgcgatgatgctgggctgcagcgccatgaacaatcctggccacgagacagtttgacagcgttagctcgagcgcgggccagtgggcaccagtgcgtgtgaagagggattaattgcggagcaatgcggtgtagggctacgggaagacatgagcacaaggggcgtgggcacccacccaggctaaacatggccatccccaggcctgcgtccgagagaatggagatggacttctcgacgattgctggcatggagacgtgccacctgtgacccatgaacacattgcccgttggttagctcccggaacagtaaatatcaacatcattagccactagagatgataaaataacaacaggtgtgctcttatgatgattagtagtagtagtagatgcaggttactccaaaggaaacggggccaatcgttcatggttccttgcttggaaacgctattgtgtgactgtgtttggtagactggctcgacgacgaccagtgctcgcgcgccgtgcaaattctgcctttttcagctcctacagttcgcgattggtgccgaccgggcccgcggcggtggtccgtgccggcgggaaactcactcacctcgtcggcccaccaccgccgtttggggatccgtaaaaaagctgcttttcggttattcccaccgccacggcacgtacgcccccgggcagtttcggtgcttcctagcctaccgcctacgcgctacccactccctctggcttcgccgagaataatatcgctctcgcgcttatcatcaccaacaccatcgcggtcctcgatcctcgccgaacttgtcgtctctgtcgagtgaaatcaccttatcacccgaactaacttaggcagtagaaaaaatgagtaattgcacaggtcacgtgaaaaaggtaggttaatcttcggagagagggaaaaagaaaaaacggcgtaccggaaggcgacgagggaccaggcgaggccgaggaggctggagtaagtgttggggttgcggatgagcttgcgccacaccattatgaggatgaggcgtgtcatcacgctcgccggcggcatttggtactgccccgcgcccgcggcgccgccgccggcgttcggtccgtcgacgtcgacgaccttcgggtgcagctccgccgtcgagctcgaccccatcttcgtcagcccgtcaggcaaggccgcctcctcgtctactgcctcggcgccgtccaccgtcttgccgcctccgaagctgaagttctctccgccgccgccgccacccaatgccactgcgccgtactcctcgtgctctgaaaatgtagaaaatttgggaaggtctatgtttagagttgcacatggagcccgtgattaagtgacagtactactactgcggcattaatgtcgggacggacctttgcctgagccgttgttctgcggcaggtcggcggggatgaccatgtggatttccttggcgccgacgtcgagagcgccgccgccgccgccgccactgaacacaggcaggccgctgacttctgagacgggagacgcgctcgagctccacacgaacatgtggagctccttggcatcgtggttgagtgcccccgtggtcgttgccggtggtttcggcggccgtgccgagtgctcgtcgaagttggactgcctcggggttgggccccgcgacgattgcagcgagtagagctcggaggcgccgaagctcgagccgcgcaccgcagcgggcgtcgggggcggtggcccgccgccgaccatggcgaagaagtcggcgtggttgaagttggagccccgcggggttgggttccgcgacgagctaagcgagtagatctccgctcccgtcaggttcgacggccgcggcgtgaccagcagcgaccgccgcgacaccgaggaccggcgcacggtgacgtgcagccgcccgtccgccgccacctcggcctccgtctccgcgtggccgccctccagcgacaccacgtccgggtcgacgtgcagggacacgatggacgccgccgtgtccgggaactggtcggcgatcagcatccgcgcggcgcggaactcgaagaggaagagcatcagcgtgtaccagatgatgcactggagcacgacgatctggaccatgagcgagccggagtatggcccgtacatggcgatcagcagcgggatccccatgacgagcgtgttgggcagcgtggagagggagaagagcgtgatggaccagtccagccgcggcgcgccggtccgcgaggggaggcgcgaccacgcggcgagccccgccaggacgagcagcttctgcagcgtgtccgccgccaggaagcggaggttcatggcgtacgggtcgttggtggagatgaagtggaaggacaggagcggcacggcgaagatggcgacgaagcggttgatgccggagcactggtccggcgtgaagatgccccaccaccgcaccgacccgtacgccaggaacatcgccacgtacagcggcaccaccgccgccatcaccgtgtagaagtcgtgcccggatatcatctcctcagcctatctcaatccaacgcgcccggcggtggatcgagtgcctgagcgagctagaactagctagttatacatgcaggagcggccgagtggagtggcttcttgctaactcggagaactcggggtcagccacttataggctgcgtccaagtccaacgagcacagagttgaggagcggtctacattctcccgtcatccaggctccagggtggattttactgtaaaaacatgagagattttgaatgcgcgatcgtgactgacccaccagtgggcgtgtgcttcataagaaacgatcaatgtttcgctcggaggtgcaaattaagcccgtagttcatgcgcgcacatgtacaagctagcgttgtgatacacaatgcaatgggtaccgggggtatatagattgcatcttggcgatggatttgcatcactggatgcgaatagagtcatagaggcattgctgctctgaagatagatttgcattgctccgtgaaaccgatcgattgatcttatcggttatgtacgtggtgggctttttccgtgactatgcaagctgatgatcgagcgcgcgtacgggatactgcagaagttgtactgttggtttggtaccactgtctgcacttatccggctctcacggtgccccgaccgtccatgaatgtttggactcgagaacactagctactccagctagcagctactccctccgtactatattttgggacggatgtagtacaacaatacgtgtgaaagactagtgttccaatatgcaaataacagtagctcggtattgttgaagtactatagcaacaaatcaacaaagattggattagttaaactattgaaattgcgcattttagtgtcttcttggtttatacatgaacaagtgctatacaaccgaatggcgaatggtaaactcgtgcaagatcgaggggatgttccctcatataaatttttctttcaatttcgatataaatagttatgaaagattttttaaaaaattgacaatataaagtataatgatatctatcagtccaaaaaaaaacaagtttaaattcgacttacacattgagaaaaaaagtgacaaattcatatatgaacattatattatgctactattcatatgttggatttgtctcccttttttatatctcgatgtgtgagttgagtttagataaaaaaatttatggagttgtatagatatgttgtatgagtgttatcatatttttttaaaaagaaattcataaccgtttggatggtttttaattaaacgaacaaggcaatatcctcttgaggcatcaaaatagtctcccgcaagattacagaggtttgtctatggatcgccttcttgagagggccaacgaggtacattcttttgtgttgaatggctgaacggttaaatagctgaatgatttgcgaattactttagggcacaaatggatatatttagtatcataaagctgcatactggatttaaaactttttttatgaaatatatgtatgaattttttttacaaaaattgtaatgtttaagagcatgatcgagaagcgtggagtgtggacatccatccctcattctattccttaaaaaaataacaaggcaggctggttgctagcttgcatgaaagagaatgtggccgattgacttggggaagaactctattttaatgtattgcaaaagattgcgcttggctagtgatgattgcttaatcatatgctaagatgtacttatctccgttttcgtgggacaaaattttaaaatcttaataattcattaatatacaaaactttttatattaaaaaatatcaatagaattgtcatgaaatatattttcacattgatatagttttatttcgaataaacacctaattaacaaaaaaaatgtattaaaaactatttgatgtccaaaataccaaggaaaaaggaatatagggacaagggagagagtatgtacgtggtacattgtcacacccagattatgcactgccgtacaacaacacatgacaagggcgtgctgtaggaaaacggcgtaaaccgctccctacgagaccaagataccaataccaatcacatgacacaacattggtactcacagaaacacttatgaatcattgtgatccttaatttaagtggaaggaagcagcaacgacagctgcggacccaaggactaactcccaacaccacatgcaagcaacggttgtgaaccaagatgaaacctaattttcatttcacttcaactttacctttagagcagagagaactatatatgcatagagcaagggtgggtatttacgtacttaacaagcctgggaaacttaggtgttttatgcaaacttttaagggatgctggctattttgcaattgggtttgttttaagggttaattgggcccataccactacaaatatgacactttagataaatgtcactattattcacgatatcggctatgtgccactgcaatttggggaaattgtaaacggtggcactccgtcatgttttccgtcctcaatgtgggatccacatatcagttccatgttcctccatccgcctcttcttttttccgcacgtccggttgaggctaacgaagatttttgacggaaaacgcgacagagtggcacggttcaatttccccaaattccagtggcacgtagccgatatcatgaatagtagtggtatttatctaaaatggcatatttgtagtggcatggatacaattaacccttgttttaaagctttgaataatataagtgtttgcttttccacaacagagaaagacaaagtctactgactttccaagtttgcacaagtagcagagttggcctcaaagcgagtttcctgagccattccatttcagtactcctagagtcccatagttcaagacatccatttactttcatggacttcctaagtcccctgtctccctgatagccatttatttccagcccaagcatcacgtttcccaaaccacaacaatgtttcacaaagcacaatataaacaaaaactatgctaaggaatcacttcacatccgcccatgacccttctacacagtcgtttgaacaactagttaactctatagaggggtacactttacccccaagctgacgctactaactgggtcacacaacctgtgcagaacatccacatatgatgactttgaggctttcatgataaggcattttgaaagatgacacaaggttacctcatgccaactaaaggggtccttggactaacaacaggctagatcctagaccatgctagcaaggaatcccaagggttctcctcgacaccacctcgacgatgcagtccattggtattcaaggcttccctggcctagctagttccttagccgggagtgttccacttaacccatgtggtcgtacttacatgttcggatgtagtttaaaggatagtccttacgagcaaccaccaatgcatctcgcccaataatgaccctgtgtcgcgagttttctcataaactcatattctttcgcaggcactaacccacgtgtcagatttttcaaagctttttagaaacaagtttcacccaagttgttctcagatttaaagattgagggctaccgtcaatattcttacaaggttgcacaaataccaacatacaacaaaggtggttacaagggaacatgatatagctattatgaaggaaagataaaatgcaacagggttaggtaggcatatcattccatcttgtagacgaggcgaaacatttgcaagtgcacgccaattgacgcataatcaatttacaaacaacaaacttaagttcaaatatgggcacaatgtaacgccccgatttttgttcggaattaaaaatcatttaataatgcatttcctagaaattaaataaaaagttaagcaatttatccaagtgaattattgggagaattaaaattttccctttaaaaatcattggccgggaatattttgtagtattctttgtgccctaaaatactctctgaaatttcccgcgaatttttggagctcatgaaataattttaaaagcaccaagttcattttaaccaactaaataaaaagaaaaacaattaaaatctccctttctctctttgggccattttcggcccaagtcttccttccctcccgcggcccgcgcgcctcctccctctctcgggccggctcccttctcccttggcccgcttgcaaaagtctgttttgcgtccctccttctctcccttcgccgacaggtgggaccggcggtcccacctgtcagctcctcctcctacctctcgccggccaaccccaaccgccattgccgcccacgtcgccgcaaaatccggcgccctctcgcacccgagctcgcatccaatgacgtgggcacgatcccctgcacgtcctccaccattttcctcgctcgtcccacaaaaaccggcgccggccgagccgccatcaccccgcgtcggcgccccacttccccggcggttgccgccccgactccgcctctcccgtgctcgatccggcctcccctcccctatagaaacattccccgcatctccctctccattttccccttgtttcccgagcccggcactctctccctcgctctccccacgccgctcccgcgcgccgccacacttcggcgaactccggccgccgtttcccgtcgctagggtcgccgccgcactgctccgccgccaccgccagctttgccaccgcccgggcaagctcagccaccgctccatttcccctctccacctccgtagcgccgtagccacgtgaaccacctctcttcgccgccgccgccgactccagccgcgtcgcgccgccgcttcggtcgacgccgacccgcgccgttgcctccctcagctccgcaaggacgaggaggacctcggccgccgcccctcttcgccggaaatccgccggagctcctccttcctcggttgtcggtgagatccttctcatattgtcgcggtcggccgtcgttaccggtcaccccgcatcggtcctcccctccccaactccctcttctccttctgaaggtcaagggcgaccccgtccgccctccgtcctcgcaagccgccatcgggcaatcgtcgtcgctgtcatcttcctccgcgccggctgccgcttccggtgaggacctctcctcccttccttttttttcccgtccccctttcttgccgacctccgcctcttggggtgcgtcgcggtcgccgtgcgcgctgctgtcctccggccgcccgccgccgttccacgtcgccggctgctgccgccggtggccgcatgccgccgccacgccttggctcggccgggccggcttcgtgccgcgcctgtgcccctggctgccgctcccctcggccgcccgatcggctcaggccgatctaggccgtccacgtggtggacgcgcacccgaggccacgtgtggaccatgtccaccgtgcgccctccccctttgactcgctgacgtgtggggcccgcgtgtcggcgccggccgccccttgctgacgtcagcgaggtccttttcctttgtaaaaataaataataattgcgcaataattcgttaataattctagaaattcatataaatggctcaaaacttctaaaattcatatctaattcattcgaactccgaattgagccattcaacttgcaaaattcatctaaaattgagctctacatgtttgtttagtttttatgtactgttttcttggtttttattagagttttttctcgttttgcgtgccagcgtgtagaatccgtcgtttcggaagttcgcggtcgcaaggataagagttcggaagattgtttgaagaagcaaggcaagtcacacattccccttgagcatgttgttcccaatttataaatgttttaccgtttgcaaataaatatgcatgttttgctaattacatgggatcagggtttacctatctgctcgcttgtgccatgtttacttgatatctgtcctttgtcaaccgtgggtaataaatcgcctagcttgtgttactttgatgacctagctagaactatatgcttagccatgcttaattaccactagctcagtcaatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggagtgggtaactgcttgatctgaagtatagctcgaccctttcctaggcaccggtggcgagggtgggcgtgatggagttgggttggccggggtgtccggttgtccagctgccggattcaccgcggcgcaagaggggaccgcccactgccttttgaggggtgggggtgaaaccttagcgtggtgtggatggttaggggaaggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgattgaccagattcaccgtgattagtctcacacttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccagaaacccctccttgtatccccttgcatgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgcgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacacacaatatgttcaaaggtgatttgcgttgctaaggggcttcacaaatcttctcgaaaccactttcgaacgatttttcgacggcccaaattatacgcaaacagttgaaacctacacaaagatcaagaaaaagacatacttaggactagtaatagtgacattttgatatgtcacaattttagagaactacgggaggtggaaggagtcgaccagagctagagatatggattttgaaagtttaattcattttctagaacattggaaataatttattggattttcataaaggaatattcttaggaatattctagacagttcacttacaagtggggcccacgtaactagtgagagggatgcctagaagcatatccacgagcttcattttttaagaaaaataaattaaatccagcctttagctcgtgttcttccatgaaaaaatattacaaaagatcagcattaacattacacatcatgatggtgtaaaagttaacattgtttagatggaaaaatatttaaagcattttttttctaaatctccatccgtagttagcaatatttgcataattgtagtatcacgactgcaatatgccatgcacaatatttctttgttctatcactcttttgcatgtatatggctagaaacagagccaatatgtctcctaaataggacc

SEQ ID NO: 79700 - DNA, 27347 bp, Oryza sativa
catgacacgactgcttcagaaagatgtgaagtacaagtggtcgaaagaatgtgaacagagttttcaagagttgaaaagtcgcttaatatcagctcctattttgattttgcctgatccaaagaagggtttccaggtgtattgcgatgcatccaaacttgggttagggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgttacagaaggacgacagttgccattggaattatgcaaggaatttgaaagattaaatttgggaattgtcggtagaggtttcgttgcagccttagaagcgaagcccactctaattgatcaggttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccgggttgttgcagcctttgaagattcctgaatggaaatgggaagaaattggtatggattttattactggtttacccagaacgtcatcaggccatgactctatttgggtgatagtcgatagacttaccaaagtggctcattttattccggtaaagacaacttattccggaagtcgcttagcggaattgtatatggcaaggattgtgtgtttgcatggcgtccctaagaaaatagtgtctgatcgaggcagtcagtttacttcaaatttttggaagaaacttcaagaagagatgggttctaagctgaactttagtactgcttatcatccgcagacagacggacaaactgaaagggtgaatcaaattttggaagacatgttgagagcttgtgctctagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctcttcgaggagttcatcgttttcataccaaaggagaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgcttttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctccgggatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcctctcgtcgccggagtcgtcctagcgccgtgcgccctagcttcgctgtcgccgccgccgctccagccgtgcgccgccgtcgttccagccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtccgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactcgttcgatctcggccgtccgatttggatcggatcaatctcggccgtccgttcgcgtgaaccgtcgcccgtgcgcccggtccaccaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgcttctttttgcttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattctattcgcttatcaattagagtaatatttgtactctattatcaatttgttattgtgtgcctcggctgattcctggacgagggttcacacacatgtaagcgtttggaattttggatagaaattccgggcgtgacaagttggtatcagagcctctttgaccttaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtgttattagtactgtacatctattactgtactaatggctcatttaccagcaaaagttttacaatactgttttatttaatcttgctgcaataaaataaatttagtatgttgattttataactttcttttgaaacctgttgttaaaaagtacaaaatttgtgaccttgtttccaactatttcaaattatctcgcaaagcttggtttactttatttacttcccttctactttgatttctaaaccttattcaaattaatccaaaaacttgtgctattaattggatagatgtcttaactccctcctttcacttgtctttagatgccgtgttacaagcctgagtacctgtttggtgttgagggttttgtccaggagttgcgtacgatgtcctttgtcattggatttgggactgcccctttttatgcccagattcgtcatgatcgtcatgaagagaagtgccgagtcaaagtcaccatgaacagtaatagtgaagatatcccctcagcgatgttcgaagctggaggaagaaactacatccatgcatgtcaggaagtggcaaggatcgccataggagagctccgtgatagctacagtgatcaattggccgacactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagaccggaatcgtggtaagatttgcaagctagaagacaaggtggatcgtttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcattataagtagtgatgaagaagaagaacccaagcgcaacaattccaagtttgagtgggtagctatcaaagatgaggaagatgagccgaacgagcctttaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttcccccgttttctcttcttatcctgtccatgccagatggtgaacactcgcagcaacgggaatggtcctaacctcaacaaccccaataacaacaacaatggagagaatccaacccttgctcaagttcttgctcaacagactcagttaatgcacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgcttactcagggatctcgctctgttacggagtatctgcacgaattcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagtctatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctactgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaggaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaaaagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgcttcagaaaggatacatcagaccgagttcatcaccatggggagctccggttatttttgtggaaaagaaagatcatacccagaggatgtgtgtggactatcgtgcactaaacgatgtgacaatcaagaataagtatccgctgcccagaattgatgatttgtttgatcagcttaaaggagccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaactggaaacaaccaaagacagtttcagagatccgcagtttcctaggccttgcaggatattatcggaggtttatagagaatttttccaagattgctaagcccatgacacgactgcttcagaaagatgtgaagtacaagtggtcggaagaatgtgaacagagttttcaagagttgaaaagtcgcttaatatcagctcctattttgattttgcctgatccaaagaagggtttccaggtgtattgcgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgttacagaaggacgacagttgccattggaattatgcaaggaatttgaaagattaaatttgggaattgtcggtagaggtttcgttgcagccttagaagcgaagcccactctaattgatcaggttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccgggttgttgcagcctttgaagattcctgaatggaaatgggaagaaattggtatggattttattactggtttacccagaacgtcatcaggccatgactctatttgggtgatagtcgatagacttaccaaagtggctcattttattccggtaaagacaacttattccggaagtcgcttagcggaattgtatatggcaaggattgtgtgtttgcatggcgtccctaagaaaatagtgtctgatcgaggcagtcagtttacttcaaatttttggaagaaacttcaagaagagatgggttctaagctgaactttagtactgcttatcatccgcagacagacggacaaactgaaagggtgaatcaaattttggaagacatgttgagagcttgtgctctagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctcttcgaggagttcatcgttttcataccaaaggaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgcttttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtctgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcttctcgtcgccggagtcgtcctagcgccgtgcgccctagcttcgctgtcgccgccgccgctccagccgtgcgccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtctgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactcgttcgatctcggccgtccgatttggatcggatcaatctcggccgtccgttcgcgtgaaccgtcgcccgtgcgcccggtccaccaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgcttctttttgcttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctttgtaatgacattctattcgcttatcaattagagtaatatttgtactctattatcaatttgttattgtgtgcctcggctgattcctggacgagggttcacacacatgtaagcgtttggaattttggatagaaattccgagcgtgacaccgatgcatggaggaagaggggcagagcccgtgccatctggctcacggaggatggctggcgccccggctggtgacgggcacaagcacctggctccagcggcaaggccctccagggcaccgatcggcgatgacgacgtccagtgcggcgtccaacggcgaagagcccctctgtctccacactcgcccacgctgtcgcctttggcttccgcttctgggttggtgccggcctcccctcccgcgtcgcagctgccgccgccgtcgcctctccgccaccacgctcgcctgccaatgccgccttgctctaccgccgccctccctttctcctgtgtctccgccgccgcgtccctgccgcagtatcgccggccggccgtcgacctcctcaccccggcgacctcctccccatcgtcggccgacctgcccagtgcagagagaagagtgagagagagagataggggagggggagggggaggaaaggagaggaagggagaggctggcctactgacatggcatcctgacatgtggagctcacgtgggtcccatgctaactcaatcgccacgtcggacaaaaccagggttaaaatcgccgagggatctagtttgaactggttttgtaagttgggggatgtattgtatcgggtttcacggttaggggacgattttgtaactcgattacaagttgagagaacttcggtgtactttttttccttcgcgtaatgaggaggtggcctgaccaggtgtggatgcggattggagggtccatcccgcgagctggtggaagtggaaccgtggaagtgagatagcaacggatgtacacctatcggaatcatgaaatagctatggtcatagccgttattttgcactaaaacttgaaacgggaattgtgctgttagaacttgtgtttttattttaaaaaagggtgccattctttacataattaaccttaacaataattcctcaaaacctgaggttttgtgaaattcactctaaatattacggagtactgtatgtaagaatttaattccaagatagaatcgactaacttgtgcgtgctctctaaatattacggagtatgcacgctctctttctaagtttgctcgcctttctcgttgcgtgcaagttttgcatcaacacgtagaacgacaatgagctaaactagcttgcctcggcagcttgcatataatttgaattagttttgtgctatcgaccaaaatcaccaacgtaaatcaccaatttcgactaacgcgtgaacggaatcgaatctcgacagtacgttccaagttcctagacaagctggagagtctccactttgtgttcatatggactctccactttagctgtgtttgttcatgctaaaatttaaagtttggttgtaattggaatatatgatgaaaaagttgtaagtttgtgtgtgtaggaaaattttgatatgatgaaaaaattgaaagtttgaagaaaaactttacatctaaacacggcctttgtgttcattggactcttgctcaaaacacgtaagacaaatcgaaccagaaagcaatttgttcgttttgtgtggacggcatctgaatctcacggaagttaattaggaatatataattcgatcagggagttgcatctagggtgaataaggatatattattattctgttcgatgttcgtgtgcgccaaaatttccgaagtggactggaaggctccaaatcaaaccctcaatgtgtaactacaattttattccgagtaattttcctcttttttttcccttcagatgtacaagaaatctgcgtatcattatagtcatctcataaacacccactaaagcaaagttaaaaacatgagaacttgtcaaagaaaaaaaggtactacgaccagcaacctgtacaaacatatattcaaggtcaaatactagtaaggcctttggtctaccattctttgagtacttttgatttcagctaacttcaatattatgatcaagtactacaaaactacaaagattttaacacatggcaaataagcgtattatggtcctaaggtttttacaaactacaccgtataatcaaatgtttttcttatcccaccatgcttatgatttatgaaattaatccaaaacatctacaatatgagagttttaatcatctaacttaagtgtttttatttttttttcaatagtagtagttaaattgattaatggtgtggttttgtgtaactcagtgctaaacatatgtggatttgtacaacgccgaactacgatactccccagtcccaaattataagacgccccctttttttttagaaaaatcaaactcggtatattttttactaatgattatactaaccatatatttatgttaagtattatgcatgttatattactagattcaaattttaaagtattttcacgtgatggtaatttcatattcattgaaaatacaaaatataataaattaatggttaaagtatatcattgaaaaaccatgtaaaaaattataggccttataatttgggacagagaaagtagattagtttttgtgaagttctactcatttctttcacttgatcataatcttatggcacgcaagctatatagataagaggttccaactcaagaaatctgaaaccacattatgcacacccagcttgttatacataggaataaaagcgacaccaattttgttacaactggcacagcccaccttaatcgtataagaaaatgggctgcagttgggcttgtcctgatgagctgcattggcgtggtttggccctgttgttcaccaggaaatactacatgcaggcatgaagcaaccactacgaaaaaacaagatcatctgccgcaaaacgcactcatactcgcatggttttctcatgtgttagcatccatattctccgaagtgtgcgtatctgactcgacgaataatggaactcaactatttccaatagcaaactcacgtccggtaactctgcaaacctagcaagcatccaattctgtaaaagctcccccgttgcatcgtgccatcacttgcctggacaagcaacaataatacaggggcgcctttattcctgcacatctaggatttgtactctgcacacttgagagagatcttgcatatctagcacgaaggcctataaataccttgttgccatccgtttccagttcatcatcaacaacacagctgcttaagagcttctgagccttatcccagggtcaggacagaacagagcagagaagcatcagaagaatggcttctctgaaggccgtgaaacctgccggacttgccaaggagccggctgccaagctcagtgagacggcgacgaagcccgcggccgccaagggcggcgtcaagaaggctgagcagaagccccgggagcccaagaagaaggtatagtactgcagctgatccaaatccaacttgatgttggtaatcttgctgttgttttcttggcagcgtctcttcttcgtgttgatttagtcatttggctattttcatgtgaaatcaggtgaagagcagcaagccggcggcagccaaaaactgatagtggcaacaggagagatggagatagtacgagggtctccatcttacgctatgctatgggattatgaatcccgtctgtcccttcctctcgtcaccccgtgatgtcttgatcatgtagcagcaaccttagtcaagctggtcttgacggtgtgtgcagcccatgtgatgaatattacaaataagatggtacagttgtgacatccgcttcatattttttcacttggtgttaattctgtttggattccatcactgagaaaaaaaaacactgaaggtttcgcctgaaaaaaaaaactcgagaaaataaacccatcatgtaagaaagagcaactatgaacaaacacgtatggggaaaaaatagtaaagatcaagcaaagcacaactggcctagctaacagcaaaactgaaaattcactacaaaaagaactacaaaataactggcagcatatatgcgagtacaaaagaaatgaactttgtgtaacttggaacagaacttaaggactgggcagttgctacaatataccgattgctgtcgggaacactgcaaaagtgtcttgctatatcaatctaagtacagcatgagcttctagattagctagatagtaatattatctgctttactaaaattacccatgattacaaggttctacagtagaatataagcatggttacaagccttgagtgatatactgatataatatacaacactatgtacaagaagagaaaaaagatgtggtttccaatcatgtagcttccacttctattcaataccatctacaagttccgcagagttctaaagtgccaaatgcccatgaaaggaggtttagcttgcctgatcccatctacaatggcttcgccaataatcctttcctcattaaggcagaaaatgcacatatgtactttgcattagttagatatttaatgtacaaattcctctgcaaaaatctgcatccaaacatttccaaataagtataaatttcattaatatgcaaataatccaatagttggcataaatacttcaacgaattaatggacaaacgagtagtgaacatagaaattgcaaactgttactaaaacagtttggactagcaaatagtgtattttaaatataatattcacaaacaaatgtagaaccaacctcaaatccctcaacaactaaattctcaaactgccattgcacatatggtggtcttttaaataagttcaccataatatcaccactcagatagggaaaaaaagcatctggcctgtttgattacacagaaggtggcacaaagacttttctaagcatatcgtggaaaatgatattccagttctaatggcctgtttgatttgaggaatgaggagatcgattgaccacttgacaatgggttgtttggtttaacgaatgaaattggaccatcatctcatccccaaaagtacatatttaggccctgtttggcacaacaccagatcttagatcctttctggatttagagtttgttagttaaacaatagtggtttgaaattttatatttcctataaaatacgaacaaaatgattcatccaaatgctaatataatcacagatccagacccatggattttctacccagctctaaaaattgatggatctggaactgtgtgagtaattgcaccaaacttgtaggataatcccatgatggataacccatcctagatggtctgattcctcaaaccaaacagccatagtcccacaggccacaggatcatagtttcagatttcaactctacatgcaagttcggtttctattttagataagtaataaataaccaatggtttacaagtcggttgtattgtcattgagaatagttctgtcttttaaaacaaaatatcttatcagagtcccttaacagaagatatacagcttagaaacaccaaaatactgacatttgaaacttaagcgccacttataccttataattttattagaataaatacaaaatcacaactacacaaaaaataatagtgattacctactagaatggactaaatcgacgggccagctgtaattgccactcaaacaccaggcgccttggagctggtgccagagcaatcttttcttgtgtaatttcatcatcaacatgaataatagacaatacatcttcaaccaatggatctcttccaccccgaagaggatcctatggaaagatgtaaagaaacaggttataatcaaaggaagtttaattgaacaactataagaactcataattaaatgatattatagtcccacagcaaaaaaaaaatctatatactttcaaaagactgtattataaaaaaaggtttaagacaaaaaaagatagcaacgtgcttttattatatatcaaaaaagaacgcggcagtataataactaagtatatcttttgcaagatcttaacatctaactcaaaccagattccaaatgattggtcaataccagttcctcgttagtgtgtgataatccaggacagctgggatacaccaacactggtagttcaaaatggtcagcaatcgactggaaactggtaacttcatcaaaatttccctgatgcttttttcattttaactattttaaaatctcctaacagtggtaacgtgagtacaaaacttaacactacttagcctaattcagttagaacttagaagtcagaaatcggtgagatacggcaaaaaagatcatgacccttgccataaaacattgcacgtaactttaactttacacatctaagtgctgccgatactaatagagcttgagaccagaaaaaataaattcattatagccattccgcgtatattacctgtataaatatatctgtatgtgttttgccttcgtacaactgtaacttggcttgagcaccagcttgttgaaggacgtcagcaaaagtttgactgcatacaaaaaaacagagtaactggtatcatgaaaatggaaaacattatgccagttcaacaaggggtcaatcaacaaatgatccatccactacacagaacaatcttacagtacatggcaacaagaaccaatatagctgaaagcatgtttataatagaaaaacaagtagcacaacacagtaatatttgttctaacagtttaactctgaactattttgtactagtgttgaatatgggaagacaaataatggtctcaataaacttggcattctatacaatcaatctcctatttacaagtactttgataaatctactgtcctttgaactccagatttaatgaaaaatgcaatataagaacttatgctccggttctatctagaaaaactgcaaatgcttttcttcaattctctgctctgtatatccacatttaggcttgtaatagccaagatgtaaaaagacttcatattcatgatatgctacatttaagcttctaatagacaacactggaaaaggatggagagtataagggaagaattggggcattagagatgttaggcatgctacatcttggtttacgccttcatcaatccagctttttttcaacttagattggcattgcttcctaaattcaagtgaaactggacttagtaaataaaatttcctttagtaacacctgcatgtcatgccataaaaaaaatggagggtagataggtataggtgaagcgtgcatttgctcgagtttgtcttgtgtcatcttaaatggacatctgcagaaggcataagaagaaacctggcagatgatggtattgaataatcttcagttccatgcataagaacaatgggaggcagaagagctattgtctgggaacttgactgcttgacaacaatttccggagaataacgtgacaatgactcctctccttccattatgctgaaacagttattcaaaaattttccttaactgctgtttaaacaaaacaaaccactttccaagcatagacatattactacctgaaaaatattgaacgattaagaccacgttcatgaaaatggtcaaccaaactatgcatgttgtatctgctccccaaaaaaaaaatgttgttagtgcttccaaattccaatgtatgcttagtattctatcagaataatccgaaagagaaaagaaaacaattgaatattggaggctggtgcttattcgtaatatggtgataacaatcatcataattcatcttcaggagataacttttgaagtgtctatcaaactccacagcacattgagaaatgatttatttgtttgactaggagaaacaatttactccattagagatttatatgtaatcacattgaattgatggtcaactaaaatcagggtaaaaggaggttgatataataaatcataaatatgcacaatgaatcattgatagttttatttacaaatcctgaatgtcaaattgaaactgagttaagcagtttggtcgaaccactttcatattggcacacatggaagcaccagcaaatgaagagaatggaacaaagaataacttgggggagaattcatagggtttctatttacatgttagtaacaaatacaactaacccagatgatgtgaaatgatgaagactattaatttatttcttatttaagattagttcccatttggatgcactcccattgattcacgtgccaaaacaaataaatgcaattacttgtttgaagattggaagaaaataacatgcttccagtgtttgatcaaatatgccgaggacaatatcttccagagaaaacggccaatatgcccgaaaaacagaatatctgacatccaagtgtgaattttaaggatagcaaaaattaaataagaagttggcagactttttgttgcttgctgccaactcaatgcatataccagtgttgcagtaataggaatattcacgcaaaaaaaaagctaataaaaacgaactgcaagctcaccctccagataaaccaaaatatgctttgatttgtgtaacactccaagaaatggactgcccactagattctttcactgcctgctcgatgagggcacatgcagcaatatgtgctcctgctgactgacccaccaagtagatcctacaggtttaacataaatccataagtatgtcatgaaggagctagaatttgctgtttttatatagcaaaaggttattctggaggaagttacttatgaaggactaatgaattgaaggagcaaggacagataataaacagaattatatcaatatatggcttgacaatatctacacaaatatgaagaaagaaaatatctacatgaacatgtgatatttgctactttacctagcatgaagagtttaagggtaagcaaccaatgccataaatcaactttctttttctaataataattctaggaatttcaaggaggctatcaacagacattgctatgtaaatgccaaaaaattcacatgcaaacttgacttcaaaattttaataacagttctgtaagaacctttcataataaccttaatagaaactgaaatagttgttatcttaccgattaggatcacctccataactagcaatgttgttgcacacataagaaataccctgggaagcatcgctaaccatgtcacctattgttccttgagggaaatttctgatataaatgtacaacgttgtattaaacaaataaatattgccaacagtacaattcctcattagtaataaaatgatatagtattgattcagtggagtcatcagcacctgtaatcaatgcaagcaactatgattcctctctcagccaaccgcctcccaagaagggaaccccatgccttgtaactaaaatattttgtgcaaggtcatcaacaaagaaaagccaatgaataccgtggcgccttgttgcaaacttaacacttacccaataatccaagccccaccagttacgaaggccaccactgggcagggtctgttgatatctttgggtatgtacaaatctagcctgttcaatgtaatatttatcagtttcaataacatacaggaaacagtgttcttattttattttattgatgatgatgttacctgtttcttggttgttctccatagactatacttctacgaacctgacttgagaagaaatagtaatatccaactgtgaaccaagaaaggactgttttagaacgttgtagggtaataggaagagaaatcagacatgccatattcttttctgaaactgtgttagggtcaggtttgaaattctgaaaaaaaattatttgccagttggtcctggtaggaagtgtctccagtaaaaattggtcaaaataggtcaaaagtcccttttaccctttcctgttcctctcatctgaactcttccttccccttatgctagacaatattgccccgaaccacgctcaaaccaagcaaaaattttgttcggaagttcaaacaaagttctgaatatttggaactatgtccatccgtcttccccccccccccccatcctgcaggcatcaccaccgtaattttcttctttttttttgcataaaaccctaaggcatcatactcttcatgcgcaacacaactgacttgaacaattgagtcaatagaactgcatgttatctgcagcataccttgcaaaaaacctggcataagtaaaattgcatagattgtcagggcaagtagttgtgacatccaccggtaacctaacctgcaaaacaattaagatagtaaggaatatgtaaaaaaaccaacacaattatattcatcgagatattttttggcgaaaggatgaaaattgtcactaaggctgtgtttagttcacaccaaaattggaagtttggttgaaattggaacgatgtgacggaaaagttagaagtttgtgtgtgtaggaaagttttgatgtgatggaaaagttggaagtttgaagaattattttggaactaaacacggcctaatgtaatgttacgctagctggatagaaacttttgctacattgaatgcagagttggaaataaatactggcacttgaaaatgcaaggcccagacctgaatatagcgctcaaagattccaatattaaagcttctcaaacattatatacttgtgaacttagctgtcttacaagtatcttaaaagcatatttatgctttggttgtgcttatgagaacatctatagctgtatacatgtcttgtaaacaatcttaactgcagcagctgttcaattctaaacaagatgtagaacagaatttctgaggcaacaagaaagaatcacatcaacaaaattcatgactaataagccaggtaaaatagaagcagccgtgcatcatgctgccacactgttccatggtgctactactttatatacatactggtcagttaattgatcagtaagtccaaagcaagagcacaatttgcacgaagacatagtgggccatgtgactaactgacagcggtacagtacacgagtaatacagaatgactgaatctgcatgtaaaccaatagtccaatacactaatttaatttataaaacggacaaaatgcgtgttagcaacaacaaaagtctgcacgccagggaaacctctaaacgttaaaacactcgtgtggaccccgtagcttaattcccagtacgtctcaactctcacctgtcctcgaagttccacacgcaattgcatcagcaacctagtcaaaacactccctacttccctagtggattatcgacttatcgttagcttctccatgaaagctgcgttcgaatccaccacacggaaggaactccaagaaaacagaagcttcgccatcggaaatagcatggaaacaaatcgccagctcacgtatcgcatcgaggcgtccgcgattggctcgtgagctagtccatgatcgattcgggcaaacgcaacgcaagggctaacaagggtagaggggaaaaaaacaaactaaacagcgaataattacccgaggtactgcaggaggctgaaggtgaggcgcgtgacgaggtacgtctcggaggccgcgtgcccgacatcgtcgcggaacgaggactgccgcctcgggccgccgcagccgcatccggcgggtcgcggggacgcggactgcaccggcgacgagcggcggcggcggccggaggagtcgctccgcgagaggagcgcgccgacctcctcggcgctggagacgggccgcattgcgggcggcgcgcggcgctggggcggtgtgcgggatattcgaatcggttcgggtgggtgggtgggtcgcaactcgcaacggtgcgggaggtggtcgggtggtggacgccgtcggagggggagagttggggggtggtggcggtggtggggcctaaataggcggagtactcgggtagtgcgtggcaacaagggacgcgtgggcggaggcgggcaaaacatggcgaaatcttccgtttcctcctcgcctcggcatccttccttccggcgtagtatcgcagcttgcctctttcggcgcttgcgtacgcctaaagagagagaaagagaggattttgtcggattgttccgagtaaaatttgatattgcagtacagatgtcagcgttttcctcctgaaaagaattactcctattttactcccaactcacgctacggggcaaacgttaaatctgtatcgtgcagacacatggcaggcagaggagcatgagatttcatcggtgtctctcgtgtttcaccggccataaaaatatatagcggaaccagattctattttcatttttagaaaaaaaaatgatggaccaagctcgaccgcaagtgcacgcaatgaccgcggcgctcaaccggtgccacagttccgatacacttctttaacctcaaaataaattcatcttttactcatcccaacattagaatacctttattttatcaaattttaatataacaatttctcattttatctattttcaatacaattatttattacttttataaactaaaagacgcgaatattagagaagaacgtaatatcaaataattaaaaggggtgaggtttcaaacttaggtcgtctagccaaccaccttgtagagctagctggaagacccttacgcgtttctcacttttataaactccaatacagtaattatttaaaaaaaataaatataaataggatgagttaaaacgaacatattataaagagggagtattccgaacctgtccacgaaatagggaatttcatggacggaactcgaaagagtgtaacagcctaatcgtctcggtgacggagtatgggcataaatgggttggtggtggcggggccgcacaccagccgcagacggcgccaaagctgcgtgcggtgcgagagaatcttgcaggttctagagccggcagcctgcgctgtgcggcgtagctggctctcggcctctagctgctggtggcctgtggccggccactggccagcctaccgcatgcgggtggccgcgacgcgcgccttcctgccccgtgccgccgcgccacgcggcaggagaaggccaccgaggcgtttgcggccgtcgggccatgggaaaaaaaaaaaaaacgtttcgaggggcgacccgctgagctcgccgagccgggctggcctgaacagcccgtgccagcttggatgggctggcctcgtaccctcaccaccaggccgagctaggctggactggggaaagttgttacgctgctctttttcgttttatatatatacttcggctgttccgctctggatcgtaatgtgccaaaggcatatgctaagatcacataacgtgcatattagctgttgtcaacctttcaaaatgtgtgctattcagaatgctactatttcttgttttacataaataatttcaaattggacatggtggattcaaaacgttgtcttgaaaaaactcaatgtaagtgctatagctctctcacgagtagagtaggaaggca

SEQ ID NO: 79701 - DNA, 7787 bp, Oryza sativa
caccaatttctttaaacaattttacaagtgccacatattctcatacaaatattgctagacctatttttaatggacatattgcatttgctagtgattattcaaataattattcgagatctttgaattacgaaaataatatgtcactgcctatgcaaagtaattcacatactttaaaattcagtaatgctagtaatatacaatatatacacacaccttttaattcatcggcgattatttcacaacctactgttacacaacaaattttgccgatgaaagatatgtatggccatgacaatattaattatccagttgattcttttaattcattgcatggcatgccaagtatcggtcagtcacatctcagtcttatgggtcaccttatatagtatctagtggaaataattcggcttcatatgctagtagcgattatagccgaattaatagtagttccactagtgattttgtacccccacatagtttgccatcttcaaaatgtcaatcaaatagtactatgtatatggtcaaacacgcagagttcaaattgtgtaaattcggttgggggcaaactgaaatacctatgtcaaaaattgccaacattgatcaagagcacaatttcgatctcgacaataacactgtcacactagacgatttatctgagggccaacggtgtgagttagagcaggaagtcgaggtagaaattgcagagctaagggaacataaactcatacgcttgcagaaaacaaagaatagtgttattgcgaaacagcaaaagccgataaatttagaattatcggctaatgaaaaggaggtagctatgcttgatttatctggaaacataggaccttttgttttgccagctgaatttcgtgccaaggaagtggatgaacatctagacgatggatcacgaaatcgcgacgacaaggcggaaatattggagagccatcaatgaacgaacttagacatcattcaagtgaaaaaatcagaatgcttctccaacacattagataaggtaacgtttacaggtaatttgcttatttctcaatttgatcatgcttctgaaaataatccatacattaataatgtcaccatgaataattctaacagatcgattggggagattaatattcttgttggcaataataaagtgtttaaattttctatttcatcattgacaaagtttatgtctacatggtttgcttatgatcaatctagagctagaagcacaaaattaaaattggtgctgatatagcagatagttctaaatcattggacaagggaaatataagcgacaatgtagccgaatgggtagatagtaaatctgaaccatttgtttgcttagctttaaaaccgtctccacaaaagtgtcggttaaaggaaaagaagtatacttttgattggagtatgtgtgatcatatttttgatgatttgctaaagaatgattatattaaattgccggatcatcatgtcatgccatcgcttcaagatttagaagaacaaatttattgtaagtggcataattcatttgatcattgcactagtgattgtaatatttttcgtcagaaaatacaatcagctattaatgaaggtcgattgcatgttgcaactccagaaaagtcacatgccatggataaccgatttgataagagaaatcggtctaggtggtctagtagaaagaagtcttcggtacaggtgggaggtagttcaacaaggaagcaaatctaggtgccgaagtctagagttcaagaaaagagcttagctgctggtgcatgtgtgagtgtacaaaaggctttagtttagaaaaaaggttattgaacctggggggcatgcacgtgtacaacagctagaaaatgtacatcatgtgagtatgaagtgagagacatcttcggcagagttagtaacaaatcaggatccgccgaagagctcggggggcaatggcagccaattgagacattcacacagcttgtcgaattggcagaagaagcagctccacaagctaagtgtagaaaagctgagggagaaaggtatgtcatggcttcctaaaggaagtgttcaggtgcagaataaaacagatgttaaagttaaagtggaggcaaagaatgagaaggtagataggaggtgtgtgccaaatcaacggtttgcatcagatcatcaggttcttttgccaccatattatatatattcttcacctatgcaaccgatgcatatgtcttggaatcaattctcaggtatgtaaggttatccttcatggtcttattatgattcttggatatcatatgagtctatattatggagggatgttaccatatagttttgtatatttactaataattgtagatgttgttatcaatttttagagaccgaaatatttgggagctagaaataactgtgatttttttattttttttataatttatttcggtcatattttgtgcaagtcggcaagatgttggtactgttttagttttgccaaatagtatttgcttatgagacatcggtttatttggaatacccttacactttagaccgaatacaaggctttgttattcggtttggaaatttagttaatattggtgtgaggatgtagatgctttgggtgatttgctgctagtagtccaccaatttagttggggagtttaggattcactggtgaagaaaccatctttggtcggtcagccaaaaaccacaatagtcccggttgcaataaaaaccgggttatagctacttttttatcttttgttccggttggtgttctcaaccgggactaaagatcaatttttagtcccggttgataataccaaccgagactagagatacctattatctttagtcccggttggtggatctatttgtagtcccgattggtagcctaaactggaacaaaatatcaccatgcgcgcatgcgtggcggagaggacgaggcatgcgcgagatggaggagttaataaattctattccttatctcttccctaaccttatctcttgctcctcccatctcttcctcttcctcctcctcctctccccattctattcctcccctctcttctctttcgtcagcggccaagcggcggcggcggccggatagaggcgcaggcggtctcgcgccatggcggccagccgggcggcagcggcggggccctcgcgcggcagggcggaggtggcctcgcgccgcgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatacttcctctcaatcaataaagatctaagcagcggaaagaaagataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcatagtagggtttcatttgcaaaagcagcatttaacaaacttttgagaatttaataaaacagttaagtaataattaaacaatattaaatcaacgctatacaacataccctgttgcataggcccaaccattctgaacaaccaccccggctgcacagttctatctccaaaccaggaatataccattccaaaccaggagctaatcaaattattaccagttatagcatcattaactatggtgagaagtgtgaaactaatcacgaaagacattgttagacccgcccataaccgcgggcacggctattcgaatagttttactatgatcagaggtgtaccactgtacccacaagacacaaccccacatcatgtcaccatgtgcctcaataccaccacggtacctcggaaaggagttgtgacaatacccctcgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgtccatcgtgaactatcattaagccatcattaaataatagtgagtcataagttatcccaatagtgagctaatgtttctaagcatggctaagcaattatatctaatgtctaattgaacccatataaataaagctcaactagtcaaattataataacccaagggatcaaggaataaagtaatcaagaacaaaaagggctataacaatgaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcataaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacggcggcggttcacgcgaacggacggccgagatcgactcgatccaaaacggacggccgagatcgatcggtccacgaccggctcacggcggacagccacgatgacgtcagcgatgatgtcaccaccggcggcggcggctcggcggctcgggcttgcatgctcgccggcgaacgacggcacggcggcgcgaacggaaggcaccaacgggtagcggacggcacggcgaactcaccggcgaccaaagcgacggcggaagaggaacggacggcgacggcgacgaagaagaagcggcgacgctcttcggcttgacgacggcgacggtgctccggcggtctacagcgacagcgaaggggcggacgaggacggcgacgacttggcgaccacgacggcggtcttcccgagcgacgacgacgtctggaacggcggcggcgcacggctggagcgacggcgacgacggcggcgctagggcacacggcgctagggcgtttccgacgacgagaggcgaaggcgaaggtggcagcgggtagaggagacaccggggaaccttttaaaggggctaggagacgacgacgaaggcccacggcggccggcgacgagaaggaaagttcgggaaaatcgaatccgaaacaaactcgaatccacgaatttccaaacgattttagccctctattgattcggccggagaaggaaaggatcggccgaattggaaagcggcggcggcggcgcggtgctagggtttcggccggaggaagacgacgacctgacaggcgggccccacctgtcagcgggcggacgcgcgggcgcgggcggctgcggactgggccggctgggccgaggagagagagaagggttttgggccgactttcggcccaaagccaaaagagactttttaaaacctttttcaatttaaattatttcttaaatgcaattccatttattaaaaatacttccttgctcaaataaatcccagaaaaatctaggaattatagaattaagcaaagtatttaatgaaattttatctggccccattttatattggaatttattaattaaaattagatcttctcttctaggcttttacaataaattctaaaaattccatttaaacaacaatttatatattttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaagcggataactcgattcctggttcttctctcatctgtttccaaaatacggattggtttctcaacataggacagatcctcttggacttctatctgttcgagattagcttcttcggtaggtacccttaaacactttttcaattgcgacacatggaacacattatggactcctgccaaagattgaggtaactccaactgataagcaacctctcctcttttactgacaatcttataaggtcccacaaaacgcggtgccaattttcctttggtgtggaaacgatgaactcctctaagaggcgtgacacgaagatacacataatctccttcaaaacttagatctctgcggcgattgtcggcataactcttatgacgagattgagccactcgcaatctttcttgaatgatctttaccttttcttctgcttcccttaggatatccgtcccgaaaacctgacgttctcccgtttgatcccacaaaagcggagtgcgacacttccgaccatacagtgcttcgtaaggagccatctgaagactagcttgataactgttgttgtacgaaaattctgcataaggtagattcttatcccaacttccatcgaaatctaaagcacaagctctcaacatgtcttctaaaatctgattcaccctttcggtttgtccgtctgtctacggatgataagcagtactaaagttcagcttagaacccatctcttcctgaagtttcttccaaaaatttgaggtaaactgactgcctcgatcagacactattttcttagggacgccatgcaaacacacaatccttgccatgtacaattccgctaagcgacttccggaataggttgtctttaccggaatgaaatgagctactttggtaagtctgtcgactatcacccaaatagagtcatgacctgatgacgttctgggtaaaccagtgataaaatccataccgatttcttcccacttccattcaggaatcttcaaagcctgcaacaaaccggcgggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcggggacacagattctctcacccaaccatacagttccgtgctcatcctccaagaaaccgatagcttttcctcttctcatattcttcttgatctcttgaatatcaggatcattaatttgggcttctctaacttgatcaattagagtgggcttcgcttctaaggctgcaacgaaacctctactgacaattcccaaatttaatctttcaaattccttgcataattccaatggcagctgtcgtccttccgtagcattgcaatagccttttctactaagagcgtctgctacaacattagcctttcccgggtgataatgaattcctatgtcataatccttaattagttccaaccatctccgttgtctcatgttca

SEQ ID NO: 79702 - DNA, 31996 bp, Oryza sativa
cctacccttaatcataatggaattttttgttttgtcacagcttagctagttatcatgcttatcctggccaccacacacattttccactcttgttagcttggggcaaaatcaagtgcaaaccacaataccctctcattttccaaaactttgttgacaaaactagaggaaactcaagtggaaaccacaaattcattaaggcatgaaaactacgtttgcaattttcaagagaattactaccaattaccatatatagggctagtgctatagtacgaacatctaaaaattctaagatctacattggtttcatgtggaagaaacacaaaattcataaaaagagtaaagtatactagcggtatcacaatttgtttggtgggtgcaattaagtcactcatcttgcaaattgctcaaacaagacacctatcttctttccaaggtgcaaatcacagaaaacatatgccaagtgggatgttcgtgtgctaagttagatgccatattaatttcattcatatacgttaacacaaatagaccaatggtctaatagtattgacaatataatctaatttaagaatatttttgttttttttgctaagcattatgcaattgtgttgactgaaagcatatgcatgtagcagcgcatgtaagaatacagaggttaatttgcttttttttttgcttaacttcaaacttgtaaccttgccttgcccatatggatcgcaagcgcatcatcttataccaatagggtttttaatttagcaacaaacacttcatgtgacatgtattctataatatttgcacccatgaaacaagttgagtggcttgtttgagtaatttataagattagtgactagagtgcacgcacccaccttacaagttttagtacccacggtgcattttactcttcataaaaggtgcaatgaagaggttgaaaacaacatttttcactctttctatgaaattaactaaaacgagtttatttttgaaattttacatcaacgtgcaacataacctctaacgcatatggtgttttttagaactttttaaactgtaatatatacagtttgtttgttgcatggttttcatgattacaccagaataataggtgcttttctacttgatactttcctcaacaacaccattatgaactgaagaataatttttttcatccttctagtttgagctttcaaccgcaactgtgatcaaccttcaagtgttatttcaacccttggaactacaaaatcttaactttcacgtttaatttgaagtgtgagactgagcacatgagttagctatgtgtgtggaattgaaataatcataaaatttatcaatatctatactaaataggcactgggaaagcaccaagattattagaaatacttttatgctgattaggtcgatctaaatatcatgattgcagatcttattaagagtttgttttaaattgttgggacccaaggtcacgaacaaaatggggataggtggggaaatacacttttcccctaactatcctcaaggtgacatgaacttgagatatattggttgacttatgttgccattgttccaatccaatgtcacatgtcttgctacaaggttaggctgtcttatattgccttgggaggtatacatgaagttacattagtgcccccaaaggtacatgcaaagttacggtaataccctcaaggagctgtaaaccctaggggtgttcctgtacacttggatgactctctggaccactagcgccatcttgcaagggcagttggagtggtcacccaatattttctaatggaatattcttgccgggttgtataatcaagccttctcctcagcatggcgtgtactacatgcccctcttgtaacaagctcgaataatatttgatggataaaacaactttccctgaactagacacgaatagtatttgatgggtaaacacaactttcccatgaacatacttgttaggcgttcgaggccatgtcttggttaaataggaggccaaccctttgttccgggtgcctgctacaacataaataaaatatgccaatggaaattgtcatggttatgaataaggcatacctcctttcctatgaattacgaaatatacggatatggtataccttcgtatatacgatatattcccatatatgataaggaaaactagaagatattatggaaaatatcctcatggactggtgattaaccgagtcctactcagagatgattgggtttattctatatcatgcaggtttattgtctccgagttctacttggagactaaggcaattcacggtataaaagacacaccccctgagaagttcagatcatcgaatcatagcgccaacacacccatcataggttatgaagccggaggatgcgaagcctactcgccggaagatcttgtcgaatcatctcgacaagggtctcgcatgtaacgccggattcatctgttctctgtgtactctgtggttttccatatcaatctcatataaactgaattagggctattaccttacaaggagtctgaaccagtataatttttgtctctctgttcgtcttgatgtcgtatcgtgtagatcctcgtaccaacgtaccccaataccctatttatccggtctacgggtatcctccgtcgacagaaatgttatgtacttctaattgaaataatgtaagaaggttataccacaagaatggtcccctgctggagtttgaggtagtattgcctccgttggtgttgacggaatccttcttctccttgtctccagtgtttgacatgttggtgaagacgaagtagacgttgataaatagtgagtagtcgagccttgcgctccccaaaaacctgatcgcccgcccgtccgtgcaaacgtcgcagcagtgcgtggtttcggaggcctactctcccaacgcgtatgcacacattcgtcgggatgggattaccgtagcagcaaccgccttggaaatggatgaaagtgtgtctcacttctccttagggagatcaaatccattctcattttatatgaggagtggaagatgaagtaagagtcatggaatgggaagaggaatagagtaactaattctcatcaattagccatgaaccatcaaccaaccatcaattaggtgtaattgatgtaggttaccaatggaataggaagagaaatagagcaactaattgtcatcaactagccatgaatcatcctccactacacaaccatcaaccatccatcaattaggagtaattgatataagttaccaattccctaatcaaatggattaattctcaaaactcatcatcccattaatatcccataagataatgaatacacatgaattcctagcataatgagccttggaatttatttgatttaattgatttaaatggatcaattacccaattaaatctaacatcttgtccagtcgttttaccaaatggcttgcttaattagaaaccactctagtttcttcaagcttgctactgattctactgaactaggattagtccaaaaacgtcccttgtcaagttgtcctggcttctagcttgtatcgcgaaataaagcttttgttgtgctagtaacagtgtgtaatagtgagactgccgtcgttttacaattgatacctatgctgccaacatttggtagctgcagcgatgggcacacaccatgcatatagtatggatagggatggaaacggtcagaagaatgctcaaaccattttcataatcataatttttttcccaaaaactgaatcggaatgattgtgtgaaatgataacgagattaatactactacaacactagaaaatatcataaacaaaattactgaaatagagtctcagagataacgtaccacaagaacaaggaggtcatagtcatatctatactacaaagtaacgtcatgtactaagcaattagtgtagatttaaagaagtaaataattaatttaaattctttataatgatactatagcatcgagaccgacaacacatggaggttatggtagcatttttctaattctaatgggttgccgatactttacacttatttgtttcggatgaaaatggtgcaccgttaaaacagttaaagaaaacaccctcccgttttccatcttgatttccagataagataatacagagtcgaaataaaatggctagtacagaacacaatgatagaaaactccgagccgtttttatccttaactatacatatcaggtcaagtccggccaactcctacagaatccaggacgggttggattgacacacatataaaaggctggtcttagaattgccgtctagagttccggtcttcctgaccgaccggctggcgagttcggtgctttgatctcgtgctcacttcgatccaaattttgtgcgtctcgtcaagtcactgcttcgaccccgtcactgctacccaattctcgcacggctgaacctagcttgtagctgtccatccgacgcctaacttagttaactgtcacgcagcaatgcagcatcggtagtcgccggccggtagcctggtaggctactgtggttgatcaacggatcgagctgagatgatatccatcccctggtacagactacagaggccgcgtgaccaatgtgccagttcaggggacaagaagaaaacgtaggccataagtgaaggaggcgaagcgggtagcgtccatcaagaacagggcaatggattgcgggccactggactggacaccggtccgggaccaaagaaaaaccacgcccacacgatggcacgagccgtgcagccgcgcatgccttgatgcgtcgcgtggtccgtccgtccggccgccgaggcgaggcgaggagaggcttggcggtggcgggcgtcgtcaaaaaggttctcgggaaaagtccgcgggggtgatttgtcgcgcgcgcccacgaaaatcgcatcacgtggcatgcttcggcgtccgtctgatcgtgtagcggcaggcccacccggggtcttttctgcgctttcgtgccatgatgtcatgtgtggtctcgctagcttctctctctagtcttcgatctcttgagctacgccaccatgccatccatggtatgtaggagaacgctacatgcatcgcatctcaggcataggcccaagttctggcactcatcagagttacttaggagagttccttagggttggttttgtttgtggtctaaaataggccttattaaattttatcaatgcaaaattttagtaagttttggtatgactaattttggtaaagcaaagttgtatttggattgaagccaaaatagcctaagttcactattaaaatggcatattttcttaggcatgctaaaatttggcttcaaaccaaatagacactaaacactattaaaattaataaatattggtaagcctaatttagatctcaaaacaaaccagcccttagggcttgtttagttcccaaacaaaatttttcgtgctgtcacatcgaatgtttggatacacgtattgagtattaaatgtagataaaaaaacaattacatagttcgttaggaaattacgagatggatttttcaagtctaattgtgccatgatttgacaatgtggtgctacagtaaacatttgctaataacggattaattgggcttaataaatttatctcgcagtttactaacggaatatgtaatttgttttttgttattggactacgtttaatacttcaaatctgcgtctgtatatccgatatgatataaggccatccccaacccagaaactattaagtagtttccatacttaccatgtcatatagacactgtgtatagaaactatgtatacaatggatggagtcttcaaattaaattctcatccaatcacctctcttctctctcctttatccacgtatgctcttgtttttatttggtacttgtgtagatatggtttcttgtatgagaaatgatttcttcatctttttacctctcttctcattgactctattgccacatatgatttttgcttatgtgacaatgtatttaatactatggaaactagatgacatagagggttggggatggtctaagggggaaaattttttgccaactaagaaagcccttacttggatgtgatacgaccacatcgttgaatcatcgaacaacaacgtggcagctcaccacggcagcggccagcgggtcgtgccctgtagacccccgattttggaaatcggaaatcttctgtgtttatccgtaccaatccctggatcagtagttggtacacacatatatagttggatcacaacatatcagagttaaaagagttaaatacttacattagggccaggtaggccaacaactatcagagaacaaaataatataagggcccggttaacatgccacaggcagtcgactgggaaacgagacctaaaacaagaccgcactccgatcatcttgttggatacgcaagcgtaccgacaagggcttctcttcaacactctcctaaaagatatataaatagcaagggtgagtaccaaccgtactcagcaagccaccataacaacaatgcatatgataaagggtatttcaaggaatggcttcaggttcttttgcataaagctagttttgcaattcttttcacaagtctaagacatagcatagactgatcaagttttaataccagtgttcacattaaacaacgacggttctgtccaccattcattgtgatcccaaggatagcttcccgccattgagtcgtcatggttttctgaggacgtccaccttccctcctcccagtaagtggctccaacagcataaaaatcatcatgcaatatcccatcccacacaagttaagaattttgagtctagccaagtgtaatacacgtcccggtgctcaataaccgcgagcacggctattcgaatagatttggtttattcacactgcagtggatgtacactttacccgcactccgcaactgcccaacacatgagcctcgtcccaacacatgagacgcgtcacggcaaagctttttgataacctcgcattggcagtacccgctccatgaactttacatcctcatgcactctaggcgtacacggtttctagcagtgagaggagttctggcgcacccgggaagggaagactcacacatgcattaagttataaatatgtttagattctcacatggcagtcctaccgatggtgacaccactgtagacacccgcctcgcagtcctaccaatggctgccccaccgtagagtccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggatggcactagccttttccggacatcacccaaatcctccgtctgccccagtcgaaaacagttgtttaattttatttctcttttcacaaatcatgttatcaacatcatggcaatgtgacgctcatgtctccacatgccgtatctcaattaccttcccaaaggtaatttcccaagcatatagcatttgataaatatgagtatgcatgattctagaatagcatttctaagcaattgttataattgactagggactcatacgtaaacatggttacgaaggcataaggggtaaataataatcaaggcatggcataatcacaagtaggatgttcatcattgcatgcaattttatttgtaaacaaaataatttcgcaattgggatcaacatgttcaaggaatagtgatgacttgcctgctcagaatcatccttattcttgatacaatcttgatcaaccttcacctcctggaagctgcatacgttgcctcacgactaactgatacacaaattctataatacgcgagaaaaactaatattcaacaacaagcaaatatgcacaaccaaaatacaaacgtcagggtcgaacctagggttgctcgtactattattgcttgctaggggattccaatcatgctaagggctaaaattccttaatctttctattttcatcgtggtctatttaggagttaatcgatagtgtataaatgagatatacatatggctaatctgtggtttagtcaagctaatgactatggaaggattatggctacacatgtatttatctaaataaagtggtcatatactagaggttctgttgtcggatagatttaggatcaatcaaataattacagtgaatcatttgtattattattttactgatggaggcattactttaattatgaacatattttacttgtcacaataaattatgaaaggataataattatccatgctttgaatgttagagttgtttaggttaaccatattatggttacagattatcccttaatgaacaatcctaacttacagttgaactataattataattataaggtcaagatttataactagtatttatccaccatacatgtttgtcatatactccttggtttaatatatgctaaaggtaggttattgttcttatgtgtgattttaaatggattgtacagtatatgtgatttaagtgggttgacaagtgattttactgtttgagtaattattggatgctaaccgactcaaccttatttgggtggttctatcataacaactctgttcctattcctcataaataaattaaagactcatctatgtgtattcatgtttgattgacctaattataaggctagctttattatttaaataatctataagtcatgggtttaattatacaacaatttaatagtactagtatctccctatacattaatttgagacatcatttaaaattagtttgtgtggttattacaatgacaaagcatgttagagagaaatattcttacatctagtactaattttatttgttagcacatttttaagttgactattatgcattatcttagtattaattatataccattggaaagcttatgaatttagataaatttaggttcaagtttcactcaaatccgagttaaaatgagagagttacgctagtttaaatattcaaatttgaattaatccgagaaattgcaaaaaggtactgttcataaatgatttatttttaatccgaagtctgttcttaacactaacagttgctgacacgtggggtcaaacctttactttattttccaccgaattaattttctaaagggaaataggatgtgctaatgacaagtggggcccacaacctattctcttctcttttctcgttctctctatcgtcttctacctccagaccgagcgggagcagcaggggagacgcggcgcgcgcggcaaggccggccgagggcgacccgacggtgaccaggggagggagtggcaaggctctggcgtccacctgccggcggtcacggcgtaggacggcgcaggggcgagcggcgccgcatggccgccatggccgccatggccgggcacgggtagctaggtgctagggcgatacggagggtttacgaccaaattggtgagggcgtgagcatctacggagtgtgggggttccattttactcactagatggagaggaggagctccgggatggcttgtccacggcgagctcaccggcggcagaacggtggccggaccggcacggcgacggtttctaattggcgaaattaaaggggactatagtttctacggaactaggggaggccagaggagcgaggacttaccgagggatggaggaacgacgaagttcgatgtcgcgggggtggagtagagaagaagatcccgtacgcacgctaggtgttcgacgaaatgtgtgtgagaaagagaaagaggcagagatggggctaggccttgtgatggcagccaaggtgtgtggggaggaagggagatgggaggggggtatttatagggtgtgggaagggtggcttaatggtcgacgcgacggacggcgcacggggctcgaggacgacatgatggtgcgcagggctcgagggcgacatgatggcgcacggggctcgagagcgacgtgatggcgcacggcagcgcgtggctcaaggcggcgatggcgacacgcggcgacgcgatggcgcggcagcggcgcacggggcatgaggcactgatgcgacggcgacggcgacgcgactggtacggggctcggcgcggcgcaagtgacggtgacggtgacacgagcggcgcggggctcggctcggcgcggcgcagccaacggcgacggcgacagcacgcggcgggttggagacggcgcggcgacggcgacgcgacatgacgcggcggcgcggggcgcgagttgacgcgcgacagcggcgcggcagggcgacggcaatggcaacaaaacggcacgcggcggcggtggcagagcgaggcgacggcgacgcggcgcggtgatggcgacacgacagcgacggcgccggtgcgggtggggctcgaggccggctaggacggcgcagtagtggggagaaagagagctgggatggctagaaaccaaatcgaacacctaggggctaaggaacagtgctagccaactatttctgattttagagggtactttgcaattaggaacttggtgcaatatcgatctacatatcgaattaaatactcccataattctattatatatagagagagcctagtttatttgaatgatcatcatttcatgtgtactcatattatggcacccacctacattattcaaatattttaatatttgataaaataggttaataataactttttgtttatttgattttaatatcttgtgcataattatttgtaggattaaatatattctcgtaaattatatctattacttaaatgtatattacatttaaaatgtagttcttttctttacttttttttatcatttatggtttggcaagtaataggaatcataacaaccagcatgatgcaaaagttttaaaaaaatttgaaattttagtgatttttattatcggaaattttcagggtgttacatgcccgaagccccgaagtccaaaccgagagtagctcgcgcgctgccgtgtcgaccgagctggcgcctccaacaagtccacggcacggggcgggagggaactgtattccgtgagacaatggcacgagaggcagctgcagaatatgtccctgcatgcctggggctatgatatgagctgtggctgtctctgagatctcactggcctgatgaaactctacatggtgcaatgcatatgctgatttgcatttggcgaatagcggaatagggaatcgcgtgcgtagtatattaatccgccgatcacttaacctaaactccaaaaggtgatcgtcgtgcgtacgtacgtacagcgctccggtctgttcggtcagccctcgcgaagcttcacggaaacaaagaaggcctcatgatcgggagatcagaagggaggaaaaaggataacgaggaaactgtttcgctttgtcctcacgcacacacgcctcatgcgtccgtgtttatcgatcatgccactgccctgctgatgaacaagttcttcaagcaagttacggtgatatgcgcgcgcccactctgcaaggagcagggaagtattggcggcacatggagcagcggaagaaaggcatttctttgaaccggatcgtttcagctaatctatcgcccatcaccgcatccgacgcatggttggatggaatgaaatggaattacatttacacgtccacggcgtggttgaaaccgaaaaactggatcgcgtgtcacaaaactcataatgattggactaactgaatgtcgatttcctagcgcaatgattcatcaataatgcctggaattggctccgaaagtctgaatatgaaaatgatggctggatgggactctatatacatatgtcgataaaaagatcttctaaaaatttatcagatgtaaatatattatgattgtagtataacttatatagtattacttatatgtaacttttaaaaatccgaagtggtggtcacaggtcaaattccctcacccgtgcctgcgttttttttatcctttctgcttgcacgaatctcgaacaaaaattaattgttaaatatttttgtgaaaattataaacaagttacaccaaaatttaccatatttacgtcagacaaatattttcaagaaaatttatggacatatttatagcaaaaccgggccggattagcaagcgcatggaaagaaaggctctcaacgaagaacctcgcatggaggcccaaaagtgcatcatcgtcggcccgtccggcaaacggcccatatcttgctatgtcggcccaaagaaccctcgaaagctagggctttgcggagggtttagccgcgaccccgttcagtcaaccgtcattccgtctcttgctctcaagcggcgtgcaaccatggcggccacggcctcctccttcctcgcccgccgcctcctcctcacccgccgcgtcctttcctcccccctccgccccttctccaccactgactcctcctcatcctcctcctcctcctcttcctccgacgactcccgtgcgggatctgatgcgggacccgaccccgagcagcagcaaccgccaccagcgggccaggatcagcaggccgccgcccggccgcgcgccggcgacacccgtcccctcgagaacggccttgaccccggaatctacaaggttggaactccttgatcccctctgggttttgattcggtgcgagctgacagcctgattggggattttatttttttgtgtgtgtgggtgagaatcgcgaaggcgataatggtggggaaggtggggcaggagccgatacagaagcggctgaggagcgggagaacggtcgtgctgttctcgctcggcaccggcggcatccgcaacaaccgccgcccgctggaccgcgaggagccgcaccagtacgctgaacgatgctccgtgcagtggcaccgcgtctgcatctacccggaacggctcggcagcctcgcgctcaagcacgtcaagaccgggtgagccctctgttgcctctgcagacgagctgtcacgtaaacgtagtgaagggccaattcctgatgtttgagcgtgacaacctctgatttcgtatgttggattagattcttaactacaatggttcaactgcatagctctgttgcaattgatttgttggtgagtaaagcatctgttatgattatacttgatatgattggtacttggtttccttggggtagaatttggtatattcctttagctctgcatgagtggggattggtagatgcctttttcttttgtgtcgatctattgacttgaacttactctacctctcatttgtgattacatcactgttctactgtattactcaattagtaagaagctaaatatattagtctatctttcgcagttgtcaatttgcatataagtgacatggtaataatattttaaggttttagctttgtacagttcctttttttaattctttggttgattaactccactaacacaagtaaattgtaccatttcaacatttcagttctgttctttatctggaagggaatcttgagacgaaagtgttttctgatcctataactggactggttcggcgcataagagaaatagctgtgcgctcaaatggtatgtttattgcaccattgattttgacttgtggcaaatattttcttgaaaacatgtactagtgcgttgcccatacctcatgttcttttaacaagttctgtctagttctcaaaaagcaatgctcataccactacagtacgttaagtagacttttcgctgtttccttttatttttcacgtacaaactacaaagtaatgtcatgttgcatatgagcattcagcgatactgttcaatatttctatcgatgttgtttagtcggagtatgatactttttttttccatacgaacaggccgtctcttgtttcttgggaatgattgtaatgcgcccaagttaggtgaagccaagggcgttggctacttctgaaactgaggtccactcgacatcaaggtatatcagttgataaaattgatttaaattagaggtatctcaactgtgcttagctttaagcgttcaacgtatggtgaagatctcagtagtggaccagctttatggaacaaatacagttggacatcattgtcgaaaccctctaataattgaacaactgattgtactgtataacttgattttgacaaaacaacatatgtggctgtgctatttattttagttctcccaaaatttcttttgaccttttgggtcagagaagtttgtgaatttgagcttttctacaataaaatggatctgtttactcaatagttgttctatgatgcttccagtctaatctgataacccccttaatacctaatgcggatgataaagcctatcactttttttttggcatctgacagtaaacaaaaatatttgaacaactacgggagttaccacatatctttctgaagtatgcttttttcttgtcttatctcacgtgtccatcgtaagagcatctccaacagtctctctcactctccaaatgtctatttggccaactctccatctaatttgacaagccaaactcgttgtttactccaacagcctctccatctaccatctccattacaagtctatgacaaatgggacccatacgtcagcctctactacccttcttccactctcttttccccacccggccaccccttctaccacctccagtactacttactgcctcctcccctcgcctttaccttggatgcggcgacgacggatgacgacggccacggcaactcgcgtgcgcgcaaggcgcggatgcgcgaggcgacggcggacggcggcggcgactcgcgtgcgcgcaaggcgcaggtgcgcgaggcggtggcggcggcgactcgtgaccgaaccagttcccgacgacggcgacgacgcatggccaccaggcgaactggacgactccgctggcgacctcggcggcgaggaagaaggcgaggctgtgcacgccgaggaagtaggctgcgccgcgccgccggcgtggccccggaggcgaccatggcggcaccgaggaggcggcggaggtcggcgcggtcggcgaggtggcccacggcaaacatggcggtgacgaggaggcggcggaggtcggcgcggtcggcgaggtggccaccgggctcgccgaggcggtgcgggccggaggcggccgcgcgactggaggcggcggcgtgggaagctggcgccgcggcttccatttggaggcgacgacgaagaagacaaggaggagcgtggtgggacccatggatggccagtgaatggcaagtggagtaggctggccaagtttggctagtgagggaagaaatttggccatccggatggcttggagagtgggatggagaggctgttggagtgggatttttgttcaaaatggctaaattttggcttggagagtgggatagagaagctgttggagatgctctaagatctgtagagtttgagggataaacaagttatcaaacctgcatgctaacaccccaaaactttactttctcacctgctgaacacgccttttctgtctcaccatcgcatatccagatatcatctgctttgcacatcagttaaatgtaatataagctcgaagggtatatatagttactttgtgagctaaaagttttagggcaatgcaactgattctgaagatcaaaccggacattctaagatagacaaaaagcccaccagccattctaaaagataaacagaagacgaacacattatgcttgtaacagaacaatattcttatgtctgtctaataaacaaaaggtgaatacactatgctcgaaacagccaattctcactgaagatgagcacattattcttgtaacagagcaatcttctcagacttgcctaatgtgacgtttcctcggtggagaagttggagcgctgggcaagaacatgtagataccaaaggacaggaggaaagctgacatcgaccaatccttctagaatctggacaatctctcccatcgttggtcttgtgttctcatcatcttgtatgcaccagcaagccaccttgcaagccctctccacctcttctaagttagcatctgcacttagttctgaacctagcaagtcttgaatcttcccttcagggagtctcatcgccactagcactgggaagaatgtccctgcaccttgctcaccttgccgatgccaatctgcatttctgtttcctgatatgatctcgaaaagcatcatcccatagctgaaaacatctgcctttgtggtgatagctgtgccgcttatccattctggggcaagataccctatagtgcctctcatggttgtcaaaactctgctgaaatcccttccgaggagcttggcaagtccaaaatccgcgatctttggcatgaaatcagcacctaggagtacattctctggctttatatcacagtgtatgatgaggctcctgcatttctcatgcaagtaagctaatcccttggcaattccaagagcaatctgatatcttgtcttccagctcaaagtcaatggagtgcttccaaataggtaacgatccaacgacccatttggcatgaactcatagactagcatcttcatggacctctctgagcaaaatcccagcaaccggattaaattcacatgctgaattgtgccaattgtgctgacttcagctcggaactgcttttctccctgagaaacaccatcaagtttctttacagcaattagtgtcccatcaggtaacgttcccttaaatacaggaccaaaagaacctttgcccaacctctcagagaagttttttgtcacatgctgtaggaacctatacctgaatacgaccaacgaaccctccactttgttcgcttcactcaaattcctcttcctgagaatcagaagtatgccaatgatcacaatgagggtgacaaggatagctccagcagttgaagccccaataacagttgccttcctcgttagctggagaactctgatgcagcgagccggatatggatgctatgccccactgaaccatcagcaggagccactagattgattaaatctccataccacaaagaacaaccaccagcgtaggaataagcggtacaagagcaattgttcagacaagcctgcttacatccatctgtaccagttgccaaaccccaggctttgtcaggcaacttagcaacagctagtgcatagaattcatcagctgttgtcttgctagagctattgccatcatattgtagcttagtgtttctcatgcaacctccactgggattaccatatcgccactcgccgttgtactgcttgctgaaacccctgagacaactgcagaaagtgacggcgttctcagtgcacatggcaaaagaaccacaaaggaagtacacggcgcactgtgcttttggcagtgccaagaagggcacccagtcttttttgctctccatccatactactgtttttacctggcctgaaatttccataataaacatcgctgtggcaatggatgcattagttcggtacacaaagtagctctcttggttgttaacggtaaatttgtagcttaaaacttctttaggatacaatgccatctcaggaattccagtaaacatattaccaatccatttgcccgtttcccagtagatggcagaattgttccatagatggatgaactggtcgccaccattcgggtcaatctcaagcgtataatacccaggtgatggatcaacagagcttttccatgagataaatcttgtgatttggccagtaattttgttccgtccaagcttggccccagggagccacacattggtcggttcatcaaaactctgccataggaaattggaggtattggaggcaggagctaacactaagttgcctgaatcaaggataactccaactgtggagttgacgttattagtgatatttgtggcccagatcaaagacctggcctggtcgaacaatgccaaattgccatcttctgatgctgtcaactgtgataagtttggatcagagattggagtcgcccgatttgctatccagacgggtgtggtctttgagatcttgttgtaccaaatagcaaggtaccatctgttaggcgctctatcatctgaattgttaaccactgagattataatagttttcaagaatgcactagacaaagacttctagagcttagagactagtatgtgtatctagaaagaaataacgaagataggtcttgcttcacatcttcaacaaatgctaactgctgcatgattcatttgttgtacatggaaatatcttcttctacaaattataatattttctctcttatatttccatctttcatataagttaaaatttaaagcttgtgggaaagtaacaaaaagaaggaaaagaattatgccatgaaacgagcatatttcggaagccttccttgtggatttcaagaactcacctatttctttctcacaaaaatatgcctactagggcactagccagatattcacctccaacctgaaagtatcaagtaaaataaaaggaaacatgtggcgtggcttgtagtttctttttttcccctaattatagccccccaaggctatagttttatactattctttttctattatatcaatataaaatatttccttcatcccataatataagggattttgaagggatgtaatacaacatagtactacaaatctagacatagggttttgaagggatgtaacacaatatcgtaatactagatagtgtcacatccctccaaaatcatttatattttgggacggagggagtattgtactatcttggggtgcaataagctttgcacataacatgttcaaaacatcaatttggtttgtaattactattgcaatacaaggatggcacactgtaaaactataaaattgccatgaacagtacttttgaaaaaaaaaacatattaatcgtgttaagtctgtaaaacattatacaagatatatgctaacgacagaatggaatatcatccttacgatatcccatcttgtatcccctataaaacattaccccatgaaatcttgtacggaacttgcataaaacattttttcgatagtagaagtcaatctagcctctacatccaggatatataggcatatagccaaaacatgcatagaaattgattgaactatttaaattaagactcactgaaacatgcatacgcctaacaaaactatatgtacctcgttttattttttgttttggtttttgatcaaaccatattgtccttactgcaattatacatataaaatttaggtatttccggggaaaaaaggtttcttgaaggactggaagaagcatagaactatgacgaaacatgcagaaatgtgggtgaaagctttctgaaaccttttgtacttaatgaaacccgatgagaattggaatataaagcagaggcaagataaactaatagctgaagtttacaatatgtctctaatctctatatcacttgttacttgctacagtagttgctataaaaaatacaaacgaaataggctgaagtttttgaagtggatgatagggctgaattattagctcatgtatatccacgtaccaggctggaagaaccccagcgcgaaaagtccgccggacgagataagcctttggccgccggagagcggccgattccgggagacggtgtcgtctgcccgcgcgcatatcagcagaagaaaacacggaaatatcaacgcgcccaaggaggcctccattagtgattggcttcttttgctgggaggaaagcaattatatagttcagccttgactggtgctactgtgccagaatagtaaaaggcgagactacggtggtgtttggaatggatagatggcacatcggacgttacgacactaattaaaagtgttaaacagagattaatgataaaaaccatttcataactctagactaattcacgaggattagtctatgtgatgctacagtaaacatgtgctaattatagattaattaggcttaaaaaatttctcacgaattagctctcatttatacaattagttttattagtctatatttaatactctaattagcgcatatgacaaggactaaaattagtctcctcatatccgaacaccacctacaaaagagtattccctgtttggttgctcgtgtagttattgactttgaggttttttttaagataccctagatatatatataggccgtccatttagtttgatccaacgcgtcagaattcgtcatacgcggacttccgttgctcataatccacgcacttcttggcttaattatctcttgattattgtttcatatttggagagaagatatccaaattattgcaccggcagatagctatgaacagcatcttcgtttttttttttcttttccttcttctctattcgattgaacaggattttgcaaaagcacgtacaatctatgatcagtaattaatcctcaaattaaacaagaaggttgcatgcatgcctgttcattctttcatgcttgcatgcaaacccgggctctaataaggactttttatgctgcaagctaggtttttttttctttttttgagaacaagctaggctgttactgttgttaatttgagagagatggcggctggcggcgacagtggcagcgctcgttaagttgggggccatgcgagatggaaagagagatcctcacggaattattagatttaataaattaattaattattactttaaccaaagatctaaaatatctatataaatcaatggtacttcctccgtttcacaatgtaattcattctaacatttctcatattcatattgattttaatgatatatatatatagattcattaacatcactataaatatggaaaattctaaaatgacttacactgtgaaataggtggagtatgatttaacactattaccattattagtaaaagtgtgctgtaaaaagcgtccggactccggagtttggagttcctctgctctgtacctctggaaaaactcggtaatacaaaaatagaatcattcgacaaaatttcaaatgggaatacgaatattcttattcaacgcagaaaaaatatatatcaaggagataaaaaaagcttaactaaattaattaaaccagaatttattgcagctgttgtttcttcttttggatcattgtgtttcctacgaggtgggtcgccgccgacagagacttctagtgtcgtacatgtacatttgttagtggcggtcagttctcagttttcaccgtagcgggccgggcaccttttgtcaactccggcaactggttgtttggtgactatcacagattcagaggctcgcagccatgattctctcaaccatgacggcatgacgaactctcgcttccggatcatccaaagaaaaactctagggggcatgtactatcccctagcagcagattgatagcttgacaaagaaccaacggtgcaacgattcattaattaacatgttattattattttctacgtatatctttatctctacttattataaaacttaaagatgattctgtactcatccttatttccgtccatagtccgactttagagctgggatgtcgtgcgtgaacgggtcacgcgatggagggagtatatacgactgaaataaatttaaacggtataatttttatattatggaatgaagggagtatatccgactgaagtgcagaagtattctctccttaaggggttgtttagtttaaaaaaaaaacttttcccaaaaagcatcacatcgaatctttagatatatatgcatggaacattaaaatatagattaaaaaaactaattgtacaattagggaggaaatcgcgagacaaatcttttgagactaattagtccatgatttagccataagtgctacagtaacccacatgtgctaatgacggattaattaaactcaaaagattcgtctcgcggttttcatgcgagttatgaaattaattttttcattcgtgtctgaaaaccccttccgacatctggccaaacgtccgatgtgacacccaaaaattttcatttcaccaactaaacaggccctaagccgcctccaagaaaataaagggcttcttgattaccccgagaaaccgaaaaatagaaccaaggccctctttgtttaggcttataagccaacttataagctgaaaagtctaaacctaaacaaacaagcagatttttcgtttggcttttttgaagccataagccattctaacactattaagccaaaagttaggttagagaagcttttttttttacttatatgagatagatgtatgactctaacactagacttaggttattaaatccactggcttataaattattatgccaatatgctgacttaaaagtgtaagccaataagcataagcctaaacaaagaaggcgtaagcccgaagtactgtgcactgtgacttacgtatagcttctgggatatttaagagaaaagaaattctccctccgtcctatttttagtacagtcgtgggtttctgtaccaaacgtttaaccgtctgtcttatttaaagaaattataaaaaaaatcaaaaacttgattcatgcatgagtaatattcatattttatcatctaataacaatataaatagtaattataaaataatttaaataagacggacaaacattaaacactaaaacccacaactgcaattaaattggaacataggtattattcaggcagttctgacgtcaatgtaccgcaccgctcagtttatgtacactgaacatgcggagaattggctagggcctgtgctgctgctgatgccgcgcgaggttaccgtggccgcacggtcgtggtgacgagcaggaggccggagctgacatggtgagcgcgagcagctgcatcctcaccggtggcgggggcaccaaccgctggtctcactggtagtcgtcgtcatcatcgccgtaagatcgagctcaacggagagagaggataaagggtgtgtttagttcacggtaaaattggaagtttggttgaaattggaacgatgtgatagaaaaattgaaagtttatgtgtgtaggaaagttttgatgtgatggaaaagttggaagtttgaagaaaaagtttggaactaaacaaggccaaagaatagccgtgttcgggaggtgaggttggaactcacctcccgcgcacataaaaaggagtgacatattttattatgattaattagatacttattaatatttttagaaaatagattaatattatttttaacgtaactttcatatagaaaccttttgtaaaaaataacaccatttagttgtttgaaaagcgtgcgccggaagacgagatatgtgagttgggaaaggtggggaagagagaagagtgaaggaggaatattatatagtcgtcactataagtgagctcttacatagtactccagttcctttttcctaaaataagtttattcttacctatttcacacgtattactatgaaatcaaaaaaactataatacctctgttttaccaaacctcaatgtagttattttctattttatctacttgcagagtatttattttctaatttcacaaattccgataaagtgattacttaaaaaaatatatttgagtgtaggtccttcctatttttaattgttttctttatttttgaaactaaaatgccttgtaagtgttccatcacctaaaagaccacgtcaaactgccacaagtgatccaaatcgcactgatattattagttgaggatgagatgctctgtatccgtaaaatgatgtgaatgaaactcaattgaagggatgtgtagtgaatcttatccctttactttatattctattaatcctaaaataagtttagctttcatctatcctacacataccgatacaaattcaaaaagactagaatatccctattttatcaactcccgatataatgatttctcattttcatttacacttgatataattattctctattttcataaactctgatgtgatgattacttaaaaataaacttattcggaatatataggagtaggggtgaaaacggtcacggaaattaccgatcgatcgggcgccgtttccgtttaaggggtaccgtttccgaccataccgtttttggctatttttaaattttgttttttctaatttctctctgcatcgtattaatgtcgatactgagtagtttaaatgataaatatagtcaattaccggctgatcgagcatcgtttctgaagagatgctaccgatttctaccatttccgatcgtttccacccctataggaggagctaaaatgaacttattataggacggagagagaggtaacttgatgttgattttttcaagatttttattgtcctaaccaaaataaatcacgagagtagttttattgtcctgtttggaacaggggaatttaatccccccggcgaggccacggtaaacctcgcccgtcctttagctaactgcactcaattaacctagtagcaaacgatcccattgtaccgcaactgcacgaacaatttaatcctgccatacctagtactgtagtattgtggtctgtgggtatcacacgatacgcctcccatctccgatgaatcccccgttgatgtacctatactcgcttcctgtgtccgtgaggatgaggattgaggtcaaggtgagagcgcagattacacaacgggcaaagactcgcttcctcaatggctccggcctccggctcccaggaagcagccatcagctgtcatatcagtgctacacctgctacagtatactactactcctccagtgggcagagtgacagaggagcagtgggctagggagtagggagacctccactagcaatgcagcaatggccctatttagttctaaagtttttttttttctaaacttctacatttccattacatcaaatcttatacacacaacttttctattatatcgtaccaaacatactaaatgtactgtagagggttcctggtacagttgttgagtcatcgcctcctctcccaaaccaggaaacctccggtgcctccatggtcaaagctccaactttagctttgtttaccctcgcgtcctatactgtccaccgtaccaatcccgagggttgaaaatcacaccggcctctgtccctctccttgcctaacttcattctccatccttatcatcgtcgtctacgtggttcttccttcttcattctactccaatctctacccaacagggtgtcccgagcaatccatgtttttcatggcattttacgcctttacctgtgcaaaattgtgctagcaatcgacgtcagctgccttgcaatcacaatttgatcgtcaattcgtcattgtggggacaaaagctctgtcctattgtactttccctgcttatcctattctcaagactatcaaggtattcaaggtctcaaggaggcagcttggaggcatttgggccttgagacacgggtaggtagaactcagcatgcatgcgcatgcctttgaaattccaagggggatcactttagtttaagcctttgctgagaacgatatttggtaggagtatctggtagagtactatagtttcagactttcagtccacttcaagacaccatgcagaattagctaccggtgagaagcaactattctaatcgaagtcagcagtgatccaccaactaattgagtttagtcactcgatgctcacctggaattcacctaaattcttgcccggttcattggttgttgccatgtttcgtgtgtggtgtccacagattaacgagcagtcaacctggcgacacggtactcacaaatcacaatctgtagcattcgctcactactcatcactgacttaatatattactcgtcactgacgacgttactgtaataaaattatactagcatgcttacataatatttaagatataataattattaatggatgataatgtgatatttttacatactaagctttagaatttatactacggagtatgttgtaacttattaaagtaaagtaggataaacatatgaaaaaaaaaaccactttctgcagaaggggacagcaatacagcacgagtgcgcgatacaggaaaaaaaacagcctattcagattcaacactccaactaaaacagtgggtccgattagtcaaatcaattatgcgaggcaaatgaactatctggagctcaaagattttacggttattcccattcgtagcccggggcactaggcattttcacgaattaaatatgaaaacatattgtccattcaattttttttaaaaaaatattcgggatgcaaaatcttttgcacaaatatactatcggtctcacacaaccattgcatgaaaataacgtgaaaatgacgtcgtgacttgtatcacacagtgaaagtcgctcaagcaaacagcgataccgcaagcaatcaacgctatcgctcaagcaaatagcgataccgtgccttgccgatttaattagcggttaattatcctagttagcgattaatcactaatcagaataattaatcactaattattattagttaattgttaattaagtaattaattactaatcaaatggatctcattggtcagtgtcgctgattgcttctgcgagaccgaccgaatggtctcgctcttccattccgcgagatcgtgcgcgagaccgtgcggtctcgcgctttcgccacgcgataccgcccgcaacgtcatcgtcatatcattttcgcgtaacagaagtgcgacaccgatggtatatttctgcacaagtttttgcatcccgaatatttttgagaaaaaattgagtgaacagtataattttaaatttaattcctagtcactgcatgttcatgagttcatcccatgacattaggcaacatatatatatatatgctcacgacaaaatcgatccgttaataccttccatgggatgtccgtttatatacatcgtcgaaatgcctggaaagtcctataagatatcactaaacttagcacttcgactcataatatattattccctccagtcataaatattttatgttattgcaatatctatacaacttcaaaagactggtgacagtaaatctaacatcccatcctccattgtgcggctttacagttttttcaaattggtcatactattctctaatatttagagaatgtctcactatttgattcaaacaagttaaatgaatatcatataattaaataaacaaacacgtgattaaacattttacaaaaactaaatattttttgggcatttagctattcaatctgtctcaaatataacatgtagattttaaatttggtcctaaatataccaagctagtactcataaaaggtgagttttaccactataaactacccatattcatccactactccttccgcctataatataagggattttgacattttgcttgcactgtttgaccactcatcttatttaaaaaaatttgaaattattatttattttatttgtgacctactttattatccaaagtattttaagcacaacttttggattttatatttgcacaatttttttaaataagataagtggtcaaacagtgcaaacaaaatatcaaacttccttgtattatgggccagagggagtatcatttagctttattatagccccagctagtccaagcatgcacctcatacactccgagggaataaccaagttttttttacctctctccttaataattgtgtcaaaggctaaaacttactatattttagaatggagggagtagtatttagtaaaaaaaattattatcggtctcatctcccaagtggatacccccaagcttctacggtccgcttattgaggaatagatataggatggatgttcaataaggacaggtcatcgcaaagaaaaactaatactgcctccctcccaaaataattgtaattctaggttatttagcctccctcataaggtttgaaaagaaagactatgatgtccctcattaaatggtgtataagtaagagtggaagagtggttgagggtagaatagaaagaaatttgaatgagaagtaattgatgggacaactagtactctattgtgataactattttgggataaatttgaattgtagaaatacaattattatggtagaaagagataagtgagcctacgagtctacgactaccaattccatcggacttatcaaatactcggtttaaaaagaattatgtgcatatatttgcctcaaaaagtagcataatagcaaaatttactagatttcataaacttattattgaaaaatataatagtatgttttatataatgtcacaactatattaaaaaaatatgtgaaattaaatgggaaatggttatgattggttgagacgagagaataagtgaagaaattgaacatgcgatgattgcgattgcttgaaaggatgaagtagatgtaaaaattgatatataaaaattggcgaccctaaattcaaaagtttactgaaggagtaataattacgaatttaaatatacaagttattgacttttggtcatgatgttactattcatctttttttaaaaaaatgagtacaagttatttattttgttgtggtttgttttatagttaaaggtacttcatgcctgaactattttttcccatattaatgaaaaacattatatccaaaatttaagtcacttggcaaccatcaggccatggcgccaagcacgccatcctatatcctaccacctccattttggtttcaagaaaaccaccttcattttgaaacataaatatttcttgactattactttttgatcttaaaatgaacaaatatattactgtttacgacagactaaacctattcggttgtatagcaaaagaattttcataggtgtattttgggatgaaggtatagctagctgtgagcaactgactgaacatttatcaaatggaattgtacataagttgaaaaaaaaaaagaatggtagagccacatttctcctgcacgactgcctggcccatgccctctctgctataatctgcaccctgtcttccatttcctcatcaaaaaaacacaacaaaacagaacagaagcagaccaggtagcagacaaagccaagagtttctcacactcctcccatcgcttctcttctcttctcttctctcctctcctgtctgctcagtttggtgggttctgctcaccagtctccccccgcagtacaaaacctccattcctcgccgcctcctcttccactcggaaacgggtagtagaaaagaacacaccgcggtcacacacactctcttcagcaacaaacgatgaggaccatcatggcgaggagccctcacgagtcatccttctccttctccaggaggcacttcaagtggccagttcttggcaagagcagcagccatggcgccagcaatgcaggggaggacgacttcatcaaggcagaggacgacgaggaggccaccatggccttctcctccacctgcccgtcgttccactccgaggacttcgtgtcccctccgccctgcaagccgctcaagcagcagcagcagcagcagccgcagcagcagcgcaggaagggacgcacggccgtgtcccgcctgcgcacggcgctggccgcggccctcgccggccggcaccgccaggtcgggctcggcgcccggctcaccggcacgctctacgggcaccgccgcggccacgtccacctcgcgttccaggtggacccgcgcgcgtgccccgcgctgctcctggagctggccgcgcccacggcgtcgctggtgcgcgagatggcctcgggcctcgtgcgcatcgcgctcgagtgcgagcgcgccaagggcggcggcgcctgcgcgttccccaccgccgccgcggccccctcctcctcctcctcctcctcctcctcctccagcgccggcggcaggaagctggtggaggagacggtgtggcgcgcgtactgcaacggcaggagctgcgggtacgcggtgcggcgcgagtgcggcgccgcggactggcgcgtgctgcgcgcgctggagcccgtgtccatgggcgcgggtgtcataccggcggcgtgcggcggcggggagggcgacgtcatgtacatgcgcgcgcggttcgagcgcgtcgttggctcccgcgactccgaggcgttctacatgatgaacccggactgcggcggcagcggcagcaacaacaatggcggcccggagctcagcgtctacctccttagagtttgatcactcgagcgtctcccattctcacgttttcttgtatcgtgtcagttcttgcatgctttgttgtttcctgttgtaggctagtagtactttagtaggtagtgtgacggtatgagtggttctggaataatatgcatatggaaactgggattgaaatggaattattttttctttcttttatgtttttttgggcactttgtttggtgcctaggagttattggactgaggtgttcgatcatgtgagtttagtgtcactgacgtatgggtctatagcaaagaggattcacatatcagtaactgaaagtcgtataatttaagtcgaacgagcttaatctaaagatatcactcctatatacagagaaagtatggtaagttctttagtaaacagtactcaagaaggtctaggacgtcattttctaatccagtgatgggtgatctcaattggtattgtactagcgaaagatgattaagatcttttaacttaagttatgtgattttgagttactaacatataagttatgtgattttgagttactaacatataggttctttttgctacaaacctagagtcagtgaacctagagtcaggtgacttagaggcagatggtccttctcctccaggctccagtgaaagaagggagatccagatatcaggaaggagcagggatgaccggtgaacagtgttgtattatccagaaagattatgtgatagtaatgattattatcgaactgcatcaattgtctttgttctcatgcatttgtctctgccataatgtgggaccgacagaatgccggactgccggagtacatctgttttccgaagttgtttttctaatcactttatttatttattatgtaaatcactttatttattcgtaagcttaattttcctgtattttactgtcaaaattgggggtataaatatgaaacccgtggagtgttaaaacaagatagagcaaggaaagactagattcataaagaaacacttagctatatgttccattttaaatgagtgcaccaaacagctcaattacacccagtcaatgaaaaattatgtttatgaatctgaatatgggtctgtctatataggtatatacctagtaaatattgagagctactatacatacgatatgtcacatacgaagctagtacgatgttgtccagctgtttcctagcgatgcaacaagtaaggttcaccatccgttagtaatcgtacgagaatcgtacataacaatcgtaatcgtacgagaatcgtgcataacaatcgtatgcacagctagcattttcacaacttaagtttgtttaatttgtgttttgttgagttgtgatcagtgaccgcttgagattgcggcgcaggtagctagccaatggccgcgaatgcccaatgctaatgtacaagttaatgaatagaacttttataataaaatcatagtacatattattttttttctattttgttgatttttaacatgacatttaataattcatgttattacaaatttagtgcaaatatgaaggaatataggtcatgttcaaaatatctttaataattaataaaaacacatcacaataaaacaaatggttattagtatttattgtatttttaaataatatgagtggttaagtgtcatgtgtaaaagttaacaatgttatatatttaaaaatatattgtaatcatctaagtttggtatcttctttattttgtgatagtagctagtcaaattggtccacattgtttagtggtatgttttgatcataatactcagggttaagaggaagcaccggtaacgatggactcatgcagtcatgcttacactggtggagaaatgctttttagtcccggttcgtaacccccctgtagtcccggtttttcaaccgggactacgaatccgggactaaagatcgctatctttagtcccggttcaaataaccgggactaaaaatcaatctttagtcccgg

SEQ ID NO: 79703 - DNA, 9448 bp, Oryza sativa
cgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaatccaatataaatttcaaattatatgcgattcaaaattacaccatctcttataaaagttatgatgtaagtttcatgaaaatattacaagaaaatatactgtaattttgagtgagacaattgaatgagagataagaaaaaaaaatcttttaagtgagatatagaaaaatcgttttggatatgcatcattctttaaaaaccggtttcactgtaatatcatttttaaacgcgagcattcgctataatattgttttctttttttattgcatttgcaaacatttttgtccaaagcatatgcaatctctctctgaccacgtactcatgatcgagaccgagccgagcgagaggagagaaaggcgagggaagggacgaccacattagtatcgtcactcactagacacgttgccaccttcccccactatccacgaaagatgtggtgaaaggaggcaggagatattgctcgagtaggttgctgcttcttgctgctcctacctctcttgtctcatggcgtggcatgccactgggcttctccctctcgccaaagaaacagacgttgtggtcgtctcccaacaaaaccttctccatctctttcacgatgactctaatggcaccacagatgacgagggagggggcgcagtcaagtaagacggcggagcaggttgtgggcaacgccgacgaggttggggagggagaagtggcagggatggtaagggaaggtggctagggctataagtgggtcagccgcgaacccacttataggtcaaaataagcggtttcgcgacttattttagcctataagtgggtttcgcgggttagccacttatacccctaaaggtggcagcgcagaagacaaatgaggtagcgcgactcagttggggaaggaagtgacgcgctcggttgggtaatgcggcggagttggtgtaatcaccccttcattcagccttctatcctagtattgctcagctcggtctcgatcgtgggtgcatggtagggctgtcaacgagccgagctcgagcgagctcgtctgcccaagctcgagctcgacacaagctcgagccgagccattgcaccttcgagcttttaggcaagctcggttcgagctcgagctcggtgccgagctcggccataagtagtataatatatattttaataataatctcttgataagtataattattttctagttaatcacactaataaaagagtagaaaatgattaaaataaatatattgtgctaacacatgctaatttattgtgtaaatagatacaaatatatatatttatctattagtttattatattaataaggtgaacatgcaatataaactatacacagccaagcttggtcaggctcggacgctcggtagaagctcgagctcggctcggttaagctcgcgagcttttgctcagactcgagttcagctcgtttggagctcgagccgagctcgaatcaagcctaggacgagtcaagctcgagctgctcgtgagtctcgagcttttttgacagccctagtgcgtggtccaaagagagagattgcatatgtggtttggttcaacaacagtaaggggcaaaaacgtccgatgaaaaaatatttgaatgaaaaatattttgtaagtaaaaaaaacaacgaaaatagcattgtgtcgaatgcttacaattaagactgacatctaagcgaatcacacgcaaaattcttaggcactaatgtgggaacgcgaagtaactaactggttaatttagtacataggagtatttaggatggattactattaaatccccaaaaccccgcaccaccgcgtctcaaaaaaaaaaaaaacgcaccaccggcgcggtcggcctcgccgatagaaaggccgcgcgcggaaggccaaatgtggaagaagatcgcggccggcgcggcggagggggagacatggaaggcgctcgcgaccggcgcggcgaaggggtggcacggtctgctgccgaagacggcgtccgccaccaccaagctcgtgcccgattcttctccaaagtcggcgacgccgaccgcggcgctcaacctcgtcgccgacgcggtggcggcgtggcgccgctggcttcgctctccatcagcgagtcccaccgcgaggtgtgtataccctcctcatcagctgccgtggagggcaccgccggagaaacaagcccccccgtctccgacgcagcgttggaggtgtggcgtcgttggctacgcgcgtcgacgcggcgctcgctctcctcgttcatggatcaagcttcgtcggagactcacgcgcccccaccaactccacggccgtctccaccacgtgttctcccgcctcctccattgtctgctgcacggagggcgaaggggtgtcgcactgctgcttcgtcggcatctctgtcacgcaactactcgacgtcgtcgacgaactcgcagtcccctccggagccccgcgacaggttaactcttcagaacttatataaatgatgcttcctctagcgatattttctctcatgtcctttttaatttgtactctccaaattgccccacatggttcatggcccatgtccaaatctgtggtgcaaagtcagacgggatagactaggcacccattatatgatctgatccgcaagcttccctccattgatgccctcccggagctgaacgaaggaggaaggaggaaggacgatgccgttggtgttggtgttcagagtatctctgactaaatcgcttatctctgaacaagggaaggaggaaggacgagtattgtggatttcctttgggttgggaatgggttgaatccatttttctgcacttggtttgggtttgctctgtgagtggattggattggtttggtttctgcaagctatgaattggattggaatggtttagaagtgtactgtagagacaagtggtctggggcggttctggtctggatctcagtccattagcaggcttattatcatgggtattcagttgaatgcaattatttttctgcttgatgaatcagtggtggacgcaggaaacaactgttgagtcaacagcccaggattttgttcaacattaaattccaatagagacagctagtgttaaaagagttttttctccaatatgtcctaacttaattattggtttgcagctgcagagacgacagatcattggacatatggtatactgctaaagaatttgtcaagaagtatccagttgtactctttgctcagcctacagatacacactctcagttccacagatgggtataccaggagtggttcaaacccacggtaagaagcttgcttaagtgtgtcagtgatcaccatgcttccaatttggagtttcaggagattactacggagaatgtcaagatattttgcaatgctgatgctcctcaatttattccccgaatcaaaatctactgtgagaccagaaaagcgacttatgaagggagaaagcagaattttgtgcagacaggggaactgataacagagttgataaaatcttctgtggacaatccaactgaggttttggacctgctctctgaggacataaaagataagctcagtatgttgaaaaatcctgacctgtctcatgatgctgatccacggcagtgtggagtttatatccttgtgaatcatccgtccatgctacgaagggagatgcaatctccgttttaccttgcctgttatgatttgctaatgagtgtggataaaagaattgcaaacagggcattcaggaaactgccttataagaactggcagtcaagagccctgcaacaccccctgctcaaagatcatctcatcaatagacggtctagctatggcagagacaagtatcaccaagcaagatatcatcggaatgtggcaagtcacaaaacatcatggaaatccaagtacaaagctgaagaggtcgacgagattatccaccaccactttccgatgattttaacacgtctgatgaaggtcctgtcaaagatgaagttgctgatacgccttaccctccacaacttctttggataaagaatgctgtagtgaatctactgcagtagcaaagctcaacttcttcatgtaggaaaggccatagtgatgcaactttttaacaaagctgaatctgcagataccccatgacttcttcggctaaggaaggccactgtcaagctattgctgtaacaaatctgaatctcttataccagaactggtgttgtctgccgcaccctcacaacttcttggagtggggccgaaacaaatgcaaaagcacttcatgcttattacgagtaggttttgtctcattaactttttgttctttaggccccagttatatccaattgtctgaatccctatgcaggttaatttcctgggttcatgtaacaatgcaaacccatgattttgcttcatatcaacatagctaaacatgatatttttctgtcgacatttcttctgatatgccagaaatatatatttttcttttgacttgatacaattaattttccctaggcatgtttgcaaagccttcctgtccgtgtccaagaaagactcgcattttatctaaccactgtacttacacaacggaggtctgcacctgaggtgcattaatcgctagaattactgaatgaactacggtatacagcataagacctttgttacattgtaagatctgatagcgtgacaaatgtttgtgtaaccttataatacagctaaatctttcatttaggctgatgactatgtggaacgcgtcgaatcttcaggtaccaaacttgactgcgcctggagatgagccctcaaaaacaattggtaggtacccagtagctgcgagaatggattctaatccctcgggtttaagttaatctggaaaacacaacatgatagtatctgtgttagagtgacatgccatgaacgtacaaacattacaaggaatcgcaactaacctggcaaaccgaatcacaactaacccggcaaatcattgcaagaagtttgttagcttctccacaagcaggtgtcatttggcccattacccagcaaggtgctccaacaatgcgattctcaacctgcatagttgtcaccaatggatgactcactttaatagtagaagattaagttatggacataagacataacacagtatgaagctacatccattcatttgttaatagtttacctattgacagagtaagggggtcacagagtatagcaatatatcttggagcagtatttaaaactacaggcaagaaaagaacatgaattgatgtcaactagcatgcccagttaagttaaatatgtaacagcgaggtagctgctgcagaacttgaaatctattatattattaaaggaatagaaaaaggagcctccacgttcgctctcaaggcctataaattctcacattaatcggagaaaaagaaaaaacagtgtccatatagaaatacaatttagaaatagctgaaattcagaattaaaaaataaggaatattagaaaaggagactagagtccatatagaaatacaatttagaaatagttgaaattcggaattaaaaaataaggaatattagaagaggagactagagtccatatagaaatacaattaggaaagaactaaaattcggaattaaaaataaggaatattagaagtagagcatagagtccatatagaaatacaattagaaaataatagaaattcagaattaaaaataagaaatattagaagtagagtatagagtcatatagaaatataattaagaaaaaaaatagaaattcagaattaaaaaataaggaatattagaagaggtgactagagtccatatagaaatacaattaggaaataactgaaatttggaattaaaaattaaaaataaggaatattagaagtagagtatagagttcgtataggaatttaaaactaactaaaattcggaataaaaaggagcctccacgttcgctctcatgacctaaaagttctcccattaatcggagaaaaagaaaaaatagagtccatatagaaatacaatttagaaatagctaaaattcggaattaaaaaataaggaatattagaagaggagactagagtccatatagaaatacaatttagaaatagttgaaaatcggaattaaaaaataaggaatattagaagaggagactagagtacatatagaaatacaattaggaaagaactgaaaatcggaattaaaaataaggaatattagaagtagagtatagagttcatatagaaatacaataatagaaattcggaattaaaaataaggaatattaaaagtatagtatatagtccacatagaaatacaattaataaaaaaaaagaaatttggaattaaaaaatattataagtagagtataaagtgcatataggaatttaaaactaactaaaatccgaaataaacataataaaatcaaaagtagagtttagagtccgtataaaaatacaatttacaaacaactaaaattcgaaattaagaaaaacatgggaagaagagtttaaagtcaatataggaattcaatttagaagtaactaaaatttgaaattaaaaattaaagaatattgaaagatgagtttagaatccacatagaaatacaattagaaataataaacattcagaattaaaaaaagaaatattaaaagacgagtctagagtccatataggaatatatataatttacaaataactaaattttgatattaaaaataattaataactaacacgtatataaaatacaatatgaatattacacattagtagtttcgtaaagttattgcaaaatttaaaattatgttatcattgtaatatattttaataatataatgagaaaacatatatgctattatatgagagaaaatataatgatgctagccgcgcaatttgcgcaggccaccatactagtttacctaaaagaaacaaaattagtgatataacatagatttttaagtcaatcattcgcagcagcaatagcagatacactggcaacctccactgatgcagtgccgaagaggctgatcaattaacacgtggaaggaaattgtgtgaaagactttgttcttgtttgtgattatcaaacaatcaattgcccaaatgtttgtgattaacatggtggcatgtctggctacaaagaaatgccaagattttcagacatcaacaaccgaacacacatcgagcagcccaacagattaatgaagacattcaagaatatgaattcgtgttccagcctccctgatgtagtctgcttttctgcttttttctctttctccacttctgtctaccatctatctccctcccccattttcgctttcttctcgcttgctgaaggcggctcttttacgtctgtactaatacgctgctaatcgatttgtagaccctttctccctctctaatatattgggcaatactcttgccgctttcaccttaaaaaaaagcccaaatgagccgtgaagcatccaactaaatataggttatattttttgttatcaatgagctatgaaagagtgataaatacagaagccgtaagaaatcataacattgcaataaaaggaaaatgaggtttggtcataaacaacatacagttttgtaactacgacgctgctccaacttcaacatatgctaattgcctcgcctatatatgctactccctccgtttcacaatataagtcgttctagcatcaatatgaatgtgggaaaacatcaatatgaatatggaaaatgctagaatgacttacattgtaaaacggaggaagtaccatagcttctgcttgatattaagagctaaattgcatatgccaaaataaactattactttatttcccgagaacgccgtcgccggggatggccagccgcttccatttgctcttaagatccaatgttttgacgcgccggtgcctgttaagggaggcattatagacattatatttttcttggtggctgactgggctgaaaatgagaggctatctttaatgggccgggtccacttcgttcacaaaggcgctgggcctaaaacgcgtgcagcccaagaaaacggcccactaccctcaccatctccccccaaccctcgaccgatgtggtgaagtcccaaatttctccgaacattccccacctcaccgcccaaaacccgcgcccattccaaaaccctccgccgccgccgccgccgccgcggccgccggcgaggcctccatggccaccaccacccccgccgcccgcaaaatagccggcaccgaggtccccatcccgggctcggacagggtgcggtggatcgagctcaccgtcccctccaccccgtccccctcaccggagggcgattccgatcccttcgtcctagtgcccccgcgcgccgcctcggggttccacgtcgtctcctccggcgactcgcagtgctatctcgcctggtacgccggtgtcgcctccccctcactgactcgagctccgttggcgttgggttttctcaggaattaatgctgtgttagagctagtggtagggctgagatagctggagtactatggagttttgtgcagtggagttgattttggtcttattcatctggtactttgtgggaatacactgcacactctgtattgcggtggttaactggttgctgtgatgctccgaggaacactaagtctgtgatagcttcagctaagcagtcagttagttgatttgtgcaaattcaatcctgtattatcctgcattgtaccgtcgcactgtagttgagggtaagctctagtgcatttcatcgaaaatatacatgacaccacagggcagtgagccagtgacatactggcatggtgacaaattataactggtacaaccatgatattcaggaatgttatcatctgacagaaacttatgtgctgttatcatctgacagaaagttatgtgctaatagttcagtagagttccttaacgattcaatttttagggacattttgacaaaagaaagtcctatactgtcatggttgatgagacctagacactaaatttctagggacatctgttaaactccttgcaagtacatgagttcatacatttcctacactgttgtctccaccgatgaaaaatgttgaacaaaataccttgtcagatgaccttctat

SEQ ID NO: 79704 - DNA, 5519 bp, Oryza sativa
caaattgaaacagcaaatctctacgcggcagccgccgccggcagcacggctgtgcacctcctgggagcgggcgccggcgcacgcctcggccgctcgcgcacggcgcgcccgcagccgccgccgcctcgcgcacggcacgctcgcgtccgccgacgccgcctcgcgcgtgcgcccatggccgccgcctccgcgccgcgcgcgcgcactcgtcgccgccaccgcgtcgcacgccctcgccgccgccgcctcgtgcgcgcccacggccgccacctccgcgccgcgccgccctcgccgcccttgccgcagccgccggcgcccccggcctgcaaagtgacgcacggggtgggagactcactcaactggtcaaccatatccattccctcaagggtacaaaggtaatatcacaattcctaaaaccttttttttatttcctttagtatttctttaacgcacaacatgggacccaccaaacggttgtcacaagtgagggtagacggctgcttcagatttcaaaacgtgagggtaaaactgcaaaccctaaaaaaatagggtgaaggaattctccctcttaaagctaagaagacaaagtgtttaatcttaagaggcactttactttgccacacatcctgcatttctgcatcaataacccctccaaaacttaacaatctactagtagtagcatgcctgtgacatttacatagaagcatacatgacagatgaatgatatcaagaaacatatatatgacttaccattgcctctaaattataaattatatattcaagaaaataaatgtaggcaaaatatataaatagtagatttattatttgattaataaaaaacatccttaaaatgtcttatcatttccgtggtacgaacacatctctatatgctacaacacgccacacactgagcctagcattgcttcggttctccttaaaggcactaagcaaacataatattagggcatccaagaagtgctcgcaaaaagtaggtcacaagatcgttaactcttatctcgcatggaggcttagaatatagagaaaatcccttgtatacccctggaaattaagctaatcccttctatacccctgaatttcacttacttccttgtatacacctaaaatttgattttgatcccttctatacccctcccgtcagttgaccgttagttgaccgtctaatttctataaaaatgaccattttacccttcggatgaatatataaatttatgaattacattattaaaaatataaaagtttcccgcatgagactattaatagttatgagtttgttgtgcgatgtattatttatccccaaaattatttttatataatgaaataaaaaatatgtatttatttttaaaaaaaatcataaaaaatgaggagcattcatacaaatataggaccaatgttcacaataatggttttatgaatgctcccgataaaaaaaatccattgtcctattaaaatttcaaataaaaacttcaatttattacttttgttttattttcaaaatttatgtcaaaattttctgcactaattatttagtctcattagtttcataaaatgcacatactgcgcactcaaacaaaatttttaattgtttttgaaggttatattcaaacctaaagcatcaagggaaaaaaggtcatttgtaactaaacgtaatagtgaaatgatggaaaatgtaacggtaggggcatggaagggatcaagttgaaatttcaagggtatagaagggattagctaaagaaagtattgagtgagttttcacacagggaatttactctagaatatacaattcgtttgaaatattcagtgaaaccttagatatttttttctcttcaataacaatttgtttggtcagtgtacctctacgactgcaagttcatatatagattatctctaattcctgcacacggccagaattgaatttctgaaccaatgcatcaccctcaacaaaattgtatcaaagtatttcggtgtattgcatgtgcatagatgtaaaaacacaaacaggtatgtgcatgtgctacacagataattgcataaagtgtccaaacttaactttacacttcacaaataattgccttttttttacagcaaataaacataccataatgtctttcacggctaagaactaaagatatcataaataaatccaaattaaaggtcaccatacatgacagctgcacgtaaacatatggtgtagtccaaatatatcttctagattaatctcaatgaagtcctaagcatatatcttctcccactgacaccacaagtggaatccagtagaaagttagtttcatgctgtcaatgtgaaataaaatgaaaatgttacaattccaacacatcatgaacagtggacgaggaaaacaagggcaaagttcatcagttcaattactcacacctttaaacagaagcaaaaccagatgaaggaaagcatagataaaagcaaatcgattagttaagatagtacagtacctaattacctgatcaagagggcaatttgaaagaggattggacaatgagcaagaagaaccatcgctgtagcagagcccctataggtggtacccatcacatctaacagagcttgtcacggtgaagcagaaggcaacacaacagtagagatttagggcccgtttggtttccagggacttattccaaatccatgtcacatcggatgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattagcgtccaaacatccgatgtgacatgggctaaaaagttttagccccatctaaacacccccttaaacctttgagattcatagttcctccgcttcctgatatcacgtgccttcttgtttctatctttcttttgatctttggccaatgatgcgtaccactccctagcacgcttcctttttagttcagccgcacttagttttgtaacatcttcaagagtgcctgcacacaaaaactgtgcttaatacaaaaggcttaaaaagaaacgaaatatataatatggtgctacgcccaacctatagagtccaagttgttgtgttgacaattctcatgatcttttggcatattagttccatttttattaatagcgggatggttgttcgtcaaattagcatcaattacattagttatatcagcaaaaggacctgagagaggagtgattgtaaaattagcaagcaataatatatcaattgaccgatgaatataacattagctggatggatgaaactgtcagaacaaacaatcttaacttggaaattggaagaaaatctgaggattatgcacccagtgtattttggtcagattgtaagtttaacggtagaatgatcgtaagttttgctagagtagcaggctaagttagtgccagatggaatgcaaaaggcaaatttgagatttttttctaccaaaaatgtaaatccgcaacagttaatctacaaattcatgtgacttagactctcagtcttgtagtgtgcccgatttccttagtgatcaaagtaggaaatcgcattctttcatactacaaatatgtacatacaacacctgagcaatccaaattttgaatcctcaaacagaataagatactttaaaactgtccaggaatctttaaattcaacacaaaggtctgatcatccccaatttcgtactatattaaaagggctgtgagcatatgatacttacacgcaaggatcctgtattgcttaattagatcagttgtcaacctgcgtccgcctcaatagttggaatattctgaaatatacaggtattaaataatgtatgcgagcaaatcgaccattataaacaattatcaactgaatgtaataactgcatttgaaataagtagaatatttatcaaagttcattttaagattacttatgcaactgttctttacagtctacgaatagaatatcccacaaatggaacggtttcattaaattaaaattgcaaggaccatcagattcaattggtaaaaatatatagaccgttggatcacaggagaatcatgaatgacagcgaaatccattagatcaatcatgaagcttccagacaaaatgccctttggcagagaactcatatgttcctagacaaaatagcctactcaaataaaatacatattttttcataaacataatactactacacaatatataaatatagatggagagtaccagcagctcgtctcagtgacccgcaacgatagaactccatccctcgtagtgccaattttattactcccttcatctcaaaatataaataactttaatatataaaatttagcgtactttacatattccttcatctcaaccaactacaaccattttctatttaagaactccatccatcgtagtgccaattttattactcccttcatctcaaaatataaatacctttaatatataaaatttagcgtactttacatattccttcatctcaaccaactactaccattttctatttaatttcttcatatgcttctttatctcaatcaatcataaccttaacattttctatcaaaaacaaaaataaaacacaaccctgccatttaactttattgccctctccttaatccctttaaaataacataaaggtagctactctctatctacaaatataagcattgcaaatgtttagaatttattaaaaaaatataaggatttatagaataacttaccttcaatctcacctcccattcaaatttctttttatctgactctaaactattttctcaactcctatcattcctcggtaaagggatacaaagttttatatgatcgaacataatctttgttaaacaatatggaaatcattatatatgagaatagagagaataatctcacaaaaattatcccataattatcaagatcggtctatttgagaacatagaggtaattttgctttggtaaaaatttaatcagtatctacctaaatgaaatgaaaccaaattagcgagagagttttaaaaataaaataccgctggccttctacatgcaataataagggccacagcaaaacaaacttcgttcagtttggatgttttcattagtaaattcacaactcggacactactgcaaacttactatttctttaatttacttagtgaaaaaaagtggaaatggaaaaacataaatgatgcctatatgattttttgttgattctctcggatgaggacatacgttttgatcaatccactcatccagcaacaaaaacacaacaagaagaagaagaagcagggaaagtatagataaaagacctagctaccacaagctaccacataaaacataaaagagatcagagaagaggaaggtgggagcgacataaaagatc

SEQ ID NO: 79705 - DNA, 4538 bp, Oryza sativa
cggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactgtcacaccctgaaaattttttaaaatttataaattgttgtttaaatggaatttctagaaataattttaaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacctctcttctctctcctcggcccaagccggcccagtccgccgcccgcgcgcgcgccctcgctcgctgacaggtggggcccacctgttagtcgtcgtctaccttcggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggtgtctcctctacccgtcgccacccttgccttcgcttctagtcgtcggaatcgctctagcgccgtgtgccctagcttcgccgtcgccgccgccgctccagccgtgcgccgccgtcgtttcagccgtcgccgtcgctcgggaaaaccaccgtcgtgctcgccaagtcgtcgccgtcctcgtccgccccttcgccgtcgccggagatcaccggagcagcttcgccgtcgtcgacccgaaggttcccgccgcttcctcctcgtcgccgtcgccgtctgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgccgccgctgtcggtgacgtcaccgctgacgtcatcggggtcgtccgccgtgagccgccgtggacccgatcgatctcggccgtccgttttggatggatcgatctcggccgtccgttcgcgtgaaccgtcgcccgtgcgcccggtccaccaaaccctagcccgctgacgcaataattctcttttccttttcaaaaataattcattattgcgtcataattcaattttaaccgatataagtgttttaatccgatttaatctttaaaaattcataactaattcatcttagctccgatttagttggttcaagtctctaaattcttctaaaattgagatttacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtatttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacgactttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattattacttaactgttttattaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacattaactaatcacgattgtccatcgtgaactatcattaagccatcattaaataatagtgagtcataagttatcccaatagtgagctaatgtttctaagcatggctaagcaattatatctaatgtctaattgaacccatataaataaagctcaactagtcaaattataataacccaagggatcaaggaataaagtaatcaagaacaaaaagggctataacaatgaataggttaattccacccaatgacattcgaaaataaatgcaatagttgaaaagaaacaatagctttaaacatgatcaacatgctcaaagggttgtttgggatctgtgtgacttgccttgctggccttggaactcttcaaactcttctccggcaaaaacggactctccggaaacgacggaatctaagcagaaaagagcaaaatcaccaaggcagcacataaacaagcataaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggat

SEQ ID NO: 79706 - DNA, 3806 bp, Oryza sativa
cagttcgccaacttgaattatctagagaggagaattggagaagattgataaggaatcggatgcaaagaatgctatgctatggattactccctccgtacttgtaaagaaagtcatttaggatagcgacacggtctccaaacacaactttgacttcttgtttctataaaaatatttattgaaaagtgatatatgtatatttttatgaaagtatttttcaagacaaatctattcatataatttttatattttcaaactcaacaacttgagagttattcatgatttatatacccaaggtttgacttaaacattgtcctaaacgacttcctttacgagtacggagggagtatttccttacaacacttcactatttatatatttttaatctctactattataaaaattggagatgtttttgccggtactttggtacgtcatccgtgcatgagtcggtttttaagttcgttcgcttttagaaatatagatccgtatttaagtcaggttttaaattcgttcgcttttggaatacagaagtagtcgtataagaaatctctttaaaataaactcgcatgttaacttgacatgattttctagaaaaaatatatatccaagcgagttatcacaatgaatttcaatagcctttaccgattgcaacgtacgggtatttttttctagtattatatataagtgtatccctgtgttgacgcttttttgtggccaacacaacattacctaacaatttgcagtgtaaacaatagagtcgccaaaatcaatagatcaaaatcggctagtggaaccgatttcaagattaattcactttcgcggaatcacacgactaatttataaggaaattagcaaagagggtaaatatcagcaaactagcaaaggataatctcctcgctttcgtggtgaagcacgaccgtttttcagcgcaaaacggcaaatattaactaaattctagggttaccagaactcagctatgaaaacaaaatagaaaataataggaaagtaaataacaagaaaatagtagattgatatttttttttgggggggttcctcaaaactaacctaatacactaatatttataggagcacctgaaccctagccgcaccacttgagcgtacatggaaactccaataaattagctaacagaatccgactccatctaaatattaacaaacaaaaaataaatagttcgcatgcaatctaatgccagtcttccagcctgatcactgtcacccttcggtctatgtggcacgggtcccgtgcggcaacagcagcacagctcggcaaattaatcatcaatcaagcactgatccccgtcgcaaatctctcctaggctgcatgcatgtgacaagtccaaaccaaataaattgctgctgcacccagcattatacacagatcatccaagcagggcatcacaaattcctgcacacatatatgtttcaaaactctcgagcaaacgtctagataaatgtaccaactactctcaataatttggcctgcccaaataaactaattttaagccaaattatggtacaaacacatacccctgttttcagtataagaatcataacttttttttaccgaaaacactataaaaattaaccactaatatgatatttgtcctaaaccaatccacagtcatcttcttagaacgatactttgaacacggtatcagttctgagcccatccatagtcgtcctctcaaaatgatactcaaataggtatccgttttaagcctatccacagtcgttctctcaaaacaatactcaaataagcattcgtattgagacaatcaaacctcctacaaataccttctcaaatattttccatttagtacaaattttactactaattcggtcatcactaatgtccacctaaccgaattaacctatcctccaattctggctatgatactacactatctgtagctattaaccaccaggtactagctcagccacaacgacaagacgtacaagcccctgtctccattgtattcagctagccgaaccatcatactccaatgaggcatgtacactactaccagaacgtacacgtacgcatacacctcattagcaccgaaaccacatgcatgtactgtgtacccctatcagaattcagaactacccggcaccagcactactgcatgtattcaccaaagtgttactactagataaatcggcttgcactaaattgccatgcaaactaacactacaatttgagccgattcattcagtagcagttaacaagaagacttgcgtcaagtaatttgctttgctatcttccttcctcaatatatgacgaacagtaaaggtatcaagcggtttgattaaaactaaacatcgatccatataacaatttagcaatcactggtggagaaacgatttttagttccggttaggaactcctctatagtcccagtttttcaaccgggagtaacaatccgggactaaagatatctttagtcccgggtatatctttagtcccggttcaaatacccgggactaaagatcgatcgggactaaagatgtggtcccggttggagggttttttcttttttttttttcttttctctcttcctttttcactgttcttttgctatttgaccaaatcatctcagatcaaacattcacagcattatctcagatcaaacattcacagcacacagcaatatagttcatccaaatcattcacagcaatagttcatcccaaatcatccacacaatagtttatccccaaatcattcacaacaacaacacagatcaaatcacacattcaactcaatcaacacacagatcgaatcgcacattaaggaaaaaaagaaaaaaaatccaagctccagcttccaccgcctgccgctgcaccagccgccgccaggcgcggccctctgcgcgtgaccgccgcccagccgcctcccctccggatccgccgccgcccggctgccgcggtgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccttctctctctcctcggcccagccgacccagtccgcagccgccggcgcccgcgcgtccgcccgctgacaggtggggcccgcctgtcaggtcgtcgtcttcctccggccgaaacccaagcgccgcgccgccgccgccgctttccaattcggccgatcctttccttctccggccgaatcaatagaggagaaatgatcctcgagatctcctctaccttttctcctttggaaacaccggctaaaatcgtttggaaattcgtggattcgagtttgtttcggattcgattttcccgaactttccttctcgtcgccagccgccgtgggccttcgtcgtcgtctcctagcccctttaaaaggttccccggtgtctcctctacccgccgccaccttcgccttcgcctctcgtcgtcggaaacgccctagcgccgtgtgccctagcgccgccgtcgtcgccgtcgctccagccgtgcgccgccgccgttccagacgtcgcggtcgctcgggaagaccgccgtcgtggtcgccaagtcgtcgccgtcctcgtccgccccttcgctgtcgct

SEQ ID NO: 79707 - DNA, 8154 bp, Oryza sativa
gaatttttccaagattgctaagcccatgacacgactgcttcagaaagatgtgaagtacaagtggtcggaagaatgtgagcagagttttcaagagttgaaaagtcgcttgatatcagctcctattttgattttacctgatccaaagaagggtttccaagtgtattgcgatgcatccaaacttgggttaggttgtcttctaatgcaagatggaaaggtggttgcctatgcatctcgtcagttacgtccgcatgagaagaactaccctactcatgatcttgagttagctgtagtagttcatgcgttgaaaatttggcgtcattatcttttcggtactcgtacagaggtatataccgatcacaagagtttaaagtatatctttactcagccggatctgaacatgagacaacggagatggttggaactaattaaggattatgacataggaattcattatcacccgggaaaggctaatgttgtagcagacgctcttagtagaaaaggctattgcaatgctacggaaggacgacagctgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaaaaatatgagaagaggaaaagctatcggtttcttggaggatgagcacggaactgtatggttgggtgagagaatctgtgtccccgacaacaaagatttaaaagatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtttacccagaacgtcatcaggtcatgactctatttgggtgatagtcgacagacttaccaaagtagctcatttcattccggtaaagacaacctattccggaagtcgcttagcggaattgtacatggcaaggattgtgtgtttgcatggcgtccctaagaaaatagtgtctgatcgaggcagtcagtttacctcaaatttttggaagaaacttcaggaagagatgggttctaagctgaactttagtactgcttatcatccgcagacagacggacaaaccgaaagggtgaatcagattttagaagacatgttgagagcttgtgctttagatttcgatggaagttgggataagaatctaccttatgcagaattttcgtacaacaacagttatcaagctagtcttcagatggctccttacgaagcactgtatggtcggaagtgtcgcactccgcttttgtgggatcaaacgggagaacgtcaggttttcgggacggatatcctaagggaagcagaagaaaaggtaaagatcattcaagaaagattgcgagtggctcaatctcgtcataagagttatgccgacaatcgccgcagagatctaagttttgaaggagattatgtgtatcttcgtgtcacgcctcttagaggagttcatcgtttccacaccaaaggaaaattggcaccgcgttttgtgggaccttataagattgtcagtaaaagaggagaggttgcttatcagttggagttacctcaatctttggcaggagtccataatgtgttccatgtgtcgcaattgaaaaagtgtttaagggtacctaccgaagaagctaatctcgaacagatagaagtccaagaggatctgacctatgttgagaaaccaatccgtattttggaaacagatgagagaagaaccaggaatcgagttatccgcttttgcaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccttctctctctcctcggcccagccggcccagtccgcagccgcccgcgcccgcgcgttcgcccgctgacaggtggggcccgcctgtcaggtcgtcgtcttcctccggccgaaaccctagcaccgcgccgccgccgccgctttccaattcggccgatcctttccttctccggccgaatcaatagaggagaaatgatcctcgagatctcctctaccttttctcctttggaaacaccggctaaaatcgtttggaaattcgtggattcgagtttgtttcggattcgattttcccgaactttccttctcgtcgccggccgccgtgggccttcgtcgtcgtctcctagcccctttaaaaggttccccggtgtctcctctacccgctgccaccttcgccttcgcctctcgtcgtcggaaacgccctagcgccgtgtgccctagcgccgccgtcgtcgccgtcgctccagccgtgcgccgccgccgttccagacgtcgccgtcgctcgggaagaccgccgtcgtggtcgccaagtcgtcgccgtcctcgtccgccccttcgctgtcgctgtagaccgccggagcaccgtcgccgtcgtcaagccgaagagcgtcgccgcttcttcttcgtcgccgtcgccgtccgttcctcttccgccgtcgctttggtcgccggtgagttcgccgtgccgtccgctacccgttggtgccttccgttcgcgccgccgtgccgtcgttcgccggcgagcatgcaagcccgagccgccgagccgccgccgccggtggtgacgtcatcgctgacgtcatcgtggctgtccgccgtgagccggtcgtggaccgatcgatctcgaccgtccgttttggatcgagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgtttatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctgtttaaagctattgtttcttttcaactattgcatttattttcgaatgtcattgggtggaattaacctattcattgttatagccctttttgttcttgattactttattccttgatcccttgggttattataatttgactagttgagctttatttatatgggttcaattagacattagatataattgcttagccatgcttagaaacattagctcactattgggataacttatgactcactattatttaatgatggcttaatgatagttcacgatggacaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcatagtaaaactattcgaatagccgtgcccgcggttatgggcgggtctaacaatgtctttcgtgattagtttcacacttctcaccatagttaatgatgctataactggtaataatttgattagctcctggtttggaatggtatattcctggtttggagatagaactgtgcagccggggtggttgttcagaatggttgggcctatgcaacagggtatgttgtatagcgttgatttaatattgtttaattattacttaactgttttattaaattctcaaaagtttgttaaatgctgcttttgcaaatgaaaccctactatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatctttctttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagccccttgaccctaggttatgccaaacggttacccatagaagccctctaaaaatattggaaaagtagaactgttctcctccctttctcttttaaaccaaactaatggcacatgcacttcataatctcttttaatggttctcattaaaaatttattccagtgttattagtactgtacatctattactgtactaatggctcatttaccagcaaaagttttacaatattgctttatttaatcttgctgcaataaaataaatttagcatgttgattttataactttctttcatttcttttgaaacctgttattcaaaagtacaaaacttgtgacctcgtttccaactgtttcaacttatcttgcaagcttggtttactttgtttacttacctttttactttgattttctaactttattcaaattaatccaaaaacttttgctattaattggataaatgtcttaactccctcctttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcaaagctggaggaagaaactacatccatgcatgtcaggaagtggcaaggatcgccataggagagcttcgcgatcgctacagtgatcaattggccgacactgagtatcgctaccatcctcgtcaaccacagggaagtgaccgtggcagttaccttgagactgaaggaattgagaatgatgctaccacaaggcatttggtggagatgctgtgggctatggatgaaagtcgtgcggagattgtgttagcagctcaagatcgtgaagaccggaatcgtggtaagatttgcaagctagaagacaaagtggatcgtttggagaaggaactagctgtattgaagggagaagcaccaccgcagaaggccaggattcgtctcaccgcaaggaagagagctctatttgtccctcgctatcaattggcgccaaaggttcgtgtggtggagaaagaagttgccccaaccctagcagatcctccggtcatcatcataagtgatgatgaagaagaagaatccaagcgcaaccattccaagattgagtgggtagcaactcaagatgatgaagacgagccgaacgagcctttaatcgacctccgatgctcggaagaactagagtgacttgttaagccgttgtcttagatcgttgtgttagcttgcttgttttaagtttgcttgtgtgtctcgcatgtgatttacatcagtagtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagtttcccccggtttctcttcttgtgccctgtccatgccagatggtgaacactcgcagcaacgggaatggccccagtaacaataacaacggagagaatcccactcttgctcaagttcttgctcaacagacacagctaatgaacatgatgatgcagcaactccagaaccagcaaaaccaaggaaataaccatgcacctccccagaacaagttagcagaatttcttcgtgtgaggccgcctgttttctctagcaccactaatcctgttgaagctggtgattggctgcatgccatagagaagaagttggatttgcttcagtgcactgatcaggagaaggtctcatttgcatcacatcagttgcatggccctgcctctgaatggtgggatcacttccgtctgaacaggactactgctgaacctatcacttggcttgaattcaccgctgctttccggaagacgcatataccatcgggagtggtgtctctcaagaagaaggaattcaggtcgctcactcagggatctcgctctgttacggagtatttgcacgagttcaatcgtcttgctcgttatgctccggaagatgtgcgcaatgatgaagagcgccaggagaagttcttggaaggacttaatgatgagctttcttacccactcatgactggggattatcatgatttccagaagttagtggataaagctattcgccaggaggaaaagtacaatcgtatggagcaaaagaaacgccggattgctcaattcaagacacaacaggggaataatcagaagccgcgtcttactttaggaccccagtctatgccacagggaggttcttcgtctgttgttcgtccgcagcgtcagttcttcaacaacaatgctggcaacaacatccgtaatcaagctccacatcctgttgcagctccagcacagcaacaacctgccaagagggagcaaggcagcaagcccgtggtgtgtttcaactgtggagacccaggacattatgctaacaagtgtccgaagccccgacgcgtgaaagttgtccctgtccagagcaactctactgtaccagcatcaaaggcccgtgttaatcatgttgctgctgcagaagctcaagatgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccattcctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccagataactttggaagagatttctatagtccgggagtatcccgatgtgttcccatatgatt

SEQ ID NO: 79708 - DNA, 11487 bp, Oryza sativa
ttcctgcagcccaacttgagtcttttgcatactttcctgtagccatggtgctacgaaatattgtaagcatctcaccatagtacgcaagagtttgttaaaataatcagcatcagccttgtgatcattcagtgaaacaaaatttttgtttaagtaattgcaataaaaatatgaatggaataaaccactaggtcaagagtcaagacatttacctcaatatagccattgtagtgctcatcatcaagagtaatgatgaaaattttctcatcccaaccagcagcactcactttcctaagcctatttatctttgtaaactttctttgccatgtcttcaaatgattcttaatttgctcacccgtgagagtactgttgaacctttcattcatagccctagcacatgtgttgagatgcactgccttgaagtcagatgaggtccttgtgccaccggccacaagattagcaaggagtttcagcatgaaagatgacatagctgaggtccatgaagcatgggtgcttcctcctttgccactagtgttgtccatgtcctaccttctgtcaaatgaaccagaaattgatcattcagcaatatagtaaacagaaattgtccattaagcagcatattaacccagaaattaaacattcagcaatatgttaacccataaattcaccatttagcaaatactttgaacccagaaattcagtatatagcaatacatcaacccagaaattcaccattcagcaatacatcaacccataaattcagcattcatcaaaccataaattcagcatacaacaataaatttatccgtacaaatgaaatttagcaaatggagtacaacaagctgtccatacaaatgaaatacataaaaatgttcattgaatactaatgaaatatagtaaataaggtagaaatacaagtagcccagctacatattacattccatgatggctattacggtcagcccacatctgattagctaagccctgcctgaattgaaccatcaatgcatggtcattcgcttggccggttgattcatcaatgtcctcacttgaccaatcagacgaagctataagctcatcaattccgtcatttacgacccagttatgaataatacaacaagctacaacaatatctacttgagttcgaaatgggaagaatggagtggcatcatcaagcactttgaagcactttgaacctcctctttagtgacccaaatgcacgttcaaccatcacacggagggatgagtgtctaaggttgaacaactccttctcattttgtaccggattattcccccattcattcaggtggtaccggacagcacgaaaaggaggcaagaatccttgtttggctccatatccagcatcaactagatagtatttgcctattatatgatggacaagttggtcacattcctaaatatcaacatttgtcatggataatttgataaactatagtaatctattaccttgtgggacacggaggccattttcacgttccaaagcatctcttaaaactacagcatgatgtgctgtcccctcccaaccagccaagacataagtaaaccgaagatcaaaatctacggctgccattacattttgagtggcatgggacttcctaccacgaaaagaagactccacgttcttacgaaccgagactctaatatgtgtgccatcaaatagctccaatacaatcctattttgtgttcaacaacattaaaaattagggaccatatatcaatgttcacataaagataaatttagatagggatgaatctcagaccttaaagtaaggatctcttctagggtttcctgctattttagttggagtgtccaatgaggggggcctgattagttcatctcgtacctcaccgattgcatgaaggactttgttgaaataacggctaactgtttctccagacctatgaaaactagtgcgaactaatctatttctaaggttatgtcccactgtatgcaaaaacatagccacttgttcctcaatacacatgtggatggcatcttcaagtaaaccacgatccctaaaaagcttacagaaacgaaagaaacttgcccttctaagtctaaacatgttgatacaagttgtatcgttccaccaaatttttgtttctaggtagtcaattcttttcctatccctttcaaccaatgggccatatctaataccttatctccttgaacatctctttctttttctagacctaataatcatggccatcatcgacaacaataaatttgtagcagcaatacaaactaaaaccttggtcctcttgtccatctacaatacaacaaccaaaaaaacacatggccatcatctactgtcaagaaatttacaacagcgattgatatatgcacagatcttgaacagcagcaattgatttcacacattcttgaacaaaaacatatatgcacatatctgaaaacgaaatcctcatccaaggtttagggtctttttaccgtggtgaatgggaaccccgatgtgcagttggaggctacgaacggccctactcgtgcgccgcgtcgcccttcctcgagagccgccgcgccactgctcgcgcgccggctcgagcgtcgccagctcgaactcctgctagcgccgccgccgcctcgcctctgcgtgtgccgctgccgccttgcccctgctcgctgaccctttgctcgcgcaccgcctcgagctcccgctagcgccgctgccgcctcgcccccgcgcgcgccgtcgccgccttgcccctacgcgctgacgagagaccccgggcgtgccgcgccgcctcgcccctgcatgcgcaccggctggccccagcccacgctcgcgccgccgccacccgtgtgttgctaaccctaggaaggaagcgataagaacgggaagagataagaacgaaggggaaaaaagaggtgaagcgaaactttcggtcttaccgcgcgtgagtcgcgagtcacgggcatggggtgggatcgttttgtccgccagtttatcccagatggggttgtcccgaatattgaaggaatattcccttttggaaccatcctatccctccttgtccttcaactaaacagacctaaaaatgggacgatcccatcccatcccgggatatcctcccaaccaaacacatgcttagtgtcagctctcgtaccggtctcatcatggctcggcacagaagtggtctggtgcggcgccggacttggtaaagtaaacagcgacgtgttgccgcctgagtggagtggagcagccgcgccgtgcgtctgctgggccagtgtctgtgctgtctgccgtgtcgcgttaggctccgatccagaagcgatttctcctgcgccatgcgcttcaaacgccggtgttggtgatgctaggtccacaccttcatctgtacccgaatcatctgaattgctaccagaaaattcattagcagtattaggaaaatcaagaacatgatcactctgttgctcgcccccttgatcatgcgctacaaggtcagatggaagcaaagctatttctgctcttaggcgggcgcctgcatttgattttaattgagaaaatgggaagaccatttcaacaaagatcacgtcctgcgaaacataaactctcccagaaagcaacatcaaggcacttaaaccatttatgaagctggctgtaaccaaggaacacacattgcttggaccgcaattggagtttgtgattgttgtaggggcgcaaatgcagccagcaggcacacccaaaggttctaagagcagaataatcaggtttttgatggaacaggcgttcaaggggtgtttcaaaggaaataaccttgctaggaactcggttaataatatatgcggctgctaaaacggattcatcccaatattttagtggcatagatgcatgagctagaagagatagacctacttctactatatgacggtgtttacgttctactgccctgttctgctggtgagtatgcagacaggatacatgatgagagatgcctatttgccgaaagaaagaatggagtttctcacattctccaccccaatcggtttgcatagtgataattttccggccaaacattctctgaacaagagcttggaattcatggaagacctgaaaaaatctgattttgctttaagaaggtaaacccaggtaaacttactataatcatccacaaaactcacataatatttatgtctaccaacagaaataggagcaggtccgtagacatctgaggaaatgagttccaaaggaaattgagaaacactagtagatctattgtaaggaagttgatgactcttggccatctgacacacatcacacacagactctttactagccttgtcatgacaaggtagattatttgtgctaataactttagacgctataggacttgaaggatgacctagccgactatgccatcttgcaaaagatggcgccacaccgtaaacagcctttggagaggatgcaggagatgaaggaggaagcgggtagagtcccttgtatcgccgtccctcaagcattgttgccctcgtagcctgatccttgaccaaaaaatgttttccatgaagttcaacaaatatagcattatcggaggcaagttttgatgcataaactaaatttttggtggcatgtggaacatgtaaaacatttttgaggataagattgcgcataggggtttgcaatatagagcgaccaatgtgctcgattttcatacctgctccattggcagtgtgcacttgatcgttcgccttgtacttgtcgctaaccgtgagcttgtccagttcaccggtgatgtggtccgtggcgcctgagaccatgtaccgattggagtcgactccatttgtggagctgcatctgaaattgcaagtcacatctgcttcctttgcccctttgcccagcaattctggacgacgatcggcattgacccgcttattcaggatgttcgtcaactcggacgtctgcgccccaatggaaacctgcccgagctgcaccaccatgtcttctatcttctctgcttatgggcactatggaaccacagacacgacgttgttttccgcaacctggatgcttcagttccggcagcaattaggaaatgtgtggacgaatgttctctctggtctgaacgtcttaagcctcctgatagagttgtagtttcaatttggaaagggatcttctcctcccccttgcaatctcttcatgtcatgtaaactcagttgtaacccttactctatttatttaatgcaattcaggtggggaacctctcccctccggtgacttatctaaaaaaaataggcgtaggaggctgctgcagcaaggtgtcgctcatctggcacataagaatcatcatacctatgccagcaatctgctgcaacatgtccccgcttgtagcacaccagacacacgggtcgtgtgtcgttgccggagcgctgctgctgtccagcgccacgtcctccacagccggcgtttgtgccagcaccattgaagccgccgcgaccaccacgtccacggccggcaccaccccggttgctcggagcgttgccacggccgcgcccggctacattggccgtcatgttgccttctcgtcgtagattaagcctgttctcaaagttcaatagctgggcatatgtttctgatagagtaataggtttagttttggccgctaaagccgatacaacagaatcataatcatcatctaaaccatttaagataaaagcagtgagttcttcggcatcgacttgcttccctgacatcgctagttcatctgctaaggccttcatcttggcgaagtactctgagatggtctgggttcccttcctagtgctggtgagagatagcagcacgttgagggagcgcgcgcgagtcgccctggagttgaacatctcctggatcatcttccaggcatctgtcgctgtggtcgccgtggcaacctgggataatatattccgtgacagcgatgaaaagaggaagccgagaacctgttgatccgcggcaaaccactctttcgtacgctgggttgtcgatcatgatcttgatcttcgtcttgtcatcttctttcttttctgcttcgatgtgggcggcgggagtgacggtcttgcctttcagatgccccttgaggcgtgccccacgaatcgcagtcagcacttgtgcgcaccacagctgataattttgcttgctcaacttctcagaaacattgaagcagaacaaggaatttgtggaggtggaagaggaggagctagccatggtagatgggatctaacttcagcgctctgataccatgtgggaaaacaggatggatgggaacgtcgtcctttgcactcgggtcgacgatgcgtgttaacctatcgcacaaaacggcgatggagaagatacaaataggcatgcgctatggatagaacggccggatccttattacatgtgatcacaacaacctaagctaatctatagcttaatccaccggccatcctaatccaaagcacacggattacacagagatatactttaacaaaatcgagttgaagaaaagacagaaaatcaaatataaactcacagaatcgaagacaaatagtatctgatccagccaaggtggaaaatcgctctgcttctttcaagtgaggttgatgctggccgggagcggctgcgttgatccgcgtcacctgcgcccaatccatgccgggatggaggaagagagagcagagcgaggagaggaggacagggacctaccagggagctagccagcccatgcaagctcgatctgcgcggccacggacctggccggtccacgctggcgcgaatccgcaccatggattctaccggcggcaagctcttcgactccaggctccagggtccaacccccgcaagcgagaattttcagaatataacacccaatacgcactgctttcaggatttgtcacctaattcgcactactttcaaaatacaacactagagtgcaaattttctttgttccgtgctattccatcccctaccgtcagtcgcgccgtcgttctccatcctcccgacgtcgccgtcatcagtcagccaccgctcgcgcccgtgttagccgcgccgccgcccgcgtcagcccctccgtcgcccgcgtcagccccaccgccgcccgtcggcgtcgagctccggcgactgagctctataccagctcgaggccgcggtggcggaggttggactggcgacggcggctgagctcggggatgacacgagcgaaccgagccgccgtcgctccggtggtcgagctccggcggctgacctcctccaagccaccgtcgacggcgtcctccgcatccccatcgagtcgccctccgccgtcgcggcggctgcccgcggcgacgagcccaccgcgaagcggcgccgcaagctacagccgacgcgcgcggctgtcggcggcccggtggaggcgctggccacggctcctccccccgcgctacccccatcgtcgccgaccccctcctccaagccaacagtggcggctcgatctcaatatccggcacggcggcaagcaggcgatgtcaccggcgaccgtgtggatggtcccgcccagcagcgcaggcgctggtgtggggaggacaagctcgccggcgtgggggaggacgagctcgccggcggtgagggcaaacggggcgagaggaatgaactgacgacgcgcggttttgggatgacagagtgtcacggaacgaagaaaattcacactctagtggtgtattctgaaagtagtgtgaattgagtgacaaatattgaaagcagtgtgtattgagtgttatattctgaaaattctccccgcaagcagatgatgaggtccctggagaactcgttcgctcgtcggtggaagtgggaaagaaaggggaaaaactaatgaggagagagagggaacaattaagtggaaaataatgcagacaatgtagagaggctgagaaatgggccaacaaagttgcatttgcaattatattatttttatctaaggttactaaaatataataattactattttgagaaaaataataattgagaaaatataaggactaaaatattatagggttaattggatcataccactgcaactttggcaaattaaaatttccagtggcatacagcagatatgacgaatagtagttgcatttttttttcttaatttggcaaagttgtagtggcatggatccaattaacccagtataataagagcatggctaaaatacaaagaaatcctcctcattaaattataaaataaagtttaactaaaataaaaaataattatataaaaatattttaattggtgtgtttttgtccgtgttttcgtccgtcatcgcactaatttttcatctatccgtacgagtgcattcgatttccgatttgcgggaaaggccgctttcatccctcagtgcaccttagaaaaatcactaaatcatcagaatcggatacatggaaacacttcccaaaatcagcgcaacaaaatcggatgcacacaccacaaggaaaaaacaaaattcccacagctaggttgttccaaaatttcaaattcccaattcgaaattgaaattctaactaaaaggagaacttgtgaattcaaatcagactctaatccacccaaatagaatcagaaaagagatccacaggagaactctaatccaatgcatattcgatttggactcgaacagataaaaccaaccccataaatacttccacgggattgctacaaaaatcaatcggatctaacctgattttgcggaggtgactttgacttgcagttgtgagctccaagcgggagtgcacggcttcggcggacggtggaagctcagcgctttagtgaggaggcaaccgggctccgatttggcagggatgtcgaggaagcaggcggcggtgacagcttcaggaggcagagggattatgctcggaagtcggccactagaagccttgaacttagcagccggatcggctgcccactgcctcaccgccgctggcatgcttcccaacgccggatccaccacccaccatgctcgccactaccctcgaacctcccccaccgccccctagcctcgccgtcacccacgcgcctcccaacaccggatccatcgcccaccagcgtcgtcgccgcccgcgcgccttggccgtcttagctgctgcggagccgtcaccgctatggccgccttggccatcgccgccacggccgctgtcgctgtggctgccttggccattattgccgcggccaccgtcgctatggctgagagggagtagggagcaaagagaggaaacgaaggacaggaaaggagatcgatctgtgccagccgccacgaggggggagggattggcaccggcccactgcgcaagggagtcggagaggcgccgacgcaagcagaacatacttaggtgcttcgatgaatcatcgaggtcaaactttataaacctagccattatcttgtgcaacgcacggacattttgctagtttacacagatgacccctgctgcccaagtggagagcggcaaggtgtgcgtattttgcactgatatcccttaccaccctctacaagagctgcatgggggtaaatgtaatttttaccctgccaaaaatgcatttttcttttttttttcaacttgtccgtccctcacgtctctcaacttctgtaaatatttttaccagtacaatatttctgtaaatattaaaaaataaaaaatgaaaaatgaaaaaaattcgtctcgtgcccgtgcccttccgacggcggtggcttccaaagttccaacccgcatccggttcgctgagccatgggccgtgggctgtggcccaactatagcggctgtaagaaagagaatttttttcggttttagattttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagccctcagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcaaattttattgtatcagaaaggggaattgagagaccggctgagaggagtgtaccttctataaaaggatggttaatgaggggcttgagagttgatccacagacaagtgacataacagtcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaaggtgattcgtcagatgataagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattcagatgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggcggattct

SEQ ID NO: 79709 - DNA, 15770 bp, Oryza sativa
cagttaatccttgtatgtccccatggagtatctcgaagtcctcaaaagatctgacaccaaaacaaaattatttgaatggacggggatatgataaagtgtgttattggataaagtacatgttattatgaggggaaaagaaaggatatggaaacttacgactctgcacttccattaacctcatgatatgttggtgctggacgaacaccgatttctttctcagacacagaataccagtcaggaattccgacatctctccctggagccctttgtagttgatatcctagcactatggcatcacgcaaacgtcttgctccgctcaactgtaattgtagagtagtgcaaatactaagtccagaagttgtgaaaaaaaaaactcttgtaactttaaaacttcataggttttcaagttccagagcagtagataaatcctctgttctgaattgggaattagcaactaggtggacagttccataaaaaaaatattcttgagcaaaagaattaataaaaacctccaggggtgaaatgattttaatgagtaacatgacaagaaaaggcagaagtgtttacttatgttcaacttatcactttatatgtgtagtatgaaagcaacaaaagttccatacgacaccaaatacagataactgaagatatcaaagtctcacttttatctgaaagtttcaaggtacaactgaacaataatgtatcaacaatttatgttagtaactcaccttgccagaaatatacttcttgccaacagcagtgtcctggaggatatgtgcagccacctgaacgaataattattagcttatcttgtattataaatgcaatcaagaaagtctgtgaatcacatctggtttgaggaaaacatgatgcaagtatccagttgactcttcatgacttacggaagaattgattcaggatgaacttcaacctatggctagtatggtatttcagttttaaaaatcagccatcataaaaaaaaaataaaatttacaagatggttactagcttgagttcccaaacaaccctcacagacccatatctgagaactgtaaggacattacctcaccaccatttattggaccatcatagcatggatgaagtgtcatagcacgttgcagataaggtttccagtgtccagtaagtaaatccctccgtaccatctcaacgccacattgataatgctgtttattaggaagaaaagaggatatagaacaggacatcaaggttcatgactgatgctctataagtacgaattcttaaaatgaaactatacttcgagatgtttcaacctcaagcatattcctcaaaaacggctcttcattgaaataatctctacgaacaaatacaaatggcagcttgtaagccaaagcctcactcacagtgccatatccaattttccctatgcaacaaccaacagaattgttacatttctagaaaagaaataaggcggtaaatagccctaacacagataatatagcactgtatttaccaagcatgcagtcagatgctgccatcaaatcaggtgtataggcgtcctttgcaagtttaatgaaatttggtggaagctcttgagtttcagatgcaccacatacctttatgaaaatagaatttggtcacaaatgttgtccagacattattaagagagagagaaagaagagagaagaaaacacgtagtttcaaagaaaatataccaaacagagccaaccatcaggcagccattctttcttcagtttccatcctgcaggctgaagaggaaaccatcacaatggcattgcatcagcaatacttgcataagatggtagcaaattcaactatggattgtactgactaccaataacagcagaaagacagaaaccttagctggtctaaaaggacatattgatttaacataaatatagccctttcaaaaaaaaatgatttaacagaaatatgcaactaacatccattaattgaacaaaatcgagcatctataaacgagaaagaacattcaggctatttaatggtttacctgtcctccaaagttgaaaatgaccaccttaacatcatctttaattcctaattccttcctcacctgatatatggagattttttaagtcatcaagaactgagaacatgggttgagtgttcagagcaaacattgtccagcagagttgtacgcacctcagatctagatttatgcaatcttctcaccacaagaggaacatcaatgacatcacggaaagcaggcactgcagaagatagaattaatcacgagtacttcaaaccaacatgcaggatctttggatatattattcattcagacatatagacgtactagggcagtatccagggagtcgtagtaagaattcacaatgtgaataatcttctgctatctgcagttgatgccaacataaatgcatggttattgaacgggctgaattagtctcaacttgcaactaaagaacgatattacagagaacagttttctcaaaaaaaaatcaagaaatttgaatccggtgtctaggtggctttaggaatttagtagttagcattagcaaaccaattagacaattttgcaccatttttgggaaatgaaatgacaggcacctgccacacaattgagcgatgatgatgtccagctactacgacatactctgcataaatgaagtcccagctgcaaatagaaggtgaaaattaaagaccgtgctttgattcaaaaataactactcaaaaaagaagcaagaaaaactgcaaataaaactatccatgtaaatttcttcaatagcccgaattataaaaataaatggagagaaaaaattatgtttacaactagtcaatttcgggtaaagccataactaaaatttattgttagcatcactcagagctgcagatttcttgtgggttagtagataacttttgtgttcagcgttagtactgattacatcaggaaatgaatgttagcaggcaaaacatataaaagtcaggtaactgtagcaactatgcactgatgaaacatataaccccaagcaaaatgttaacataaacttggaataatatgggaacccacaaaggctgtaactaataattctaaagctcactctacatcctcattgctccttttgacccctagcatgaagcaaccacagaaacactaacctgaaattggtgacgcacaccgatcgaatgccagcatccgcagccgccctgcacgcgacggggacgacatctgaaacctgaccaaagaccaacaacaccacatttgcttcagatgctgtaaagattcatggagaccccggataaaaacagattaaaaaaatcgagcaagtagttggtgttagcatcctcaggagcattaccactaggtcggccttgatcgtgttgagccattccacctcagtcctcagaatcgattcgcgtggcatcacggccgtctgatgatactgcattccgcaccacacaatcactcaatcagccacaaatccacaggcaaagcacagcacagcaagagcaagagtggtggatgttgtagcagtagcaggtagtagagtggagatattggagtatgtttctggaaccttctcgagggaggcgaggcgatcgacggtgagggcgtcggcctggacggcgccgcagtcgaggagcaccttgcggatgtggaggttgggcgagctgatctcggtggtgaagacgaactccggcgcgccggtgaccacgtgcacgtcgtgccccgccgcgatcaggtgcctcaccacctgcactaaccacaaaccaaaattccatcaccccaaataaaaattaaaaaaaaactcaaacagcagcgaatccatccatccagccacgaaaccaaaattccgcgcagaaaccaaaatttcatcgcacggagacaaacacgaatcaatcctccccaaaacgagaaaaaagagaagacgagacctcgagcgcgcgggtggcgtggccgaagccatggccggtgatgtagtacgcgaagaccagatgctgcggcggcgccgacaccaccgccatcgccgcctcctcctcatcacctccgccgtctccccgaatcctcatcgccgccgccgccccaaatctcccggaatttctcccggaacaacaaaaatcgacacttattatcagagactccacactccacactcctcctctcctctccctcttatataagtcagacgatcagcaattgattgattgggagacgagacgacgtggactcgttggttggtgttatccgaattaacgaactgccacgcctgaatttcttttgttgttttttttttgggttttttttgttgttggcgcgatgatttgttggtggtggatggtggtggtggctgccattcccgcgaatctctctatctcttggtgtcattgccgcgattcgcatggtgcctgcagaatcagggcgcaacaaaagagcagatggaagaagcaacagcaagtagtagctgggggagttaggtttttatcctatccaattccagtagcagccaggacgattcgcgtatatcctatccaattgttggattatgaatttatatccgattcgttgtccaactagtccaacctcctctgcaattgatcaaacaaaattaacctgtaaaggttaattggataggataaccttttacttaattggttaatactactagattttaaagtagaggctagaataaattctacgattggaaaaattcttatgctttctaccttttgtaggctttctatcatttagggaaggtttttttataattaagtaaagtgttaatagtgttaataaattaaccctttagttaatttgataacattcttttgataataaattatattataacaaaaaaatgctaattttatagtgcttcttaacggtttcctggaggtaacacattttctatgcctccggttacactaataattttgtatctttagttacatctcaagaactgtaaaattttgccaaaaagtatcatgcttagttactccctcttttactaaatgtttgacgccgttaactattttaaatatgtttgaccgttcgtcttattcaaaaaatttaagtaattattattttttcctatcatttgatttattgttaaatatacttttatgtatacatatagttttacatatttcacaaaagtttttgaataagacaaatggttaaacatgtttaaaaaagtcaacggcgtcaaaaattttgggatggagggagtatttggttaataactaaacataatataaaatgtggataaggataattaacgttgtagaggtatttagcatggcatgagcatgcatgtagatgactgaagatcataaggctataacaaaattggcatttttcaaaccaaactcaaggaagccatgaacatgttatgacatccttcaatttgacaccaaaactcaaaaagaaaggatcttgagaccaagacggaacatataacatcagtccaagtcatcaactcaacccatcgaaggggttgcgtctacgccatgaccttgacgtccatgaccagaacatggcatcgtgtaccgcttgtccctctgcttaatttggcacttttgagttttgacttcgatcaagggatttttttttctctctatgaattctattaacctctaattttttaataaacgacgacgttaacttttggacgcatattttagcatctgtcgtcatactttaaactggagtgagcaataatcaattccgttatcaactatgcaattttagaaaactgcaattttaatgacaaaaccaacattagcgacatgttttagtttactacaacaatagcgtgagaaattatcacaaaactgtaatttttacgttatatgctgctacagttgttacctatatgtactgtaacagcatatataacataaaagttacagttttgtgataattttccatgttattgttgcagcaaattgaaacatgtcgttcatgttgcagcaaactgatagttatggcactaaagttacagttttttaaatttactcatggatatattatcagcaatggttcagttggtcacaaactcacaatcgcaagatcacaaatgcagccagcagcaagtccaaacgcacaacaacaacaacgtcggctgctgcaaacctgtctgcaacgtcgctcagctcagaacacccagtgcagcgtctcgtcgtcgtccttcctcggccggccgcgccgccagctgctgcgtcgtctggcctcgcgcgtgacgaccgtctcggtggagagcacgtaccgcctcacggcgcgcctcgccatgcgcagcggcgccttgccgctcgccgacgcctccacctccactccggtcaccaccgcgaacctctccctcacctccgtctcctcctcctcctcctcgccggcggtggcggcggcattgaatccccagcgccgcgtcgtcgtcttcaatgaagccttcttgttggtatcgagtggtcgtcctcccacctcgacgcgcgtcgtctcgaacagctcggcgacgcacagcctgccgccaccgagctggacgaggtaggacgccaccggggccggccaatccttgtgcggcgggcggtacctccatgtgtggcgcagcgacgggggcgtggcggtgaggtcggaggcgcagaggtggccgtcgtggtgaggggagaagccgaaccagaggctgtgctccgggacgtgctcggcgcggccgcggaacgggagcgcccagtcgccggccttggaccacgcgccgctcgccgtgtcgaaggtgaacgtcccgtgccgctccgtggacacccagatttgggagtcgcggaccaccgcgtgggcggcgacgcgggcgggcccgtcgtcgccgtcggggtcgagaacgtagggcggcgccgtgagggagcgccagtgccagtcctcgatgatggtggcgccaccccgcggcggcgccggcgggaggccgtggacgagcgcctcgaagcagtgctccgccccgcgcatccgcgccggctccggcgccgccgcctccatgacgtagacgccgtcgccgacggtgaaggcgatggggcaccgcttggtcgcgcgcatgtgggggaggaggcggacggcgtgggcgccgcacttgaacaggatcagcaggaagctgcggtactcgccgtccacaccgaccaccttgtccttgccgccacctaggatcatcgcaccgcacctgccccagccgtggccctggggtctatagatggcctcgccggcgcgaggtagctgcgcgtccaccatcgctgccgccaccggcgccaggcgcgggcgatctgcggcggctgatccgtcgcccccgccggttggctttctcggcgggaagaagcgcgacatgtcgatgcggcggagcccgaactcctcgctgccccacggtgtgggtttcttcaccagcagatgcagaaaccggcggctcatcctacaactaccgatgaatttctcgacggcggcagcggcagcggcggcggggggcggcggtttcttcctttggccgtaccggttaaacccctagcttttcgcgcgtccgattttgtactgataacctaaaagatatccccttgtttggacaaaggtatcctaacagattggctgtgtttagttcacgctaaaattgaaagtttggttaaaattgaaacgatgtgacggaaaagttggaagtttatgtgagtaagaaagttttgatgtgacgaaaaagtttgaagtttagaaaaaaactttgaaactaaacaaggccgtagtttgagtaaaatttctcaaatttctgtttgaaatctacaggatacaaatatgtgcaatacaacataagaaaaggaacatatcaagaagatcacaaatgcggaagaggcgaagagcattgaggtggtaaatccaaaatgctagataaattaattggatgccaacatacaggcttgtgttttttgtaacaacaacagtgtacactctctactaaaacactaataatgggcaagatcaggactatttctaggtgtacactgaaacactgaatgggcaagatcagcactatgctagagggagctactatgcacataacaatcattttaccaattgatctaatgatcagcactatgcaccacatggcagccatttgaggtactagtcgtggatgctaactaactggaggatttcttcatccttcctgtaagtaaacagcagcagtcaattcacaacaatgacatctgaccgtcaccttgaccacataacaggtgctgaagggtttggtagcgacgatggggtcatgcagtgttgttgccactggtgaaggctttcgccatcgattgctgcgacatttgcttccggagattcctcaacgtccatagaatcgacttctgtctcatcagactccattggcacttcgaagaattctctcttttctgaatctgaagcagaccaattagataccgtggcaatttgtggtggtgtccaaggaactaaagccaagaagttgctgcacccaggagatttgtcctccagcccgtgaaagttcctttgcataaaagcctgatctgaaagatgagaaagaaaatggtgaggagcaatttcaaggtatggatgataatcctatcctgacatacaggacatgagtataacactagaaaatacatacacataaagtccggtgcgccatacaaacatgctaaagtagttcagcgggctttcttccttaaagttaatcatctaatgctcatcacttaaaacagaactcacacaaagaatgtcaccaagtataagtgtgctagaagtacagaggcattttaagacaaaagcaaatataaaatcaggagcaacgcgtgcagctaacaaacttgcatgctagcaacatagccttgaatatttgttctactactagccagttgccacaaaactaaacagtgagatctttgcaagataagttctgtgtatacttatttcaatatcaaccttggatgcatcacagatgtagtatgtaaaacactaaaacgcctaacacctaaagtagcaatagcatcttctcctatatatctatcccatttgacacacgctcgacatactgtaaaagtacaaaataaagtattgcaaacattcaaatattcagaagaatacaagagtaagttataataatacaaaatgttaagtaacttactctttagactacgtatcaagtctggactgattatgattgaagggttcgaggtcccaggaccaatgcatgcagtgttatctactgacttgtataaaacaagtgccttgtcctcacttgatggatgagattccatggcacctcccagcatgtcttctataatgggcatgctaacaacactgtggatttcctctcctagcatctcatgtccaaatggcatggaaggacctggcgtctcttcttccataataggtggaagcccaatatcctacaaacaatagtcgacatttattcagcaaaatgtgacggtgcagcaaatttattgaatatgtacttacagggaaagtaaaatattgaaaaccaaacaaatgctagaaacgatataatgcgcatttatatcctgaagcaactagccaactacaaatgaaacctagttttcttcaagcataacactcctactggttagtggtaacattgaatgaggtatcagaaccaaggtgaaatatggcaatacattgctcagtactgagaatatctcccactagaacactgagtggggatggtgatgtcataacaaaatcatgcatgccacgcccacaccaatggtggacatcttattaacaatgaaagaaaacaatgtcaagatgataaaaaaaaaagaaaagaagagatgatccattgaagtacagtgaaccacaagaaaggtttgctagtggttccatacagattttgacgaacagaaagatagagtcatttcattattaattaggaaccctctgtgataactgttactgctgagcaaactcatattggataatgctacaatgataaatttggagaggatttatggtgctgataaagcctatataatgctccctccaatcaaaattatagaactaagtttagttctccgaacgtcaaatattttgactggagggagtatctaaattataatccattgaacaactacatgaaagatagtttagggaaacagctggtactcaaatacatagtagtattagctatgctttcactcagctattttatttcgttgggaatccgttgttttctaaactccatcatgcgacacacagatgtaaccaagcaactccaaggtactgacaagcaagaaaatgaaatccggtaaacaaacatactgcaataacacggtagattcttggatgggaacagttgtcatggtaagcccaagatgacactttctcagtgcatttaccatttttttctcagcctctcttaataatctcattgcaaacacggcacccgcgcaaaatcagggcatccataagcatcccgaaatacaacctaaaaatgcaccaaactacctggtagatatcgcataatagtactccaactaacattaaaccaagcaagctcataacatgcatcaaactgctactagtaaccagtgggacgcctaatcatagctataaaagtaaaaaaaaaaaaatatgattccaggctccaagcatgaactacaatagaaatatccgacttagagccaagcacaaagctatgaaatctaacactcgtatcgaaacagtactagagcatgggggaagacagctcggctgctcagctacacagaccaaacgaagccgtagggacgaggagagcaaatggcggtggcgggagctcaccaatctgcggctcttggcggcggggccggagagggagaagtcggagaggccgtccaccacctggtccagctccttcctcttccccatgaaccccaccatcatccggcttcccccaagggaaatcaatcgtgctcgaatcccgcgggctcctcgcgagtcccgagctcgaatcgaggcgcggggatgctgggaatctgggactgggctgtggtgggattgccggccggcgggcggcggcgcggggagcggcgggtttcgcgggatcttggcagatggaaggggtggggtttcgcgtgtccgcgtggggtaattttgcgtgggtgggtgggtggtgcctcgcaccggatggatggttccagaagacgggtggggtcgtcaatggaaatcatccaattggattggtcttagggcattaacaatacgtcacactagttgagttgaggagcctcggggtgtcacataggatagggctagaggtctaaaatttggattcttcacggtgcaagtgtctctaggagtttatatttcagcccctaacattttttttagttcttatagtttctttaatttatgtgaagttccaaaatttacactatacaccctacaatctctactattataaaaattaaagatgtttttgttggtactttggtacatcatccgtgtatgagttgatttttaatttcgttcgtttttgaaaatacatatccgtatttgtgtcggtttttaagttcgtttgcttttggaaatacagaaaagacttctaattgtagctcatgattttcttaaaaaaaatatatttatccaagcgaatttctacagtaaatttcatcttaactaaaccatatctctactattataaaaattgaagatgtttttaccagaattttagtacgtcatccgtgtttgaatcggctttaattttatgtttcggttttaatctatatctctactaaaaacaataaattctggtcttatgttaaaaaaagaaagaaataaagtccaacttaacgagcgataaaaaaaacttccgtcgttagtaaaaaaaaaagcatctcgtcgcttgaaaaaattgtccgactcctgtagaaaaggaaaaaaaatctcccagtaaaaaaaaagtccgtttggtttttttcactggtattttttttccctttttatgtttggctgggtcaaagaaaagcagaccgaatggaggaaggtagcggacacggaatagcggactagtctagggctgaaaaggaaggaaggctttcggccgaaaacacagaaaatatttttattaacctttttaattattatctatagcgatcccaatgttaagatttttattaacttttcaattatagtgtatagtaatcctgatattttttattggtatgaaatcttaggtaatcccgattttttgaaatcttaggtatgacaatctgaaaatttattggtgcttgttttgatataaaatctgaagttgcaatgttgtttgttcagaaatctcaaaaacgttatagtactagttctgaagctgataatatgacaagttttacagtgagttcttgaatgaactagctgataattgaccagagactatttggctacatgtttaataactttaaacttggttagtttcaagaaattgtagcagtgaatgtagcacgttctgaaaattttacctcggtgctgtattttgcttctgacggatataaaatttcactgtattagattcatggcaactagtcaagtactgaactatcgtgtacatgtaatggatgttagatttaattgggtaattaatccatttaaatcaattaaatcaaataaatttcaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccatgactcttactcttcatcttccattcctcttataaaatgagaatggatttgatctcccgcgagaagaagtagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaattctattgtaaatatcatgtttattatcttgttattttggattaaaatatgccgaattatgaccaaatttccaacaatggatacatatccaggtttctaaaactactagtaaaatgtaattggttctgttgtgctttcatacattttccgattccaagttactattggcatgtgtgaatgcataaaagaaataacttgctgttgtttgttgttcatgtgaaaatggatggaagtgtaaaaatatacaaaagctcttctgttcattgcaggtgatcatttgatatgctaccccggtgcatttaacatgactacagggccattgcactgggagttgctgcaaagagcaaggtattacattttctaaatcatttgcacctgaaaatattacgatcattcaacgaataaatatgagcttaagggacaaataagagacaatgaattggactggtaatgaatttctaaaataaactcaaatgtacagacaacttaagcttggttagtttcaagaaattgtagcagtgaatgtagtgtatgtagtatgcacattgtgtacagtagcatatacttctctatatgataaagttgatcctgtacttttccatgtgttatggtgaattggtggtgatgttgtgaggtgatccatgcatatattatggtgatggcagaagattctacaataaacaaatttgattttcctgcaacttgtaaattcgcagagagatagggcgaggagtttgaaagaaatattatggcggtcaaagaaacacctgatgaagcacagaagcttgaagagttcttatgcgtacgaagagaaatgctgaaacgtgtttaactggtgaatatgtcgtctgttgctttgccgtgtaaaaaccgttttatcctggcacttgtctgcagggtgcctgttctactaggacaatgaggcacctgttttgatagctctcttttcatattgttcatgctgtaaaaaatgggtgcaactgtttatggagaaaaaagtgggggatgcgaatcatactttgttgtgggaggatgtgtggtatgggcaaactcctgttagagtgcaatacccaggcctgtatggggtcagtttacagtgtgggaagactgttaggcaggtctgagacgggggggggggggggaatgggatctaaagtttttagaagacatttgtgtggggggagtttgttggagctgcaagatcttcagaataagttgagggctgttgacatcacttcagactgtgataggatcatttggcctgctaggaggaagcgggagtacaatactaggtccatgtatctctactacttaaaaagtccgtagtggtggtcttgattcctgacatagcagacgcatcttacagacatgcataatctcaaccatccgattgccatatccaatagcgtcaatctcctccacatcacgcgatcgctcctctcccatcacgcgctcgctcctccccatgcccactcctttccccacgccgcgtccttcgccctcctccctgcgtcgcctcctcgccccgccgtcgcgtcgcctcctcaccagccatgcccaccggcctcctctccagacccccgccgccctctccaatctccacgcctccacctcgcatcggatcaatcctccaccttcgccctcctccctcctttccctcccacacggaaaagtctatacgtactaaatttttcttacaaaatgtttacaaactctgatgtgtcaagctgtgagtaaatctagatttcttgtaacttccatctagttaaatcaaatggttgagaaatttgttagtaaaagttttgtaagaaaattttagtacgtgtagcagtactcctcccacacacacgactcgcgccaccaccggcccctcaaccccgccaccgcttcttcccttccgctcctttccctcccccacccaccggcgccgctaccgatcccgccgccgcactaatctctctcgccaccgtcgcccgccatctccttactccgcaggccttcggcacgccgcagacgatttccacgccgaccggtcaccaccgacgccgtcttctccctacttcaccgcaggtactgcttcattgcttccgctcccaccttccccttctctgatcttttatgtcgctcccaccttcctcttctctgatcttttatgttttatgtggtagcttgtggtagctaggtcttttatctatactttccctgcttcttcttcttcttgttgtgtttttgttgctggatgagtggattgatcaaaacgtatgtcctcatccgagagaatcaacaaaaaatcatataggcatcatttatgtttttccatttccactttttttcactaagtaaattaaagaaatagtaagtttgcagtagtgtccgagttgtgaatttactaatgaaaacatccaaactgaacgaagtttgttttgctgtgg
